United States Patent 7,833,706 (GENETIC POLYMORPHISMS ASSOCIATED WITH RHEUMATOID ARTHRITIS, METHODS OF DETECTION AND USES THEREOF) - sequence listing, part 6

SEQ ID NO: 10685 - DNA, 22220 bp, Homo sapiens
  misc_feature (1)...(22220): n = A,T,C or G, or insertion/deletion polymorphism (see Tables 1-2)
ggcaggagaatcgcttgaacctgggaggcggaggttgcagtgagctgagattgcaccattgcaccccagcctgggcaaccaaagcaaaactctgtctcgaaaagaaaagaaaagaaaaagaaaaagaaaaagaaagaaagaaagaaagaaagaaggaaggaagaaaggaaggaaggaaggaaggaaggaaggaaggaggaaagaaagagagaaagaaagaaagaaagaaaaaaagaaagaaaggaagaaaaccctgtttttactacctcctgtttctaatttctatttttaactaaataaaatctagctctcttgttgggagactggttatagggtatctctgtgtaagctgtcccttgacttcatttcgaccccaccgtccctgacttatcttgaagcctaaaaacccttttgaaatcctgtgtgcattttacttttcttataatattctttctagtcaccgttcaaatgcattttaagtcatttgccttgaggcttttgaaaaagatagtgcccattcacactgaaaccagccacatatgaagagtcccatttttccacatcctcatcagctctggacatttttgaaaaattttgccaatctgatgagtacaaagtttatctcatttttgtatttgtatcgcattatttgtattttcctgagtagtaggaaaggagttgaactttttcttaattttagaatttattttagaattcctctgaatttctatttttatttctatccattgttcattttcaacatttttcctattttaactaaaatattttactttggaaaaacttaatatagaaaataatagaaaatcatataacaagcaccttataaccacaacctagaattaacaaatacaaacattttgctatgtttgcctcagatttttaaaaattaaatattacagatttaattttttaaattttaatctcaaaaaaatttgagattccctctgtccatttagttctcttcttagttccattcctctctcgctctttctctctctcctcccggaagcaaacactgccataaatttagtatgtatcctttcaggccttgtgtttaaacttctatcacatatatggaaactgcaaactatatgaagtgttgtgtgtttctaagtgtatataaatcaccacatactcattactgttttgagacctagccatatgactacatacagatcactggttttccatcagaggttttgtcccccagggacatttggtcatgcttggagacatttttgtttgtcacaactgggggataggagtgctactggaatctagtggtagaggccagggatgctggtaaacatcctacagtgcacagggccaccacacaccaaagaattatccagcctaaaatgtcaacagtgctatcattgaaaaaccctgacataggatttatttatttatttatttatttttttgagacggagcctcaccctgtcgcccaggctggagggcagtggcgcgatctcggctcactggaagctccgcctcccaggttcccgccattctcctgcctcagcctcccgagtagctgggactacaggcgccggccaccatgcctggctaattttttgtatttttagtggagacagggtttcaccgggttagccaggatggtcttgatctcctgacctcgtgatccgcccgcctcagcctcccaaagtgctgggattacaggcgggagccaccgcacccagccaatattaatactgttacatgcatctctgagtgcacatgtgcaaggttttctctagagaggcagaatcatacagggtgtaagaaggctctagaggctacctgggttcaagtccccattccactatttacttactgaatgacctttggggcaaattgcttaatctctcttgatctccgttgacttgtcctcaaaatgggaataataatacttctctatataaatgagttaatacgcaaaatgcttgggactgtgcctggcacatggtaagcattcaagaaatgttagcttttatttactggtagcagtattttcatcatcatcattatcattacagaaccttgaaatgaaagtacaccgtttaaattctactaaatatttttaaattattgtaatttatactctcaccagtagggtataggagtacctatttctccatgtccttggctatatttgttattccagacttaaacttaagatataaactgatatcttcttttattttaattggcattttcttttttcttttttctttttctttctttctttctttctttttttttttttaaggaaacgtcttgctctgttacccaagctggagtgcagtagggtggctaaagtgcagtggcatgatcacggctcactgcagcctcgacctcgcaggttcatgcaatcctcctgcatcagccttccaagaagctgggactataggtgcgtgccaccatgcccagctaacttttgtattttttgtagagacagggtttcaccatgttgtccaggctgctcttgaactcctatgctcaagaaatctgcctgccttggcctcacaaagtgctggaattacaggaatgagccaatgagttgagcgtgcattttcaagattactgttttcaagtatttattggttaattggttttattgctctgcaaatgtccatttcattctctgtccattttttgatttactatttaatgttgtaaaacataatgtaaaaagtactaaaaaagaaaaaaacttaatgtatttatacaattaaaaattcacaaaatgtaatatgtcatacaaagaaaagcctctcttccacccctgttccctggctagtcagtccctctccttagagacaaccattgttagttattaaattcttatccttccagaaagaacttatttggatattcaagaaaataagtatatttttttctacccaaatggtagcatagtacatgcatttttctgcattatttgttttttcctttcttcacataacaacatatcttggccatattttccatatgtaaataaggaactccctgattcttttttatttctattctgttataaagctgggctataatttatttaaacatttccatactgatgtacatttagattgttttctaatattttgctaatgcaaacattaccacaaagtccaaaataaatttatatgtgtaagtatatctgtagactaaattcccagaggtggaatttctgggataaagggaatgagcatttgtagttttgaaacatatcacattattttcctccatagacattctaccaattcacataggcccggaaatgtgaatcctgaggcaggggaagcttctgtagctggaatcgtgatgcagggaggcttatgtaacwttgtggggccgtctagtctgacaactgagctgcctctagccttcactggcctctgataaggtgtctcatcccattagtcttggcaggtcccctccagatctgtgcactcgctgctgcatggctctgtgtctgctttcttgtgtgtgacagctgtctcatgtgcatgaggctctgcatcatttcctgttctatggctaatttttataaactctatgcctcagaattggcttggaagtcctttggaactaacacaataccaactatctcaagaccctagcccttgcaaattggaggcatttggtttcagactactgagcctactaagagtttaaaatatccattcaagggctgggcacagtggctcacgcctgtaatcccagcactttgggaggctgaggcaggtgggtcatctgaggtcaggagttcaagaccagcctggccaacatggtgaaaccccgtctctattaaaaatacaaaaaattagctggatgtggtggcaggtgcctgtaatcccagctacttgggaggctgaggcaggagaatcacttgaaccggggattcagaggttgtagtgaaccgagatcacgccattgcactccagtctgggcaataatagtgaaactctgtctcaaaaaaaaaaaaaagaaagaagaaagaaaaaaaatatatgtatatatatatctccattcagtccagtggatggatgacccaggataacaataataattctgagagagtaaagcacctttgaaacactgtagattctcattttttatgtctaaatttccttcctcatgaagccatcagtacctgtttggtgacagttstttgaaactctccagtggtgttcatatgagtattttcattctctctgctgggttgcccagcttcattgaaataccaatgttcttttaaaatatttgtttatcatttttaaagattactatttgttttcattaatgctgaaacaagaaagaataaagaagacttaatgtggaataggaaacctggaattaagtctgagatctgtcatttattagctggatgagctggaacaattagtagtgtctctaaaccaggggttatcaatgtgtgagcctccatcaggagcatcgacttctccagagaatttgcttaagatgtcaatcatcaggctccaccaaggacctgttgaaagagaaagtctctactggagttcagcaaatctgaattttaacaagttttccaagtgattctgaagaatactgagttccttttttgagaaaggataaagataatttcttacaggtgagaattaaatgaggtaatataagcaaaataaatctataaatcagagtcataatgtcaaatgccttcaagggccaaggagacgtgaggtagcagagcggtggggaacatagccaccctctctaaaggcatctacattatcattattttctaaatcatcatgccagtcaaacaaaacctgtcaaaagttaaattctgcttctaggggccagcagtttaggagtataagtaaaacaatttacagatgttagactgttttaatttaaccctaaaacaaacaaaaagaaaggtctggaggtataacatttctgaaagtctttggtttacagcagttgctataaggggagccacataatttatagtccaaactggacatttctgaaagtgaaaggaggtgctattaataattacaccaggacaaagtgaaacccaggatggttccaggcaaagcagagtgtatgatcactctggctattattataataatcatccacaagccctgtttgacctaagattaagatcagacaaaaattaatggtgtacttcttgctggggacagacggctgataatggagagtgaggaggtgagggtggaagctataccaagagaaggggtagggaggaagcacccttttccttaagacaagaggcaaggagggaaggttaggacatgaatgtacagaagggaatgtatgtaacactggttgatatattcctagtcataacaaaagccatagaaggcaagtcagggatcagagaagcaccaagaaggaagaagaagaacatatagacagaattggcaaagcaaagaatgggcacggagacaccagcatactggagacatacagagaaaaaatcaacagaggacagactactacaggtgttgtggggaggcagaagatcaccaggggcaagagcaaagtgcaaaaacaaagaacaactctttagaaaggaagttccttgcctatcctactgagctagagagtggttggttgaccctgtgactggaaattccccaaggtaggtgatgataacctctacattttcacaaaattctgtgaggagccaaagcacctgaggtagagaattgcccttcccctactttccagatgctctaccraggcttgaactttgcatacaagatgcccaaagcattgcagtgaactggctgtgacctttcagtaggcatcaccacccacccctccactccctactcagagctgattgggaaatsccccataagtggtgtttggtgccccggtcattctgattttagtcaaccaccatacaaacatacctttagtccaaagttcaggacaacttatttcactttataagcagcctattacacattcaaagtatccatttgttctcaagaggtagcaaggtaggactgcccatctgttttcctctctttataatattttctagatcctaaattttacgcttttctatcatttatttttttctccctyttcttttcctctctctctgctcttctaactaattggcagaatctctgacctccactttctctgactcccttctcccttcctagaaacagtatccacagtggactcyggggctcctacagacttggcacagyttcctacagtcttgaaacagccctgttgttctgtcatggccagtgggcagtttgtgaacaaactgcaagaggaagtgatctgccscatctgcctggacattctgcagaaacctgtcaccatygactgtgggcacaatttctgcctcaaatgcatcactcagattggggaaacatcatgtggatttttcaaatgtcccctctgcaaaacttccgtaaggaagaacgcaatcaggttcaactcgctgttgyggaatctggtggagaaaatccaagctctacaagcctctgaggtgcagtccaaaaggaaagaggctacatgcccgaggcaccaggagatrttccaytatttctgcgargatgatgggaagttcctctgttttgtgtgtygtgaatccaaggaccacaaatcccatratgtcagcttgatcgaagaagctgcccagaattatcaggtaggcatttgaggtttcttccctgttcccccatcagcccaggagttcagtgaggccctggaaactgctaccttcccactgagggtttgcaccccattgcccccaccccttgggcttgagtgggcagctcgcagtcaggcacagtgggttcaaagagctgagtctggggaackgctgactctctaaatcaaggtgcaatggagaatggaaaggatgtgaaaatttgactcagaaggtttgggctcaagcccagtcttgtgagtttactgtacaacctgcaaggaatcactttacctctctgagcctcaggtacctcacctttcaaatggcaaaaacaaaacaactctcttaaagttgttggtaggacagatgaagggaagtttgtagttctttgataattccaaagcaccatccatagtcctagttagtcataaataactatgttctggtcatttaggtcacttaggctccagatttctcccttctcagcaacccctttccccgccagcttgagaaaggcgagtccttaataattacacaaggactcacctggagagtgtcaccagctctcctaagagaccaggaggattttatgaggccagaaatctccaggcacagcctgtccaaacggccctctttccgcaggggcagattcaagagcagatccaagtcttgcagcaaaaggagaaggagacagtacaagtgaaggcacaaggtgtacacagggtcgatgtcttcacggtaagaaaaactccatcccacgatctctggaagcagaaacatctctgccaaagctcctggaatcccctattacactgacccctcagaaaaagatccagtgagccatgtcctctcctckgcgcctcagcacctgaccggccaggcggcatcacctcccgcgtcggcctcgctattacagcgggctgactgctcagtctccaccggcagacaaggtggggcacggaaaacccgcgctggtcttagaatcgcaagtacaggtttttaaggccgagctgcgccctcaacggattccccarttagaaaatgaagacattggccgggcgcggtggctcacgccagtaatcacagcactctgggaggctgaggatcgcttgagcccaggagtttgagaccagcctgggcaacatagmgagactctcctcttaattaaaaaaaaaaagaaagaaaactagccgggcgtggtagcacacgcctgtagtcccagctactagagaggctgggaggtgaaagtattgtttgagcctgggaggatgaggttgcagtgagccgtgatcgtgcactgcactccagcctgagtgacagagtgagagactgtctcaaaaaaaaaaaaaaaaaaaaaaaaaaaaaagacagaaggaaaatgaagacattgtgaccccacttacctattttcctgtgtgcgtgaaaggaataaaatctatatgaaagattataaactgaaaagccttctggaattgtattagacagttccttgaaggcaagtggtaaaccataaattaataatttcgcttaaagctgagcacgtagtaggtgcttttagaagtttgttctcctctcctttcctttcttccaggtctgccctggcacattgctctggttgggaattccacacaaacttaataaaattaatggctgaataaagtgggctagaaggaccttcgaggccatcctctcaccctctgcctgtccctgtttcttaggaccaggtagaacatgagaagcaaaggatcctcacagaatttgaactcctgcatcaagtcctagaggaggagaagaatttcctgctatcacggatttactggctgggtcatgagggaacggaagcrgggaaacactatgttgcctccactgagccacagttgaacgatctcaagaagctcnttgattcccygaagaccaagcagaacatgccacccaggcagctgctggaggtgagtcccttgggggcagaattgcagagaggtagcagcccatccctagtctcaggtcagarcatggaccactggcagaatacctgagattgccccaaccatcctacctctagcccagtgctgtccaatagcaatatgtgagccgcatgtattagaatgaaaatgtgagccacatatgtaattcataaatataattctggccacatgtgtgatttagaaatgtagtttcagccacatatggaattacaaatttttctrgttagtcacattaaaatgataaaagtgaaattaattttaataaaatattttaactcaatatatctgaaatattatcctttcagcctgtaatgaatattttaaaagtattaatgagatatttcacattctgggtttttggtggttttttttttttttttttttttacactgagtctttgaaattgtgtgtatatttttcactttggcacatctcaattcagatgctaaattgtcaattgttaaagtaaaatatagtcttaccaaatcaataaagttgtgtttaatggaaaaagtactttacccttcttctatttattttattttattttttgagatggaatcttgctctgttgcccaggctggagtacagtggcgcgattttggcrcactacaacttccgcctcctaggcccaagtcccaagtagctgggattacaggtccccaccaccacgcccagctaatttttgtattcttagcagacacggggttttaccatgttggccaggatggtctcgaactcctgacctcaagtgatctgcccacctcagcctcccaaagtgctgggattacaggcgtgaaccaccgtgcctggcctctatttttaatttaaatttgaattagtaaaaatgaaattaaaaattcagttctttgtcacactagccacaatttccaatgttcagtagccacatgtggttggtggctaccatattggacagtgcaagtctagctggtgcttaaaayaagctgagatgattcctcctcaagtcatctattctcccacaggttcaaaaacctatttatttattttaagaaagatcatgcaaagccattctagcctttctcctgccctggctagcaggctcccttgttcagtctcagagccaaattcatcttctaaatctcactcttctcttcttcactcagttcttcttgaggtcaaaacacttttctgcttactggcagagcagtgcttcttggagaagcccttcgtggtggggagaggggaggaggatggggtaagagagacttggaggggttcttactcctcctgctctgccccacacccagcaggctctgtatctcctccttggctcctgggaatcagccaagtgctgaggctgtgctgtttctctttctcttcwaggatatcaaagtcgtcttgtgcaggtrtgatgggccaccccaaatgtattttgcctactgattcatccacayacaattctcagcgtatatccaaatgcrgtcaacattcctctctcagaaatacccacccacctctaactctgcattcatacatttaggctgcagcyggggaatgcctatgccaaccatattagcacgtggttggttgttaaagaaaccagctgttttctcagccttcctccttcttcagcacagattctactatttcctgaatgcccccttgctcaactgaatagctcctgggtcccctactctgtctccctgaccctgtttttttccctcctctctgtctccatctcccatcttcatttccatatctccctatgccctacctcactcctkccccatatccctagccctgactttctgactcccagctcactatcccttaaccgccaggtcttcttctttttttttttttttttgagatggagctttgctcttgttgctcaggctggagtgcagtggtgcaatctcagctcactgcaacctttgtctcccaggttcaagtgattctcctgcctcagcctcccaagtagctgagactacaggcgcttgccaccaagcctggctaattttcatatttttagtagagaccrggttttaccatgttggccaggctagtcttgaactcctgacctcaggtgatccacccgcctcagcctcccaaagtgctgggattacaggtgtgakccacygctctcagttctacccccaggtcttcatcccctcatttctcaaccscrtatctcagatcctccttctcccacacctcatcccctgatctcaccaaccagctcaaccacatcttcctagaagtgaagagtttcagtttctcaacccaacccctgttcctctrgaactggagaaaaaactcagtgaagcaaaatcaagacaygactccatcrcagggagcctraaaaaattcaaaggtaaggaagaggctgtattttctctaktcacctacttccaggagattctctccctgctcactccactgaaatggaactgtgactcatacatgccaacaatccctgggcccttctagtgccaggcttctggctgagtactttccacgcatcagtatgcctcctcccaggcatttcttatattctgtcttcgtgatatgttatttatctgcctccctgrctcctgcgagagccatagagggcctggacctattccccatgtggacacctggcctagagcagtggctgttgggaagttggtgatgagttgtctggtggaccagagatggcctcaggcagggactgtcatctctgacttctccttctctggtgcacactggtgtctcctcctgcctacagaagaagagaaaataaattcaaaatcagtgacattctggggagaaacctcttccagccttacagggaaacagaaatcagcagaacagtagtggatgacttgggttttagatgttcggccagatatttttcataaacctttctgtgtttgcaactaggaagaagggttagtatttgtaaggactccccttaatgtgaagactgtgttggtctaaggtgggcataaagacagctagatggaatcttctgaaattatcacctggagttccacacccacctcccccaccccaacccccagccccccatacacaaacacttccccttgggactacggaaaaggaggaccagggcaatgccccaagatctccacccattcagccgggaatctccactcggcagacataaacaggaaagcatgttttgttttattcttaattttgttgtctgagcttttcttttgtccactaactgctctgctttgtctagctcctcccaccccactgggcatgatctcagccgatctagcaactttatttatttgtttatttatttatttatttttgacagagttttgctcttattgcccaggatagagtgcagtggcgcaatctcggctcactgcaacctccgccttctggtttcaagcaattctcctgcctcagcttcccaagtcgctggtgttacaggcgcacaccaccatgcccagctagttttttgtatttttagtagagacggggtttcaccaggttggtcaagctggtctcgaactgctgacttgtgatccacccgcctcagcctcccaaagtgctgggattacaggcgtgagccaccacgtccagcccgatccagcacctttctaggctcttcaggtcaagaatagtttggttctagtttggaatttcaataaaggagcccagccctttccacttcatcaggtttggagttggggagactggtgtgctctactctgtatcccccttttctttccctctttcacatacacaaactcacacacacacagtcccccaactcccacctggccctatttccttcttttttttttctcttatttttattttatttttaccccaaagaagaaggcacaatggccacctggccctattaaagcctaggaaatacaggaggtggtagggagtctacttataccacaggtccaatctccacagttcttattatgagggttggttctccctgctcggggtgactgggtctggaacacgtacgtggagaagggtgtggctgggccctgaagcygctaaaggcccttgtaggtgaagtgctcccaggcagtgtttcctatgctctaggtttgcagacccctcctaagagggcccccgcgtctccsctgagcagtccccatgactgggctggtggctctcagggaagctgcccacgcttgtcccactacctagccccaggctgtcttgtgctgtcttggggctgcaagacactgggggaagggtgctggggccagaagtagctccccatctaggggctccaccctatagttctccactcagtccagcacccctacaggaaatctaggccaggaatgggccattgtccccagcttctgggctcatcctctacctgcaaaaggagtctcttctggcaggggtgaactgggagatgaaggcactyggcctccccttgcaggagctctgtcttcgttccccctctcaagccctctttcatgggaaagagggcaggactgccatccaggctttaggagagtggggcccccccttaccccacctggctcctgggtggttagccctacagtaggccttctgaagctaaagggtgaagcctcaaggcactctttgtcctgagcacctacctttgtcaggcagtgagaaaggggctagctctgcactgtccaatttagtagctgctagccacatgtgctgacaggcacttgaaatgtagctagtccaaatttaaacatgctatatgtgaagaatcattaatttcacaagattgagtgtaaaaagagactgtaaaagatagcaataatttttataatacatgttgaaataacattttgagaatattgagttaaataaaatatataattaaagttaattttactagtttctttctactttttaaatgtgactactagaaaatttaaaaatatataagtggctcacattcrtgactcagattacattcatcattcatactggacagtgctgggctaggcagtcaccacagraaakcagaaagggcatctctcaagggttgcataccttcctggtccaataagaatatgagagtcaaatgcrgcttctacttctcccaggcatttcaaattagtgccttgctgtgtgatagtgagttctttgctcaacccctctggactctcaccatttcatcccattctttattccccagaccaactccaggctgataggaaaaaagatgaaaacagattcttcaaaagcatgaataaaaatgacatgaagagctgtaagtgagaaatgatggttggttgcttctgccatttggggaaagtgagaaaaggggaagaattgtgtctctatgattacatgaaggccagatataagtgaatgccgattcctcagccaattgagagaacaggcatatggttgttttattattttaaactcaggtaactcacaaaacagtcactaatcccaaactttgaagtattcagaagtaatagaaaattrcaaatgtatttcttcactcctagagacagggaggaaaaagtgggacaagaaggaggcagctccacctctgtagtatttgctgcccctacagggcascaggtttcgaggcaaactcctctgggtgtgaggtcagtacagctcaggggatggagacccactgtaataacagcctgtgctaaagtcattagatatggttctgccacctaagayaataacagtagaagtaccatttcttaaaggaccactatgtgcgcatctaatatttcaaaaccccacaactatcctccaagataggtgttattatctgcaacttacagtgaggtccatgtagcttccgggaggggaggtaagttacccaggtcatatgatcattaagtgaaagagagagaattagaactcctttctccaaagccagaaactacagaatgcattccaaagccagagagcaggatttagggatcctattccaccagcatttctccacaaaaggagctaccggtgtttagaaaggccatctttgttatgctccatgacttttgccctgttaaatgcttagtatcccaggccccagaaagccctataagccagtagagaaccacactcttgttgtcactgagacaacctgaaaggtttccacacttccccctgggtggggaatgggtcccactgagaaccattgactgttctgattgatgatggcagggtgcttgtttttgtttttaatttgcagcttctggttatcaagaccaaataggttttctctccccaatttttagggggcttgttacagaaaaataatcataaaatgaacaaaacctcagagcccgggtcatcttctgcaggtaagagtcctgtctctgaatactaagggacctctaagtctacaggtggtcaaaatgctgtatccacccaattccactaaatggaataaatgaataaatgaatgaattcatttattccrtttcctcagttcctccccaaattacacctctgccaggaaacagagggcgctccgacttgttcaggtgtactttcttgagtttcacctccatccctcctgctgtatgtagagctcagctgtgctgtctggcaatggaggattgctgccgaggtgctcccgctgacctcttttctcctttccttctcccgcaaaggcggmagaactacatcgggrccaccaaatcaccactcttcagccccatcccactccctgtttcgggcctcgtctgctgggaaagtcacttttccagtatgtctcctggcctcttatgatgagatttctggtcaaggagcgagctctcaggatacgaagacatttgacgttgcgctgtccgaggagctccatgcggcactgagtgagtggytgacagcgatccgggcttggttttgtraggttccttcaagctaagccagytcagagaacacggggagcggtggtgctmcacggacttcggagcatagagtggcgctgagtgagtggctgagaccgaccacggttcttgacttagtggaattgggtcgaaggagtggagaatgggagggctcgggctactgagagtggagatgggggcgggggtggtggtgaagagagttggagaaggaatggacgarttcttgagcaaaaggaggggaagagacaatctccagccacccgccccacgcttgacttcttatcactttggctgtggtgccgcctagtggaaaaaggaagtccctgcagcagtccccgcactctttaagcagctgtttaccgaaggcaccagttcagccaggagtgaaatccrgagasgagcaacgccagcctgggtcacagtccatcaaaccccatgagcccgaccactctcgctcttccttacattcccacgtcccccttctctcccaacccctcatatcagcaagggaaattaattaatgagatttgataaatcagtagatagaatgaggtccccattctgaaatatttagcagactggaaccaccacgcaagcctctgtagggggtggatggagacacttctaactttaataaactgcgactgaacgtggaatcctagtaaaagtgtatgtgtgtgtggcgggggatgactattcctccttttgtattccaacactttcactcatccctgtgtttgaggaactccactttagaaaattactggccctcagaaagtstgagccttgaccctcttatactagactcaattcttgtcttagacatgggaattaggggccacgggaaatggacaaggaagagatggtctcatcttcgggtgttgaaatgatctcaccaccaccaccaatgaagaacttctctctgcgcccacagaacaacacattgtgaaatttagggattaactttgaggaggaggaggcggggccgggcctaagacttctctggggaccacaaaggctgtgactgggaagagaaagcctctctggcggcatcgagcggggcgggtggtgggacgggggtatcagaggaaggtagggggtttggacaacttgacccggggttggccacctctttctcctcatcttcacacrgcccctgtgacactggacgcagcctcggcccacccggatctcatcctttcccaggatgagatagtgacgctgaacctcgcatcccagggcggttcgcagaagcggggcaacccccgacgcttctacaggttccgctgagtgctgggctcgctgggcctttgctccggccgcggcgcctgggaggcggagctccaasggcccgggggcggggcctgcgtgcygggcttggccttggagctggttcccaggcggggcttcctggaggtggagcccttgaccggcttcgtggagctgcacagcagcggctcccagtgccaggcgctcatcgagagcggttcccgggaggatctcccgatctgtccgaacaaagtgggcgtccgcttggattactagggcggagaggtagtcttctacgacgccacctcgaggacccacatctacactttccatgcctcctttccggggcagatctcctttttccagcttctgttttccggcacccggatcaccctgggtcgctagagttgttctttgccttcctctgcatctcctcctcactcgcttctcgccccagtttgggatgtgctgcagctggaagggttgaagctaggcttccagcagccctatgggaaggttacacccttcgggcttcctcctgatccagtcctgatttctctgaccctgctttaaatattccttctatctcagttcctctctccttacaatatgcctgggtcgaaaagaaaggctcaaatacactaaaaggctatacacaaggctgttcattgcagcacagttggtaacaggataagactggaaacgaacgtctatcaacaggtggttgaaaaagctgccacgtgcaagcatccagctgcatctcggttaagacagacacaggggagtggaccactgaccccagcttgtccgcctgtctcctcctccattttacctcctgcagcccccgtggacctgcacagggctttgacccatctgaaccccatcctgaaaaccgacatacgcaaaacttttctagttcttcataatactcagaaaccaaaattaatcccacgaccagatgcatcctcctctcaaacccacatcaccactacccgcaacaaaagtcttgatcattcctagtgttgccatgtgagggactgaagttaaacccagagaaggactgctccagtttcctgagtgagcccaaaaaaagtaaaagggcgaggaggttggaaacgcagagacgaaatgacctctggacagtaaaacccaccatttgcgccagtttgggatgattatgggttccttcctcttcctcccttcaggccggctggggactgggtaggcggatgggaccaggcgtctctaggcttttcctgcctcctcgctccggtagggagagggcggtgttgcaggaggcgtggggagtcgcccgccagcccacgctgctgcccggcgcgtggctgcgcagcgggagggcgggcccaggtgtcggggcgggagtgagccaacgcccggagcacggattccaggggcgctcagtcagccctggccaggctcccccatycasttcccccagtcgcccgcgaggcgccgccgattacataaacagccttcaccttcctgcggaggggacaacaaagggctggggacacacaggccgagacccgaaagtaacgcccctccggacttttattcagaatcagccgggactgcccaaatccctatttacagttctcacagccctcgtcatggtcatggacttcgcgccttttaccttgtttcctttcattgtgtacagattcaacttccttactacaaagggagatctttcccaaatgtcttaagttgattttatacttcctgactctaccaaccccagacacttagcacggaccctagaatggggtacttgattaataaatatttactaaattaaaaccatgccctaatttctcttttcccgcgaaagactgatgtcttggaaatcccactcaattttcgtggaccagctccacctcacctcctccaggaagccttccccaggcagggttcctggtactttctgttggaaaagtgtgcacactcccaaagccactacagccatctccctgcagcacttaccgcaagttgactgtgaagtcctcgagaacagaagcagcatctcactccttttcgtttcactctcccaccctccttgagcactacagggcctggttcctaaagggatgtaaatgaaggaagggttcaaagtaaatgaaagaatactttgtagcaaggtttaaatctggggaggtcttccaacctggaccttaaccttaaacgatgatcacactcttctcagctgtgagggatgggggtcgcctctttaggagcctctcagaagctcatttactcaaagagagtcctggccattcattcgatgttatggccgggaagtcaagtgaatactgaaccctggccaagatttccatcccccagtccaaagtgttttctgcctcttcacacagttatgatactactaacagcatgtttacaatgttgaacagtttattaaatggattcagatacattattccatttgcttctcacaactgcttaaattaggtatcgttacattcccatattccaaatatggtatgaatgttcaaactcaggtctttcaacacaaagcacatgcaaagttgacttgaaaagataaaatctcataaaatatatgataaaatggctataacaaatagtaactttccacggtatttccctacacagacggacacacacacacgtatacatgcacacacacacacacaacttatctgctatattagtttcctagggcttccataacacatcaccatagactgtgtggcttgaaacaatgacacattctcttacagttttggaagcaagaagtctgaagtcaaggtgtcagcagagccatgctctctccaaaggctctaggaaaaaatgcttcattgcctcttctagctcctggtgtttgcgggcaatccgtggcattctttggcttgtagatgcctcactccaatctctgacagcattttcacatggccgtctcccatgtgtctgtgtcaaaatttccctcctcttataatggcccaccctgatccaatatgacctcatctgaacttgatgaaaagaccctattttctttttctctctctctttctttccttctttccttccctccctccctccctccttccttctttccttgcttccttccttccttctttcctctcctctttctttctttctttctttctttctttctttctttctttctttctttctttctttctttccttcttttttgagacaaggtctggctctatcacccaggctgcagtgcagtggcatgatctcggcttactgcaacctccacctcactggctcaagtgatcttcccacatcagcctcccgagtaggtgggactacaggcacacagcacatgggactacaggcacacagcaccatgcctggctaatttttgtattttttgtagagacagggttttgctatgttgatcagtccggtctccaactcttgagctcaagcaatctgcccaccttggtctcccaaagtgctgggattacaggggtgagccacctcatctggccaagaccctatttttgaataaagccacatacgtaggtacctggggctaggacttcaatatgtccttggcagacaaaattcaacccacaactccataatctgtcacccacaggaaagcgagaacataaaaaagaaacaatggtattggaaaagagccaagggcaacacttgggggatgctaagatgagcagaagggaaaagagatagtgagcatagagggtgtactctccagggagggtcaaatttgagtatctggcttggaaaaccagagaaaggagaaagatggttttcaaaagctaaaagaggaaaaagcatggcaggagtggagaagtcattaggagggtggaagagctgctccctagggagggagagtaagagccactccactcctggggaaatccagtgaaaactggggcaagtgtcaagagatggagatccacggtactgagtcccttcccccaccagagtggcccccttgaggagccaggggtctgcaagctcccaaagcatattcccatagaaactctggggtcatgaagtcatcttgtcccccttcccagacctgatcctgctgcctgttttatactcattgttgctaccaacccccacacagtcacccaacctaggtgttatcttcaactctttcttcttcctcattcttacagtccttgaggccccaacctccttgatgttagcgcctaccacaggactccacccatcttcctcctagcactgtctagatcagccctcacctggattatgacagctgcctttctcatttccctgcctccagacttattctgcccaatccatcttccattacccaggccaaagtctatgcttttctaaaattttattttgaaaatcttctgacagaagagttgaatgaattttacagtgaccatccaaatattaccacctacattttctcattagcattttactgtacttgctttatcaaatatgtttccatcgacccattccttcatccttctatccatcttataattttatgcattttaaagtaagttgcagatattcaaatgatttctaaaaatataatctggtcatgttagaacttgttggactttcaataatgcctcccttctctaaaggataaagcctgaactgcacgttggcctgccttcagcctaacccctgcccccacctgcttcccatttttcactccagaaaggccaaattgcctaaaattccccactcaccacactgtttacatctccctgacccgctttcattgttccttcttcttagcttgtcctcagccttccagggcctcaaacgcctccttccctgaaagcctttcttgatcccccactcctctccgacactggtttaggcaccacatctataagcacatagcagtccccagggcatactttgatcactgcactaatctccacaatcaagacgatctgtttatgtgtgtttctcacctctaccccaactgagagcttcctaaaaattcagggatcctgctttatttgtctattgtccttggtacctagaacagtctgtggcatgtgtgggtgctccataaatatttgttgagtgaatgcattactggttttgtcctttctaagagcacctcctgcctttgtaccagcttctcccacacaacatggggccaggtcttcaatgtagatcccagagagttaagaaggaagcaaagaacactgttacccgtgttttccagccaaagaccccccaggaacataactgtcattaaacatgctgggtttattactccttgcagcaatggagaatgcaccccatggggagtgtgggacattttaataagagtgttaggaaaaaacctatgatagggtttgggttttggttaggtgatttggggaa

SEQ ID NO: 10686 - DNA, 113011 bp, Homo sapiens
  misc_feature (1)...(113011): n = A,T,C or G, or insertion/deletion polymorphism (see Tables 1-2)
atcacacacacacagtaacatgaaggtacgttctcacacaatcacacacacccacacaaacgtgaagtacgttctcacacacaatcacacacaccaacacacaggaacatgaaggtacgttctcacacacacacacccacttacactcacacaaacatgaaggtacattctctcacacatacacaatcacacccacccacacacacaaacgtgaagtacattctcacacaatcatgctcacatacccactcgcacacacaaacacgaaggtacattctcacacgcacacaatcacacacacccacacacacacaaacatgaagcaacattctcacacactcgcactcacatacccattcacacacaaatgcaaacgcacattttcacatgcacatttacacccccacacacaaacacgaacatatgttctcacacacgcgctcacacacaaacatgaaggtacaattctcacacacatgccaacatgaacgtacattctcagacatgcacactcacatatccactcatacacacaaatgtgaaggaacgttctcacacacacacactccccactctcacacccacacacattcctcacacccctcctcacattcacagccctacacacacgctcttacacccatccacagtgcccaaggagtgaccctgtgagagtcagggaggctccaacacggggcagaagggagagaccagggacagagacaaagaagggaggacacagggtcagatgggccagtgctgtcgatactgttagaggaagactgcgctggagtcgcggggccccagatgcagccatggaggggactgggggcaggcagccagccagctgtgcaggccatgctggggcagaagtgctcacggctgctcagctgtctgctgtgagataatggtaactccagttgatttgttgagatctgcccaccatgttggtcccatgaatcccctacttcctgacaaggatcctgactaagggttagtgctgtcactgcaccacagagacacaggcttgtgggggctgagtaattggtccgaggtgctcagctctcatcaaggccatgctcaaaactgagctctctgattccagggagccagctttccctagggtaccacacacctctcctccaggtgacaggatccaaactgctgagcctctgagccagcaggaatggatgaggggtgtgggccctgcacaggatgcttgagtatcacatgccacatccccccggtccccctctccactcccgttactgctgcaggcacaccccagcagcaccttgccaggtatctgcactgaggatccctcgtttcctgcccagtccgctcactgcttagcctcctttgcacaagagccagggagagaataccccaactggcaacccttaaccaacagggaaggatgaaaggaggacgaacacccacctttgccagccctccagtggaaagctctgaggtgccttctgcaaggctcatcagagggtcccagcaggatcaaggccccctcccacaccagtggccaactccgtcacaaaccctcatatttaccggctttcctgccttctctgttttgagcttcccaggctcctgctctgtttccctggaatcacttccccagttgaaccacctgcatgcaggccgggtctcaagctctgctttcaggccccagacagggctctcctggtgcccagcaccaggggagctaatgatcttctctctcccacttctgttttcccccaggacacagagttctgctctgatctattgtttgctggattcaagagccaccacattccccgggggggccaaaccattcttgtttatccagtaacaattaattctcagccatgatttctagtcttgaaccacacaaacaaaaagttgccttcagcaaagaggcatcccatccaggcagatgctggattgaggttggggggggtcaggatgccctccaagcttcgacctaagtctatgattctgtcttccttttaggacaagccacaggggcaagtcacccatgcagccatttgaggtcctgagttgtgtgtgtatagatttcctgtatcatttgattataaaagcgaagcatgccagttgtccaggttacatcaatacaaaatgtatagcttggaaagtgaaaacagctcccccataatcccacccttttcactcgagggtggatatttttcattgccctgggaccaggacattctcagtatcagggaatgaggccagctggtcccttcaaggacagccagtgcctttataaagtaccatttcttcttagggagacttccattcattcaatgactattttttgagtatctactaggtgccaggtactggggaagccactgtgagtgagatggatgaggccctcgcggcattttccctgatctcctctgtggcaggatgtcaagcagctctcttgcccaggaatattcacccagatgcttctggctccccgggagtcctcgcaagggcctactgctgtcccactgcgtttcccatatccacagggaaaggccgtgccagaaccctgaacgcggagcagggatgggaatgtgctgtgctcttcctgcggctgggcctttgcagggaggctccagccacctggaacgcctgcctttcaggcccatcagatccttccctcttgccctgaaaggccctgtctctgatcacctcagccagaagtcacccccaactgtaacctgtgtacacctgagggtctgcctcatgagtcaacatggtgccttggcagaactataaggctcctctggtttccccagtgcccgctgaacaggggcccacagaggagagatagggatggtggaagaacagngagtgggacagtgaagccagcaggcaggggctggagaggcagggatcaatttgttgttgttctttttatatgagggtgcctctgtgtggaactctctcccttcatggggtgggaggctggggcatgagtggtggcagagggcccagcagagaaccctctcagcttaggagctgggcatggccttgcggacagggtgccacactgagaatcacagggctggcatgtatgccaaggaaggggaagggacccacagagggtgcaacatggtgtctcttgtgccaaagcaggaccaagcacaagatttatcagccttttaaaaaacattagcacatctctcccccaacccccacttttttttgagatagggtctcattctgttgcccaggctggagtgcagtggtacgatcttggctcactgcaacctctgcctcctagggtcaggcgattctcccacctcagtctcctgagcagctgggacttcaggcacccgccaccacgctcggctaatttttgtattttttggtagagacagggttttgccatgtcagccaggctggtctcgaactcctgacctcaagtgatctgcctgcctcggcctcccaaagagctgggattacaggcatgagccactgcgccttgccgtacattacatctccctttgtaaaacataaaagtcatgtcctctttaacatcatgtgacaattcaaaataaatgtttaaacctccagcaaagtccaggcatgatggctcacacctgtattcccaacactttgggaggctgaggcaggcagatcacttgaggtcaggagttcgagaccaacctggccaacatgatgaaaccctgtctctactaaaaatacaaaatttagccaggcatggtggcaggtgcctataatcccagctacttgggaggctgaggcaggagaactgcttgaacccaggaggcggaggttgcagtgagctgagatggccactgcactccagcctgggcgacagagtgagactctgtctcataaataaataaataaatgccttcctttttaaaaaacaaaaacaaaaaacaaaccacaaataactccctccaaaaaaaatcccccccaaaacccaaaaacctccagcaaattaaaacaatggggcagcccagagcagtggctcatccctgtaatcccagcactttgggaggctgaggtgggcggatcacttgaggtcaggagttcaagaccagcctagccaacatagtgaaaccccatctactaaaaatacaaaaattaccccgggcttggtggtgtgtgcctgcaatcccaggtattcaggaggctgaggcaggagaattgcgtgaacctgggtggtggaggttgcagtgagctgagatcacaacactgcactccagcctgggtgacagagtgagactcagtctcgaaaaaataaaaaatagaaataaaataaaacaatggggcaaagttttgctttatttaaattaccaaactcctatatctgatgttaggtcccctacctttggaatcaaagccctgcgaagtatgggctgaaggtggcgccttttcagacagagtgtgagggaacggtagaaacagcagtggcaggatcgattctctaatggatccattccccgagggatgcaaggtgatgcctgaggttctggaaggggtgcccgcggataactctcaggggcatggggtggcagctccatccagggtctggatagccaagtttctctcccctctgttcattccttcagctctccccaggggagatgaccccctattgctgctggctgtcctcagcacttaccttcccacacatgcttttgtcccttttgtcccaaaacattctatctctttcctcttcctttatttaaattcccaaagcctgtagttgatcttagcacggtgttctgtcaaatgcaaggaaaataatttatactatggtgtaagagactgataggtttaactattcaaaggagcattcgcatctttaagggacagtttgtgaactcaaacacatctcaaacgggtagaatgtgcacgggaaatctcttcgaagcagggtctcaggaactcttccagttccacgtgtgtagtgcccaccgggccaccgccacccgcctcctgggagcaggacagggctccgctgccgagccctctgcggaaagctcaggcccggcgctccggagtctgggctcccggggtgggcggggatacttaggccccacgtgccccgcggcggagcggtccccaaacctgagccctggcctctgccggcccggaatgaagccgcggcgtaggagggggcggcggggtgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgcccgcctcccgcctcccgcctcccgcctcccggggcctggagcgcgcgtggccccggagccgccggcgccgcgcgaggaatagctgtgcagcacgccgagcccggactcggcatggctcggctcggcgcgggcgggcgagaggatgctggcgggcttccccgggctcggccgcgctcccgccgtggagggccccgcgcgcgcccctagcagccgccgccgccgcggtgcaggggaggggtccggagagccgcgctcgccgccgcccgcgcctgccggcccccgcacggcccctgcccctgagcctcagccccagggcgcggcgcgctgggccggcgcccacggatctcccagccctcgtcgccgcctcctccttccccctgcggccgggcgcccgcggatgctgaggggcagccctgcgcctctcccggtcggatcccgggcctgacggcgggagatcgcgctccggccgggccccgaggcgctgccggggcggcgcggctctgcggggagcagccctcgggcgcgccgagctctcccgccccagcccgcgcggggaccgtcccggagcacgcggtggccgagttcccgcacaggtaaacgcaggggcagggccaggcttccgggggggaagacagcgccccgagcgtgggaagggggccgratcggagcccgagcctccaagggtttggtggaaaaaggaagtaaacagaaggaaggctcaggaatcccccacgatggtcctgatttctttccggcacattttatttacagcttctaaggactgggcctggagggaatttaggtgaggaagtcggggactgagaaagaagagatgacagagagaaaccggttaccagggatggaaaggcggctaggcccttccacaagccagggacaggaaattgagtgtctggcgtggacaggactaagtgtgcctgcggtgggcggtggtgtgagccgggggtggcagggaaggccctgggttgggaggctcttgcagcagagatccttttatgagggttagggcgggtcatggggaaaccgcaaggtaggagggaagaggtgcttctactcagcaatgcccttttcagttctagctgatcagtgctacctgtgctctggaaacccgctctgcgttcctgctggaggtggcctcccctccgccccagacaagaagaggccctcagccctcccccggtctcagagagccctgagaggaggcccagtccagagctcttcctccgttcccagtccacttctctagggccagtagcagacaccagccagtatgccgaggaaccagggcttctccgagcccgaatactcggccgagtactcagccgagtactccgtcagcctgccctccgaccctgaccgcggggtgggccggacccatgaaatctcggtccggaactcgggctcctgcctgtgcctgcctcgcttcatgcggctgactttcgtgccggagtccttggagaacctctaccagacctacttcaaaaggcagcgccacgagaccctgctggtgctggtggtctttgcagccctctttgactgctacgtggtggtcatgtgtgctgtggtcttctccagcgacaagctggctyccctcgccgtggctggaattggactggtgttggacatcatcctcttcgtgctctgcaaaaaggggctgctcccggaccgggtcacccgcagagtgctgccctaygtgctgtggctgctcataaccgcccagatcttctcctacctgggcctgaacttcgcgcgtgcccacgcggctagtgacacggtgggctggcaggtcttctttgtcttctcctycttcatcacgctgcccctcagcctcagccccatcgtgatcatctccgtggtctcctgtgtggtgcacacgttggtcctgggggtcaccgtggcccmgcagcagcaggaggagctcaaggggatgcagctgctgcgggaggtgagtcctgcccactgtccccccacagcgtcctctcctgcagctctcaccaacttgggacctgttggagttgctgtttgctttgcctttgagtcaaaatgtgtcctgggggcctccrgggctctcacctctctccctagtccctgccttttcacccctgtgccattacccggagtctgcctgtgcttggccccagggaaaggaggatgtcagggcattgggcctcagggccactcttcacctgtgcccagtctaagtgtgtgacaggaaggcccacccagggctggtcttgaggcagcattgtcctggccattccctgtcagtgaccctggcaaggaggacctcccttgggaagagggctccttgattcccatctctccccagcactgactagctgtgtggactcagtgcccctttgtcaaatggggataacgtccgctctgcctgcatgacacggttgttgtcaggattgcaggagatgtgggggaaagcgcattaggatacgtgaagggctgcacagagggaagacgcagttgtcatatttcctgcctccgggagctcggggtgcctggggagttctatgaagtggagaatggtggtctccccactgaaggtgtggtgtggggatgcaaatggggacagtcatgccggccactgtgacgtagggtctcctggtcctaaagcacgcattctgctggtcctggagcacgctttctactggaaggggtggaatttcggcctcagcttaactattatagtattgtgttcccaccaagtgccaggccctcaggggctgcagagaccaggggacctgagggacagtaggcagtgtgtgtccctggggagccagcaagccggtgaccagagaatgaggcggagatgtctgcatctgggtttggtgcccagcctgccagcctcgtgccaatgatggtcaagagaggctcccccacttcctgcccctgcagtgctctgtctggtagagatgtcttaactcccacgccagctctgttctgtggttagtggggctggggtagagtcagctctgaagcggtgaccttctgggtgtcaggagaggcagggcgtgcccagaatccttgctgactgacgtgagcctctagcagccatggaggtcagtgcctgggtcctggagaccaggtgctatgtgcaggcccagggtggacagacagaatcttccactcctctgctgatttctccactcatgtctcatcctgctgatttgttctagaaatgggtagaggatgttaacataggcagggcctggcagggcatctagcccagactacccattttacagaggaggaaacagagatgagtgataactggttcactgtcacccagcactttggtggcagaaacaggacgggagcccaggcattgacccccagcccagggctcatttgtgtatgttccttggagcactgagagctgcctgagagcaggagctttgcttcccaccccacctcctggagacagtggctatgtgctgccctgccgtccccaccccaaatctctgtagagggggctgtgagtttctggtcattgactaggtggaaacaccagtcatatctcttcaggccatgcattagccagtcccaggttctttttttttttgagacggagtcttgctttgttgccaggctggagtgcaatggcgcgatctcagctcactgcaacctccgcctcccaggttcaagctattcttctgccttagcctcctgagtagctgcgatgacaggcacgcgcctccacgcctggctaatttttgtatttttagtagagacaaggtttcaccatgttggccaggatagtctcgatctcttgacctcataatccgcccgcctcggcctcccaaagtgctgggattacaggcgtgagccaccatgcccaggcatcccaggttctaaggtctgaggtctgaggatgactggtctctctagctccatctcctcaggtggacaaggagcttattttgaggctcctggagcttccagggaaaaggactgagaaggtatggccacagggctgggccggggcctgggtgccccaccacgtggctactcggagatcacttctaaactcatgattgttctcctttgagtattgctaagacataaaaccctaaaacttagaaaacagaaaaaaaaagatagaaatcaagaataaaaatattagcntcccaggggagcctgaccttggcatgcaagcagtgcctgggaggcagctttgggaacagagcaggaggggcagagagctctcaaggtccgattgggagcctgagatcgaaggcaggaggccccagcttacagtgggctgtgttccagaagcttctgagtcactggtttgggactaatgtgactttttaaaaggtgcctgggttcccaggcccacccaccagrgtcttcctcaactcacagcatcccggcatttggcctctgaagatggtggaaatggggccgggcatggtggctcatgcctgtaatcccagaactttggcaggctgaggcgggcggatcacctgaggtcaggagttcaagaccagcctggccaacatggcgaaaccgcatctctactaaaaatacaaaaattagccaggtgtgatggggcgtgcttataatcccagctacacaggagactgaggcaggagaatcacttgaacctaggaggcagagattgtagtgagccgagatcgcaccactgcactccagcctgggcgacagagtgagactccatcaaacaaaaacaaaaacaacaaaaaacacaagctgcagcagcctgtgttgctgtggggagggacacccgggacagcggtctcccctgagccctggagtgaggtgtcattcatctcccctgctgccgttgcctcctgggatgtgggccccatcaaggatcgggggcaagggctggaggacaggatgcaagaaccaggggaccaggccccttctggtcagggtaggtcccagaactttctccagaccccaggcaccgcctttctcctacccatgtgcttgcccttgtctttctctctcccatcccctgtcggctctggctggggactccctccagggtcagtgggggatgaacgcagtttcccagttcgaaatagacacctggatttctggggtcttgtgagttttgtggttttgttgctgctgtcactggcagcatgaagaagcattgccagtgtcaaaagtcttcttcctctgcagcccttatccccccatgcccatgcgcagctctgtggggaaggacagaaggtacacatggggctgttggcagcctgagaggtcagaggccagccagacaacctgtcctgggctcctcgcaggaggccagtgggtggggttctgacaggaagagcaggtgatcagggagtgtgggatggggtggggctggggccccaccaatgagttaatgagtgaatattgccgagcagcatgggccttgcagcctgcaaggtcaggggataaggaggatgaggccatctgacactcaggctgtgctggggcggggaggatgttctgagagccaccttgggtgggcagagacctagccaatggttctcacgacccatcctctagcccctgcctgtcccccattcctttttttttttttttttgagacagagtttcattcttatttctgaggctggagtgcaatggcacagtcttggctcactgcaacctcctcctcccgggttcaagtgattctgctgcctcagcctcccaagtacctgggattacaggtggccgccaccacgtctggctaatttttttgtatttctagtagagacaggatttcaccatgttggccaggctggcctcgaactcctgacctcagataatccgcctgccttagcctcccaaagtgctgggattacaggtgtgagccgctgtccagaggagggaacagaggacgaaacagagatgggtgataactggttcactgtcacccatcactttggtggcagaaacaggacgggagcccaggcgttgactcccagcccagggctcatttgtctgtgttccatggagcactgattgctgctccatgggtcccccatcccaagaggcaacacaggcccagagcagccggaagggaggacagatggatcaggaggagccgaggctggcagtgtttgcccatttcgctcccctggcctgggtcctgccccaggacctgttacggaattacttgccctttactgccctaaactgcccctgggctgggtgaggaggaaggaggggrctgggctcaggaccaggacctgcaggaccagcggccaatgagtgcggacwatggggaaggcagccaggatggttgggggtggtggtgggcggggcgtgcctttagcatttggcaaagtagggactaggaactgctgacaaatattttgtacccttacttcagagcagaaaggctatttgggagcaaaattctctcatggaatgaagagcctgttaagaccttttttcaccaagtaaaacatgaggaagctgtggatgtgcagtttctttcacacctgcaaattacacagcaatcattcacccagcaaaggaacatttgctcctaggggctggagggagctgccgtagggagggtgagaggaaactgaggcttccagagacaccctgtctgcagacggcaggtagctgttgcatgcacctcatcccatttaatcctggatgttactggctccatttcacagataaggggactgaggctcagtgaggttgagaggaggtagtggggctggattacaggggaggggtcactgatgagtgagaaaggtgggttgggggacttccctgaaagcctctctttctctggaacccaggcatctgggcctcctacttttctggctgcccccaaatgtctttgctaagcaacgtagctgaacagtgccaagagatggcagtccctaaggtataacaggaggcacccccttctccccatgggaattggatgcaaaaagggagaagcccatgacgatgttccctgtgggcacgtggccaggagtacttgagaaaggcagggggctgaatcgggacaggagctggtgtgaggtgcggtgggcaggaagcagcaggcctgggggctttcagccttcaggaagcaggctgcagggagaggtgtgcaggacacagagcaagaggaggcaaactcaagccagtcctggctctttggccctgggctcctccactgacccgggacgggaaagaagccgtcatccctccgtggagagtatgcagatgggcatcagtggagggtccagggaccagaacaatgatgacgtgcgtagaaggggactgcagggccatcagattcagctgcatgtgaggaggaataatcagtcattgaacatgtaaacaactttgcagaaaatcaacccctccatcctttccctgtcgcagctttctgtggccttttctgaccccgatctgtgtataaacagagctttcccagtttgtcatcatcatgcatatgcaatttaggccccacctttcatccacattatttccctgacattttgctgtgaacactggactcctcgtgtttattattttaaatcagcgctttatagtcagcgagtttttctagagaggaaacggaagcccagggctgggccaggggtgggtaactgggtagttttatatgcacatgcaggcacacacacacacacacacatgcacacacacacacacatgcacacacacacacacatgcacacacacacacacatgcgtgctcactcctgggcttggtctgcccagccttctgggtaaaccctccgtcagatggaatggctgggatgccagggttattggcattctgcagtttcttcataaacaaacagcaaatcccacgagggtggtctaatgctgggtaaatattccaacaccaccctctgcccctggctgcccccccaccaaattacacattctttttgttttttctttttttctttttcttcttcctttttttttttttcaaatagagacagagtttcaccatgttgcccaggctgggcctgaactcctgagctcaggcggttcacccacctcggcctcctaaagtgctggattacaggtgtgagccaccatgcccagccatcaccaaattacacgttcttgataatagattccacgggtatgtgctatcaccaacacggagactcagagacacattgtgcgtaggtcgaggcccatgagcagggacagtgaggaggtggctgtgtttactgagctcttgctctgttacagtttagtgccttctggcaagaggcaaatattatttccattttacagatcaggaaactgaaatgggtgacaactgaaatgacttgtccagggccacatgcctagtaagaggcagagcaggattggagcccaggtcagtaggattttggagttccttctcactggagtcataaaagaacccattaggcggtgaccagtagctcatgcctggaatcccagcactttgggaggctgaggcaggaatatcacttgaggccaggagttcaagaccagcctgggcaacataatgagaccccatcttcatacacacacacacacacacgtacacaaccaccaaaaaaaattcagctgggcttggtggtgtgtgtgtgtgtgttttttttttttttttttttgagtctgtctcccaggctggagtgcaatgatgctatcttggctcactgcagcctccgcttcccaggttcaagcaattctcctgcctcagcctcccaagtagctgggatttcaggcacccaccaccatgcctggctaattttttttgtatttttagtagagacaggttttcaccacagtaaccaggctggtctcgaactcctgacctcaggtgatccacctgcctcggcctaccaaagtgctgggattacaggcatgaaccacagcgcccaggctgatggtgtgtgtcttgtacaggaggctggggagggggatggcttgagcccaggagtttgaagttacagtgagctctgatcataccaccccactgcagcctggggaacagtgagaccccatctcaaaaaaaaaaaaaaaaaaaaaaagaacccttatatcttccctcggagcctgttgagatagttccaacggggttagggttttggtttctcaacccacaagcgttagaaggtgcaatttgggggatgaggaggtgtttttgggggcatcttcaaggaacagagatgtctggggtgttgagtgttgcaaccaacagccctcatatgcaccttctctggctgtaggagrcgttgttacattataggacagcatagtaactgatgtgcataatggtgaccaactcatcaagaaaatattaaggccaggcgcggtggctcacacctgtaatcccggcactttggaaggccgaggtgggtggatcaygaggtcaggagatcgagaccatcctggccaacatggtgaaaccctatctctattaaaatacaaaaaatcagccgggcgtggtgatgcacgcctgtagtcccagctactggggaggctgaggcaggagaattgcttgaacttgggaggcagagagtgcagtgagctgagattgtgcctggtgacagagggagactctgtctcacaaaaaaaaaaaaaaagaaaagaaaagaaaggaaatattaaattgcatttagcataaagtgtagtgtagtatctaaaaacattttcctcgggaatggataacacaagtttgaacaaataaggattatatttggaaattcagtaatgtgggatggctcattactcagtgttactgagtatatgtccatttattcaccatgtgttttagttatccactgctgtgtaacaaacagccccaaaatttggaggcttaaaagagtaacagtttaaacctgggcaacatggcaaaactcttgtctctacaaatggtacaaaaatcagccaggcatggtagcatgtgccagtagtcccagctactcagaaggctgaggtgggaggattatgagccccggatgctgcratgagccatgatcgtgacactgcactccagcctgggtgacagagcaagaccggtctcaaaaaagaataaaaaaagaatgacagtttattgtttctcatgatcctgtgggttgactgttcagctgggtggtttttgtgcttcacgtggcatgggctggggtcactcatttgtccacctgcgctgtttcattcacctgcagcattcagttgccagctatgctggcaagttctaagaagcctttactcatgtctggagcctcagagctcctcctcctgacctctccatgtggctamcttgggcttcctcacagcatggtggtctcagagagaaggtggaagctatcacagtttttaaaggttaggctcatcactatcggctacaagaagtccaggctaactcagatgcaagaggaaattgattctatcttttgatgtttgagtagcgtgtgtaagggagggaatgaattgatagcagctgtcttctgaggctgtctgagaaaccaggaggcacatgggggatgctggggagacggaactaattaaagccatgagattgggtagggtccaaaatactctgtgaccacagaatgcttcaaaagttagaaatgtggcccagagcccagtgtttttaactccattaaggtattgattctctgtaggatccaatacatcatttctaagatttttagaaagtttcagaaactgcattgtacagagagaaatggtggctcagaattcatctgtatagactttgccttgccttatttgggtgagaagtcattctcttaccttctcaagcatgcaacggcccctgtgtccaggacactgccctaggtgacaggatgtgtggcttaatcatggaccccagcaccattcctgcccctttctctcctcagcttaggttggcagcttggctctgatgtttgtattcctttcccaggaggtagagatttgcangtgcacaagcttcagaaacaccagataggattgggtttgcatttagggggatcatcttggtggacctgaatgaagtcgacatggtgcaggaggctggtgagggagtccaggcgtggcaccatgagggccacccaccaggacggacgtaggggatggagaagatgagtttggtttgagttgcccgtgggacatccaagtggaacttkcagattattcagtggaaagttattgaacaccttctgtataccagaccttgtactcaagatctggagaagaaaggtctagagttgcagatttgagaatcatcggcatttaagtggcacctaaaactgtagggaggctgaggggttgcctggggagagtgtgtagaatcaaaaaggaagggggcttagaatccaacacgtggagcagccaatgtgtgtcgggggggccctcagcatgggacatctgtaaccygcccctgcttcctgccgggacccatgattgtcccaggtagcctgtgctgggtagatcggccattaggaagcaggaagcagtgtctgtctgatggtgttttgcacgattgatgctcttgcattggggagacttaagcctagccaaggtggggccatggtgccagttgagggactgcttcccacagttctaactggcaaacaagggcacgggagtgtgactgtgttacctggttgggggaggggtgggtaattatatagaggcgctttaaactacaaagcactgtgcagatgctagttatttctttattacatttaatcttggcagaccatctctgatctttgaactatgaatgaatcagaccaagtttcttcattatccttttttcatctcttttctgcgtaatcaactagctctttttcytcattgtgaaaggattattgttaagaatrtttcaaattataaaatgctgaataatattgcagaatattgtactattccttttctgtagggcatttgtctacttttttttctttctttttttttgagacggagtttcgctcttgttgcccaggccagagtgcaatggtgcaatctcagctcactgcaacctctgccttccaggttcaagtgattctcctgcctcagccttcccgagtagctggggttacaggcatgcgccaccatgcccagctaatttttgcatttttagtagagatggggtttctccatattggccaggctggtcttgaattcctgacctcaggtgatctgcccaccttggccttccaaagtgctgggattacaggcgtgagccatcacgcttggctcatttgtctactcttaatttttgtatttttatttttattttttcttgagagagagtctcgttctgttgcccaggctggagtgcagtggaacaatatcagctcactgcatcccctgcctcctaggctcaagtgattctcctgccttagcctcccaagtagctgggattacaggagctcaccaccacacccggctaatttttgtatttttgtagagatggggtttcgccatgttggccaggctggtctccaactcctgaactcaagtgatctgcccacctcggcctcccaaagtgctgggattacagacgtgagctactgcgcccagtcttgtctattcttaatttattgattttatttatgtgtcacttgcattttatttacttgctgtcgtttcagcaggcccatcccctctctcctttcccctccttgccattttctgtctgatgactcttccttcttctgagcaggttttcagtcctttcttctaggaaattcctctttgtggttcctaaggaattcactttgattagaaatgaaactgtttctttccttttccccttcctctcctccacaacactttccttcttgtagacaggaaagtaaatgacttgtttcagaagaaatctacccctctcttgagctccattcaaaaccccaacataagcgactggacttgaactttcgcaagatttccatgtctggggtttgttgttcacatgtcacttcaggactgatctccaggaagtgtagtttggtgtcggctgagtcagatctggtagtggaagactgcgacagctgcctatccagctctcggtgggctcctggactgcccttgggggcagtttctcacccaaggggaccaggccctgaggaatttattcccatgagcctgattcctttcatttttatttttatttttttgagatggagttttgctcttgagtgcagtggtgcgatcctggctcactgtaacctccgcctcctgggtttaagtgattctcctgcctcagccttccgagtagctgggattacaggtgcgtgccaccacgcctggctaatttttgtatttttagtagaggtggggtttcaccatgatggccagggtggtctcaaactcctgayctcaagtgatccacctgcctctgcctcccaaactgctgagattataggcgtgagccaccacgtccagtcttgagcctgattcttataagacagattgctcaaggcctggtcaccaacctgcttatggtaggtggaccttcccaccttctctggagggcagcggggtgggagcagggggtggtaataccatgtgtgtcatttggtacatatttgctgccaattcctaagaaaccaaatcagtaatttcctgaaggggaatctgagcaaagcgcatggcatggtgccgagggttgttcatcctcccacgtggggcngggggccgaccccactgcccacaggcacattttctactgtggacaaccctgtcagctggagccagcccaaggagtggcacacagcctcacccttcagtgcctttttgctctactcctgcccatgcttacagtttacctttcattggtgcagcactgagtgctctggaacacacattcctcctgtagttgggcttgtagttgttaatatcatattgcccatctccagggacaaatttgggatattcactctttatttccatgaagagcccaatctagggtggttctttttattttttttttaaacrgtctcactctctcgcctaggctggagtgcagtggcatcatctcagctcactgaaacctccacctcctgggctgaagagattctcctgcttcagcctcccaagtagctgggattacaggcgtgcaccaccacgactggctagtttttgtagttttagtagagacggggtttcaccatgttggccaggctggtctcgatctcctgacctcaggtgatccgcccgcctcagcctcccaaagtgctgggattacaggtggcatttcctatcccttccattgtgtctcagacctgctggccttcacaattacggcgtagtgaagggaccttgtgagtcttggtcgaccctcaccccgggtggctttctgctttggactctgggtcaaagcactggcgtcacagtcattcgacttgaaccaccaggagctcccccacttaccarctgtgagatcnggggtaagttatttaacctctttgcctggtttctccttctgcaaaatgggtgtgataataatacctttttcactgggataggcggcaagcactagaaatggctgtttctctggctgtcactgtcattgtgatgattattggctctgataaggaattgtagaaaagcctrgcccaaccacaagggagggaagagcagccccaggcttcttccaggatgtctcaagggcgcctggtggcttcaagccctgcccttgcctccctggttggggcggacctgacatccctccccgcttggccctatccaccctatcattgtttcccaacccctgactggggtgtcggaccctcagcccctgtttaataaatasccatattcaactttcctagacaatttttgtcttaaaaaatgtaaaaacggctgggcacagtggctcacgcctgtaatcccagcactttgggaggccgaggcgggcggatcatgaggtcaggggatcaagaccatactggctaacatggtgaaaccccgtctctattaaaaatacaaaaaaatcagccgggtgtggtggtgggtgcctgtagtcccagctactcgggaggctgaggcaggggaatggtgtgaacccagggggcagagcttgtagtgagctgagattgtgccactgcactccagcctgggagacagarcaagactctgcctcaaaaaaaaaaaaaaatgcaaaaacacactttcaattattcaccatttccccacagtaactaagaaagaccaaactgtaccttcccatctctctatagtgatcatggctttgcttgctggacagggctttggttaataactctaataatcagggaaaaagcaaaaacaacacaatagaggaatggcrcataggaggcaaaatagaagaaactgaccagtcrcattggctcacatctgtaatcctaacactttgggaggctgaggcaggcagatcacctgaggtcaggagttcaagaccagcctggtcaacatggtgcaaccctgtctctactaaaaatacaaaattagctggacgtggtggtgcatgcctgtaatcccagctactagggaggctgaggcaggagaatygcttgaacccaggaggcagaggttgcaatgagccgagattgtgccactgcattccagcctgggcgacagagatgctgtcttaaaaaaagagagaagaaacttacaagctgggtcaccgttttttttggttgccttctaaatgtcggagagaatatgctttccacatgaagttctccacagagacaaagaatcatgtacttttttcttttcttttctttttttttgagatggaatttcactctgtcgctcaggctggagtgcaggggcacgatctcggctcactgcagcctctgcctcccgggttcaagtgattctcctgcctcagtagtatggactacaggcatgtgccaccacacctggcaaatttttgtatttttagtagagatggggtttcgccatgttggtcaggctggcctcaaactcctgatctcaagttctctgcccatttgggccttccaaagtgttgggattacaggcgtgagccaccacacccggctagaatagtggaatagtgtacttttgatccaaatttctctctgcctcttttctttctctctctttctttctctctctctctctttttctttctttctttctctctctctctgtctccttccttccttcctttttgcattttggcaatggcctttcacttaatgtcttttctctttatgctccgtctttgggaggaatgcgtgaagagttggttgtgggtgggagacatggtgaagaaggctgctggcatggctgtagtggaggaagccaggtatgtcctttcattaggtcagatcatgtgagctgcatggagctcggttcctttcatatggagaacctggggttaggatgtccctgtggccctagatggcctcactttgttcccctgagctttagaatcttcntcctcggcagggttagtgacgcacaacacctgaggcttcgagttgcatttagggaagaaagggatcatggcgctccctgttcagctggcgagccgtgcyggagccctgccatggtgcccccgcaccctcctacccctgctcccattcctccccgcccctcacccacttcccttcacgatggcctaatgggtctgatgactctctgaggactagttacaaataacatttgcatggatcattgaagcgcwttttatctcattatgtcacttagtcctcacacccactctgtgaggtggatattcttgtcactggcattttatagaaaagaaagtggaggaggaacagagggtgaagaaggcgcccaggctccccccgggaagcgcagacccggctggtctcagggccaagacttccagatccaaatgcaagtcagaagtcgtcttctctgaggagatcgagacagacggttgtggaagtggttacatgactgtgtgtcagaacatagaactgtacaccaaaaaagggaattgtactgtacatgaaaaaggggaataacaacaaaagatagatggtggagagcacagacggtcaaaagatggcttcagcatacagttgacccttgaaccacacaggcgttaggggtgctgccccccacacagtcaacatccatgtataactttttttttttttttttttggagatagagtctctctctgtgtcacccaggctagagtgcagtggcgcgatcttggctcactgcaatcttcgcctcccgggttcaagtgattctcctgcctcagcctcctgagtggctgggactataggcgcccgccaccacaccaagctaatttttatggtgtgatcacggctcactgcagcctcaacctcttrggctcaagtgatcctcctgcctcagtctcccaagtacctgggaccacaaatatgtgccacaacactcggctaattttttgtgtttttagtagagacggggtttcaccatgctggccaggctggtctcgaactcctgccctcaggtgatccacccaccgcggcctcccaaagtgctgggattacaggcacgagccactgcgcctggccaggaaaatatattgactattcattaagtggargtggatcatcaaaaggtcttcatctgcatcttcacgttgagtagctgaggaggaggagaaagagaaggggttggttttgctgtctcaggggttgccgaggtgaaagaaaatctgcaagtggacctgtgcggttcaaaccctgttgttcaagggccaactatggtgtggtaagagctatggtaccttaacagacactccacggggctgggagagaagttgacttggatggggcaccatggcacatgttgggatgatggcagtctttcgtatcttgcttggagaagtagtcacacagctgtacatatttgtccatattcatcaaaatatacacctaaggctgggcaaggtggctcacgtctataatctcaacactttgggaggccaaagtgggaggatcgcttgagcccaggaattcgagactagactgggcaaaatagtgagacctcatctttacacagaattaaaaaattagccaggcgtggtggcacacacttgtggtcccagacactagggagactgaggcaggaggatcgcttgagcccaggaggttgaggctgcagtgagccatgatcacaacactgcactccaacctgggtaacagagtgagaccctgtctcaaaaaaaaaaaaaaaaaccaaatacacacacacacacacacacacacacacacacacacacacagagttaaaatgtgtgccatctactaaaattcagtaggttttataaaaagtcagtaaaatacaggaatcacaaaaattgtgcatacatatatacatttatatgtattttaratagtttgttttaattgaaaacatttagctatacagtcatttgccaatcttttgttgaagggaaagttctttcctttttatataggtactctgtttggtattccttgtggcctttttctttttccttcttcttttttttttttttaaagatgaggtcttgctatgttgcccaggttgggcttgagctcctgggttcaagtgatcctcccaccttgacctcctgagtagctrggaccaccggtgttagccaccaccccctcctatggccttcttttgcagctgggatgtgttgtgtgtcatttccagtttccttaaagtggagtaagaattaaaagtcacttggaaggaacctgggtacagaatccccctacatttttattactgttctttctttttggccaaattkttactgtcttgcctaccttgaattcaacarcaatttcttytagctacttatatttgtcaaaaatgttcaaaatactcactttactttttttagaaacaacgcgctttctttcacatccatattttatctgtgtaggttatatttaattaagttatgtaaatataataccaaaaacaactggcataaacaggtttgggactaaacataagtgattcttggaaaatactccgaaagttggagcagaaataaatgcatggccttcctagagaggagcttgcctgcggcacgtgtaacgtcagttgatttctggagggactggactatcttggtggatccagtgtctcggctctggggactccagcgctatcctgtgcccctgccccttcctgctcggctctgacctgctccctcctcgctgcttccattcctggttctttcattttccttttttttgagacggagtctcactgttgtcgcccaggctggagtgcaatggcatgatctcggctcactgcaacctctgcctcctgagttcaagcgattctcctgcctcagcctctcaagtagctgggattacaggtgcccactaccacgcccagctgatttttgtatttttagtagagatggggtttcaccatgttggccaggctggtcttgaactcctgacctcaggtgatccacccgtctcggcctccmaaactgctgggattacaggcatgagcyaccctttcctggttctaatttgtccacaggaagtaatgcatgtctacttcttgttttctacacagcagcccttccagtgtttgaattcagctatgttgctctccctggatctcctcttcagcctcgcccatctccctttttcaagaagtcctcaggcgacrtggtttccagaccttacatggtcctgggcactttctctagstgtagactaaagcgcattgctcaggactgccttctcctgtttgcccaggctgctcacagaaccttgtccatcctgcctagctgcgggacacaaacactgcaggtagaaattctgtagctatacatttaagattgggggtatggcccccccatttctggaaagtttatatgtcaggccttaatgatagagctattgtctacataaacatttacgtttttaaaaaattttttatttattttttttttttttgagacagagtctggctcttttgcccaggctggagtgcagtggcatgatctcagctcactgcaaccttcgcctcctgggtggtggcgcacacctgtaatcccagctactcaggaggctgagacaggagaattgcttgaacctgggaggcggaggttgcagtgagtcgagatttcgccactgcactccagcctgggtgacagagcaagactctgtctcaaaaagaaaaaaaaaaaggcaacttcatttcatatgattcaatctaacataaaagyaacaaatgtattcactgtggaaagcctggaaaatactatgtagtatgaaaaaatattacccataatattatttctgaaggataactgctrttaacattgagscttctcttaaacgaatatcagttttcttctatattatgaagsactattgtaagaaaataattcaacctagacaggagtacaaagaataaaagtgaaagtcctccttccttcccttgctccccttctcataggtacccattgccaaatgtttggtgtggatacttccagagatctttctgtgaattgcatatttatgtgactctatgcacatttaggacagatacattctttatataagcttatgcaaatcggggaagcaaagctctacacacccctctatggtaactgtagtttcctctcaaggggatgagatgcctctgccgtctgcagccctgcctccatcagctgggtggtgccactcgaggtccacactggtggcctccttgagccacagccacctctcgagctgaggaagagtcagggctggtctagcaagctgcttctgcttgcttccatctgcagcagcaagaaggcatctttcaagggcctactgggcaggaaatccagggacagttnngcctggcaggctggtggcagaggtggctggggtgacagcagcattccagccgagagtgaggtcccgctcttagacaaacatgggctttggtcgcaagagaatggtttatttattgggattgaagaaggcatcaaaatcaatacagtcatcacctcacagggcagaagagcggatggtggtttggggagaaggaggcggtgtgccaggaggagggaagcgtggcccagagttggatgcctggggccctgggcagcgcagctgacctccctgggcctctgtgggtcagctgcctagggagttgcctaggcagttggcaactgcctagtggctctgcctagggagcagaggtagagacaggtgagctgggaaaaggtgggaggggtagggggacattggaagccagtgacaccgggattcagggtgacaaggggcatgaggggacagtggagtgtttggaggctattgagtgygtggttgtgtggtgagaacagggagaatggtggtggagctggagggagggcaggtcacctgccgtggtcgtgcttggcgtccgcgctggagttctctggcggtgaaagggtttccagtgtgaactggagctatccccaggctgcagacctcccactgctgagctgctgttggttgcgtggtaaattttgcttttgttctcccagtcttaggaattctgtttgcttccccgaacctcccaggcttccccaggcaagggttgtctccccagagacctggagccgggagctgtgcggtttcctgggacctgtggcttctgctcctttgctttgtggaaaggaagtcagaggcggaaatgggagggctcctttccagtgctgcagggctccattgagaggctgatttgagagtgaagatcttcggaggatatttcctctggctgagtgtaattgacttaatctgtggtgtggctcatttttccttttggaaaaaggagagatggcgcctgactcaccccttcatgaagcactgtgtgaagtacacgaagcccctctccccgaggacagccctgcataggtgcattcccacacagtcagtgtcccgactcccatcccgcagacagtaggtccactcccttcctttcttctcggtgcgagggtggggctcaccccacggtgatggaaaggmggtcctcgagcctccccgggggcctctgtggcgcacgaactgngagagtggagagaaaagcccctcaggaggaggagtactgagctgggccgtgaagggcacgttggatttcgatcctgaggtcagtaggggaggggcagtggcagtggcttgtgaacaaaggtctgggggtgaacatagacggggtagtggagaacctctgactggagagttgggtgcagtagtaacaaagaagcctggaaggttatttgggatctgaaatggggaggagtaaaagccatatgagacagttctgactccattttgtagacagtggncagccattgaaagctttggagcaggcagttgacctgagccctgctacctttcaggaagatgattctggcagcgaacggtgatggctgtgagcagcagagtatgtgagaacctgcctgwacgtggcgggatacaaggasctgacctgagccaccgaagcgggtataggagagagagggattcgttcagccagcatagacggagggcctgctggtgctcagcatattagaaggtgcaaaatggaaaagtctgggttgttgtccttgctgaacttcccgtgtgagtgtgaagatttcaacacactccccataaactgatgagagactatttcaaatcacccatgagaaggtggaggaagagaacagccagccacatgtgacatcgtgatggtagagttgggaggaacactgaccaagcacctgtttcgcgccgggcactgtgtcaggtgctctgatcctctccccaaccctggggagatttcagagagagactgaggtgctttctcagggacacacaggcccttggcaggtgaggctggtgttcagcttctgctctgtccagtttcagagtcttggctctttatgccaagggcagggggctttgaaccaggccttgaagttagtggtagcaatggaggtgggggtacattctataagragtcccagaaagagagagggagagagacaaagagagagagaagagggaggaggaggaggaggagaagggggaggaggagaaaaaggagaaggggaaggaggaggagggtrtggctgaattagagaccaggaatggcagttagggaaagatggggtacaggtatggtaggcaagagggatatggttgaaagagggtgggtggctggtctctttcttcctctgatctaccatgatgtcatcttgcgaaaagatgatgagacttctgcttccagtcgagagtgagcaggacagcctggaattattctcccactgtaaacaactaggagctggataaaatatagggaccaggcaatggtggactgtgattccttggaaaaagaagactaaccgagtgagccctatcgttcattacctagcctttctacctgaagagaattctaccacagggagggagaacccaaacggagactggcgagattactaagttgagggaacagagatcagaatttggagacaccaagttctaaggtttctagaatctgtgggacagaatcctaaaaggaagaagctggaaagagaaagatctccagaaatctcgatagaggcctcctggaatctcggtgaatatcaatctgctcatgcacagggcaaccctgtgagaccagaagagaacaactgcagagggagctgtaagacaaacaggatagagccaacacaggaccagggttcactggagtcctctttaaaagaatatgacaaaattatgcattgaaaaatggtaacgtttgcagtgtgagacatccagcaaaaaattactagacaaagaaggaaatgtgactgacccactaacaaaaaaaaagtggtcaatagaaatagacctagcaatgacaaagatgtgatggaattatcagggaaaggacatgaaaataacttttttttttttgtaacagaatctcactttgttacccaggctggagtgcagtggcacgatctcggctcactgcaacctttgcctcccaggttcaagcgattctcctgcctcagcctccggagtagctgggattacaggtgcatgccaccatgcctggctaatttttgtattttttagtagagatggggtttcgccatgttgaccaggctggtctcaaactcccgacttcatgatctgcccatctcggcctcccaaagtgctgggattacaggcttgagccactgtgcacagcccgaatataacttttataaatatgtttcatttgatcaagcatgtaaatgaacacatcaggatgatgggaagagaaatggaaagtataagaagatccagtagcacctctagggatgaaaaatcaaaatatcaactacaaaatcaaaaatgaaaagctaggtagataggattaatagtagattagacagtgcagaagaaatgatcagtgaattgaagctagagcaataaaactatctaaaattaagcacataaagataaaatattccaccctgggcaatatggtgaaaccctgtctctacaaaaaatacaaaaattagccaggagtggtggcatgtgcctgtggtcccagctactcaggaggctgagacgggaggatcacatgagctcaacggcataggttgtgttgagccaagattccatcactgcactctagcttgggtgacagagtgagaccctgtctcaaaagaaaaaaaaaaagaagaagaaagaaagaaaaaacattgacaaaaggtaatactcagagcatcactggcatgtgggacaatataacagaccctaatatgtttaattgaagtctcaaaagaacagagagaaagacagaaaaaaatatttgaagaaataatggtgggaaaacgtccaaatttgatgaaaactcaacccatgactcaagaagctcaacagaatacaaacaaatataaggaataagaatgaagagaattggtcaggcgtggtggctcatgcctgtaatctcagcactttgggaggctgaggtgggcggatcacaatgtcaagagatcgagaccatcgacaaacatggtcaaaccccgtctctcctaaaaatacaaaaattagctgggcgtggtggtgtgtgcccgtagtcccagttactcaggaggctgaagcaggagaatcgcttgaacccatgaggaggaggttgcagtgagccgagattgcrccactgcactccagcctggcgacagagcaagactccatctcaaaaaaaagaaaaagaaaaatgaagataattacatcaaggcacattgtaatcagattgcttaataaagatacactcataaaagtaaccagaaagaaaacaaaaaggaaaaaaaagacacacgacatagagaggaacaaagataagaatgacagcagatgtgtggtcagaaattattcaaggcagaagacagtagaactgaaaaagaaagtaggtcaatctagaattctatacccaacacaaatatccttcaaaaatgaaggtgaaataaacactttttgatggacaaactgaagttgagagaattcgtaaccagcagacctgtagtacaaaaaatgttgaggcaagttttttaggcagaagaaaaatgatactagatagaaatttgggctgcacaaaggagtgaagaggcttccaaatggtaaattatatggaaacatatgaaagttatcttttctcatttttaatctctttgagaaactgcttaaagcaaaaatataaacaaggtactttggagtttagaacatacatagaagcaaaatgtatgacaaaaatagcacaaaggacaggaggggagaaatgaaagtatattgttataattttcttatttatctttatttattgttactagtttttagagacagtgtctcactctgttgcccaggctcgacagcagtggcacaattatagctcactgtagcctcaacctcctgggctcaaggtcttctcctgcctcagcctcccaagtagctgggactacaggcatataacagcatgtctggctaactttttgtagaaatagagtctcaccacgttgcccaggctggtcttgaactcctggcctcaagcagttctcccaccatggcctcgcagagggctgggattacaatgtgagccaccacacttggctgtaattttcttatatgcaaagtaatagaatatttgaactagactgtactaagttaatgtttactctaagtcccagagtaatcactgaaaaagcgtaacaaagagatatgactcataagccaataatggagataaaatagaatggtaaacaaaaatcattcaaaagatggcaaagaaagtgggaaaaaggaacaaagamcagtaagataagtagaagacaaaaaacaagacaacagttttaaatatagccatattgataatattaaatgtaagtgatataaatattcartttaataggcagatattggcagtggctcacgcttgtaatcccagcactttgggaggctgaggaggacagattgagctcaagagttcaagaccagcctgggcaacatggtgaaaacctatctctacaaaaaatactaaagttagccaggagtagtggtgtgtgcctgtagtcccagctgtttgtgaggctgagatgggaggatcatttgagcgagcctgagaggtcgaagctgcagtgagctgtgatggtgtcactcactccagcctgggcgacagagtgagaccttgtcttgaaaaaagaaaaaaaaaaaagacaggtattgtgcartggataacaaagcaagaaccaactatcaactatcataaagaaactcatcttaaatataaagacacagatagactgggtgtggcagctcatgccttcaatcccagtgctttgtgatgcccaggtgcaaggattgcttgaggccgggagatcaagaccagcctgggtgacagagcaagaccctgtctgtacacaaaaaagagaccctgtctctacaaaaagaaattttctcgctctgctgcccaggctggagtgcagcagcgtgatctcggctcactgcaacccttgcctcctgggttcaagtgattctcctccctcagcctcccaagtagctgggactacaggcatgagccaccacatctgtcctctacaaaaaatttttttaaaaattagctgggggtgatggtatgcgctggtagtcttagctaccttggaggctgaggcaagaggatggcttgagtccaggagtctgaggctgcagtgagctgtgattgcacaactgcactgcagcttgcatgacagagcaaggcccagtctcaaaaaaaaaaaaaaaaaaaagacacatagattaaaagtaaaaggatagaaaaagacattttgtgcaaaccctaattaaaagaaaaataggccaggtgtggtggctcacacttgtgatcccagcactttgggaggccaaggtgggcggatcacttgaggccgggagttcgagaccagcctggccaacatggcaaaaccccatctctaccaaaataaataaataaataaataaagatggtgtggctataagtaccagacaatatatactttggaacaagaaatattatcagggatagcgagggacatttcataatgacagaggaatcaattcatcaaaagacatcataattctaaatatgtatgcacctaatgacaaagctgtaccaaaggaatatttatagaaccctgcacccaagaactagagaacatacattcttttcaagtgcactgaaatgttctcaaagacacacaacctgttacaaaacaagastcaatacactttggctgggagtggtggctcacgcctataatcccagcactttgggaggccgaggcgggtggatcacgaggtcaggagatcgagaccatcctggctaacacagtgaaaccctgtctctactaaaatacaaaaaattagccgggcccacttggtggcaagcgcctgtaatcccagctactygggaggctgaggcaggagaatggcgtgaacccaggaggcagagcttgcagtgagccgagatcgcgccactgcactccagcctgggtgacagagccagactccatctcaaaaaaaaaaaaagactcaatacactttaaaagattgaactcatataaagtatattctctgacaaaaatggatggaagtagaagtaacagactatatctttaaaaatcccaaaatatttggaaacacatgcctaaaggaaggaaaaaaatcacaagagatcttagaaaacatattgaattaaatgaaaatgaaaacaacatgctgaaattagcagacgcagacaaagcagtgctttgaggataatttgtagcattaaatgcttatacagtagttcccccttattcgtgggggctgttccaggatccccagtggatgcctaaaactgtcagtagttctgaaccctatatataccatatttttcctatatatacgtatctatgataaagtttaacttataaattaggcacagtaagagatgaacaacaactgataataaaatagaacagttataacagttggtacacattttctgtttgtgtcttccacccacaaacttaatacctttttcatctttaagccctttactatgcactgtagctgttacttttgcagtctgaagtgcaacagcaaaactcacacaaatttatctttcccttttcacaagttcacatatagaagatttgctcttaccctagatcttcgccacctcaacgtatgatctttcctttggttgagaaattttttcttttcacttaaaggaaacgctttatggcttctctttggcatatctgaattgctagcatcactacttttatactttggtgccattataaagtaaaataagggctacttgaacagaagcactgcagtaccttgtcagtcaatctcataaccgagacagctaccaagtgactcacaggtgggtagcatggatagtggggatatgttggacaaagggctgactcacatctctagtgggacagagcaaaattgtactagagttcatcacactactcaatttaaaacttatgaattatttatttcttaaatttttcatttaatatttttggactgtgattgaccttgggtagctgaaaatgcaaaaagtgaagccacagataagggrgactactgtattaataaagaagaaaggtctaggccgggcgcagtggctcatgcctgtaatcccagcactttgggaggccraggcaggtgcatccttgaggtcaggagttcgagaccagcctggccaacatggcgaaaccccatctctactaaaatatgaaaaaattgctgggtgtggtggcatgcctgtaatcccacttacttgggaggctgaggcatgagaattgcttgaacctgggaggtggaggttgcagtgagccgagatcrtgccactgcgctccagcctggaggacagagcagactctatctcaaaaaaaaaagaagaaaggtctaaagtctgtgatggaagcttctaccttagaagcttaaacctttagattgaagtagaaaaactagatccagagaaagaagcagaaaaaaaaattagtgggaaaacattacaaatcagtgactccaaagctggttatttgaaaaggtcagtaaaatagataatcctctagctagatgattgggaaaatgagggaggacacaaatgaccagtaccgggatgcaggtgagcatgaatacagatcatacagacactcagagagtcataagatgatgtcataaacaactctgtgccaatacattgaacgacttagacaaattggacaaattacttgagaggcacaaactatcaatgttgaatagccccatatccattgtagaaattgaattttggtttaaaaccttccacaaaggaaaccccagcctcagatggtttcagtgctgaatttcatcagacatttaaaaatgaaataataccaattccacataaattttatcagaaagtagaagaggagggaacatttcccaacttattttatgaattcaatattgccctgatatcaaaaccagacaaagacgttacaaaacaaaaactccagatgaatatccctcatgcacatgtaagcaaaaatctttaacagaatattagcaaagaaaacctggaaatatataaaaagaataatatataatgaccaagtagggatttgcacaggaatgcagggtggttttaacatcttaaaattggtgcagtttaacattagcctactgaaaaggaaaacccataagatcatctcaattttgtcaaatgcagaaaaaagcatttgacaaaattcagcatccattcagataatacctctyagcaaactaggaaaagaagataatttcttcaacctgagaaaaggcatctttgcaaaacctacatcatatttaatagagaaagtctgaatgttctctttttaaccaaggttggctttatgagcacatgacttgtgcagtctggaaattcttaacaattttatttattcatttatttatttgagacggagtttcgctcttgctgcccaggctggagtgcaatggcgcgaccttggctcactgcaacctccgcctcccgggttcaagcgattctcctgcctcagcctcccaagtagctgggattacaggcatgtgccatcacgcctggccaattttgtatttttattagagatgggatttcaccacgttggccaggctggtctcaaactcctgacctcaagtggcccactcgcctcagcctcccaaagtgctgggcaggattacaggcgtgagccactgtgcccagccaacagttttatttttgaacttatgttttgcagctgaagcctgctgagacaatggaacatgcatatgtactgaagaaatacatacaagatgagtacctgccatatgtttttgtgtcatttgcatatttgtgtgtgatgccccggcaacatggagttctggtgaattcacaatgtctgggagttgagcaagatgcaaaacaagcgcaaaataacatgtcgcatccacagctgagtaagtagaggtactgacagctctgagattttgtgctttctgttcaaactagaacttgcttcaaatacagaaagaaggcagtgacattctcagaaacatgaacatcccatgctgcttccctgtattggccaaccatttaatgctgaaattaatgacacagaaataaaagggaaggtaggacacaccctaatagctttcattccttcctcacgcattataagctgaagatagtgttagcagaaggtgcgtgtatcaataaatgaaataaaaacagttgagttttctgcagcctttccactgtttttgtttttgagacagagtctcgctctgtcgcccatgctagagtgcagtggtgtgacctcagctcactgcaacctctgcctcccgggttcaagcaattctcctgcctcagcctcccgagtagctgggactacaggcacatgccactatgcccrgctaatttttgtattttcagtagagacggggtctcaccatattggtcaggctgrtctcaaactcttcacctcaggtgatctacccaccttgacctcccaaagtactgggattacaggcctgagccaccacaccaggccctttccaccattttggtaaaataaaatacatatatacatatgagccaagaaatactaattgccatgtgaggcaattttccatgtgagaaggttgcagagggaggttttaagggactttctaaggagtgatagaacacaagccagtttggctccaaagacagtgcttattccacggcatcacactccctcctgttgtaggggctggaggaggacttgttgactaatggtgtgaaggttaattggtgtccccagacacaggcagccactgtgggctgggaggtagtcggtcagttcagcaccggcaggtggctctagcagctgctggcactgccatgagggtcttcccgataatgagacgtggaaagggatgggacaggagctgagccgtccagctgggtggcagggtcctggggccaggatgtgcagctacactgcagggcccaaaacccagccagtgcacagtgacacaggcagcattccacctcagaggctggacaggcaatgggggaggaccaggggatgggaacttacttgagagctgttgtggtttgaatgtttttgatgttccgaatgtgtttgaatgtttgtgatgaaatttgagttttgttgaatctgtggatacagaggacctacygtgtacaaggcagtgtttgaggatggagccttagaatgtcagcacagccaaatttggggaccattgacacacattgccttcccaggtgatgaaaatgaccttgactcactcaagcagactcagaaagctggagaattgggaataaattcaggagtaaccttgggaatttataatatgcctaacaataataggtaacacttagatgtattgtgtatctggcacagtctgatgctgggctctttacacacatcatagaggagtctccaacccaccctgagatgggcctgtggttatttgcatttcgcaggggaggcagcgagtttaaagtgtggcaacttccaaggcccaggcccatgatggagatgaaattccactccagcctgagtttggagctgcattcttcaccgccatgctttcctgccccgagtgttggcctcaccgagaggaggtgtgtgtgtcgggggggagtgggctgggacacgtggtcatgggggcccacagagccagatgccgggggaaccaggcaccctcaggagccatcacggctatcgctgcatgatgccggtgaacccctcgggacttggcctggttttcgacctcttggcagccccgagtgttcccaggctgtgaaaatccccccaggtgcagtggctggcctggtctccgagggaaaggagccgtggagctcgcaggtggaaggctagagagagtaagtgatacggttaggctttgcgtccccacccaaatctcatcttgaattgtaatctccatcatccctacgtgtcaagggagagaccaggtggaggtagttgaatcatggggtggtttcccccatgctgttctcgtgatagtgagtgagttctcacaagatccgatggtattataaagggctcttcccctttcgctcggcacgtcttcctgctgctttgtgaaggaggtgttttgtgaccctttcgccatgattgtaaatttcctgaggccttcccagccatgctgaactgtgagtcagttaaacctctttcctttataaattgcccggtcacaggcagttatttatagcagtacaaaaacggactaatacaggaagaaagctggggctgctagggagaagttaagaccaagagtgagccacggggtgtcacttgtgggggactgtcragttggtgatttgcacccctttgtgccagccaggcccagcatctgcctagcagagccccagggaccggcttgccttgtgcagcagctaacctcacccactcagggcacatggcagcctccttgccagctgggcttcccccttcccctccccagggcaggctcatccgagtgagtgagagcagtgagtccgtgggcatcgcccggaaccagctccagtttctaaggagagtagagcttttgcgctgctgggagctggatgatgagtggcgagaactggcctggcagcgcagctcacacccatctcggggcgggggtcttctcccttcattcctggttgtcatgaccctgagcttcagagtttctgtgtcaaggcgaagcaggagggcagagtgaggtgactgggttctgtgcccaggtcttgtgggaagatcttagggaggtttatcttcccacctggccctttgcaaggtccgggtggaggtgaggcgtgtttgctaaacatgatgtagcgcaaggaggctcaggtgggctcgatggaggaggcggggttcagctagatttcgagggggaggcggaaggcggccaggtggggaggggcattctaagtgcgtgcttcccacattgggggtgcagggttgtgtttgctttggcgcatgtgaagccacaggatgaccgtggagttggcatttcctttcatcctgtgtcctccatgtattcattccttcacccagcagacagcgtgctgggtgctactgagtgctgggaacacagtggggactgggacagatgtcgtccctgccctagtggcacttacactgaaacaggtggagacatctgtttggcaaatatttttaaacacttaaaaatacaaatacaaacatggattttattgaacagaatgcagaatccacatatattagcaagtaaaatgagaagcttcctccccaggcactttcgtggggaagtttaagagctctcaaaataggggctacagcatgtgccgaggtcaggaggccagttggtgacatgctgaggacgtcagcttggctaaagcagatggtttacctcaggcagctgtgggggcggggtttagattcaagttcatggtaaagcccagagtatataggaccctgaatgccagaatgaagattttkaactcttggacaattggcagctattgaggtgttttgagcagaaggtggtacttgcaaaaatattattttggaagattaatgtgttccagggtggattggcaggaccagggagatgagtctgtccccagccctgtgggaagtaagggtgtgagccaggtggtggcagcaagagtgaggaaaaaggagacccagaggcttttacctggaaagaccagctgggatgaaggacctgctggaggcacagaaaggagctcagtgagagagagcaggctggcgctggttcaggcgttcagccaatgttactgaggacctgcgccgtgttgggtgctgtgttcctagctggggcgtagtgttggcagaagtgagacctgtggatcagggctggttaggggagaccatgacaascttgggtgttcacattgactttagcgttttccactcctggtcccgccntaaggtctcctggaaacttttcagcaataccagtgtctgggcctctggttccacttttgtggactctgcctgggcataactccccaggtgattctaaggcacagccaaagttgggatctgctgagtgagggtgaagtgagcacctgcaggtggtgctcatcaagacagtggaggctgaggaactggaatttaggagaggtgatagttcaccagggccttgaacttgaattttggaatttggaagtctctgtcatgtgactaagagagtgcattgagaggcctggtccatgacctgccatggtccttccagaccagagtctctcaggacaagaagaaggaaaattggaaaggactttaaatctgaattgaaaaccagggaactgaattaaacgcaggagacatgaagcagcatcaacaggtggaaagcaccgccgtgggtggagctttgaatgtgtgggagacatgctggtcagaagggaaaaaagatggtaaaagggtacctaactcagggtgagggtgaaccagggatcagaagactgttagaaaatgagggctgggcgctgtggctcacacctgtaatcccagcactttgggaggccraggcgggsagatcacttgaggtcaggagttcaagaccagccaggccaacgtggcaaaaccctgtctctactaaaaatacaaaaattagccgggcgtggtggcgggcacctgtaaatcccagatactcgggaggctgaggcagaagaatcgcttgaacctgggaggcggaggttgcagtgagctgagattgcaccactgcacttcagcctgggtgacagagtgagactccgtctcaaaaaaaaaaaaaaaaaaaaaagattattagaaaataaagacaataaatgcatagaagaaaaataggggataggcataggaagatggcctaaggcagcagcatgagagtttggtttaaagacccaggaaggctggaagctctttgccttgttttyatatctactactccaccttgaacagtgattctgtagaagagaatcacctggaggagggcacagatgcagatgccggggattctgtgggctaggaccctggaatctcccattttaaccagctccctttgggacgctggtgcacctggcccagaaacactgaactggaaaaacagcaactcaggaacaacgccagaagggttgcatcagaaccagtgactggaaaaaaaaaatgctgaatgtccctgggaaggctgtgagaggctgtagggaagagggaattgctgagaaacccctagaaggactaaaggggagaaaaaagatgtatcaaatccccaggagaaagctgtgattcaggagagcagatgatgtgggtttttgttgcagacggtgtgcaaaaagttttactctcaaaatgtcattttctgaattgaaaggtaggaagttttggaatccaaagagtttgctgtgttccatggccacaaacacaagagaataagggcttggtgtttctgtgtcatcagtgatctgttcccttcaagtttttacattttaagtttgtgtgatgatctatctggattcctaaatatcttctgtctccagattatacacttgtcttcctccgagctggtacatttgctttcaagttcatctaaagttagtttcagaaagtcaggtgatctgtgtgataaatgtacccagtgttgcttataggtaagaaagcatgagcaaaagcatggagccctttcattcctgcctcacttagtattggccgtcagttagaaattggtttcaattttctttatcgtccagaatctatatgcttaaatatatgtgaaagctctgtgttttcagaacatgtgaaaactccaactgagtgtggccagcccaagctttccttcctcatgggggcctttgctgacttctcccctctccctcagaatcaagctgcacatcctctgttcactgctagcttctttttttattttttttgagacagagtctctctgtgtcgcccaggctggagggcagtggtgagatctcagctcactgcaacctccgactcccgggttcaagcgattcttctgcctcagcttcccaagtagctgggactacaggtgcccgccaccatgcccagctaatttttatatttttagtagagacggggtttcactatattggccaggctagtcttgaactcctgacctcgtgatctgcccgcctctgcctcccaaagtgttgggattacaggcttgagccaccgcgcctggccctttttttgagacagrgtctcactccatcatccaggctggagtgcagtggtgtgatctckgctcactgcaacctctgcctcccgggctcaagcagttcttgtgcctcagcctcccaaataacttgggactacaggcatgtgccaccatatacccagctaatttttgtatttttagtagagacggggtttcaccaagttgcccaggctggtctcgaactcctgacctcaggcgatccacccgcctcggcctcccaaagtgctggaattacaggcatgagccacggtgcccggccactgctagcttctttactgccagtagagtcagctccttgaggtaattttataatctccagggcccagtatggggtccgccactcaccagagtattcaatagagttgaactgaccactttgtaaaaagacatgagaccaaacatgattcggctttaaaacggacttctttaaatagaattggaattatttggcctagagaaagagaccaaggtgactaaataatgaggtcacatcaataagagaagacaggaaatgctgtgagcagatgtttgtgtgtctagtgaagcagcaagagcagtgggagcttttgaggagttttgtggttctcagtcatctggagtaacagatccttaggagaatctgacaagagcaatggacttgcttcccagagacgggccaagtgtgatttctgccctactttaagggctcaccaactcctccaaagcctagtccaagtgagtaatccctgggttaggataagatgctacatttgagctgtccattcttgcatggaaatggggaggttgaccagatggccttctctggttttgaccatctacacccctgaaacgtgggccttctgggtgggtgcattgatcaggctgttgtgtctttatgttcagtaagtatcaggagcattctcctcttagcccacaaactctacaattgacataaaaataaatctacttgttcacaccattgcttcagagttcattattctctggtagaaaaggtcaagaaaaagttcattgtgaacactcaggaatcaaaaaggaagaaggcgttgttccaggccagggtttcttgacgttggctccgttgacatttggggctggatggttctttgtggtgggggctgccctgtgcagtgtaggatgttcagcagcatccctggcctccgcccactagaggccagtagcacccgctctcctagtcgtgactgtcaaaacgtctccagacacactgtggaatggcctcggtggtgggctgatcacctgtggttgagaaccacttctctgtttatcttcattttggctctcttatcaagggggaacacttcagtggagaatgaactgttctttcagcttctttttaccactgtagctgttcacacagctcacgtttgctatgttccaatagctgtgcaaggccctggggctacaaatgtaagtgacacccatgatctcaggtacttactgcatcctcttgggagatacacacagacgcatcaggagctgcactgagggaaggctgtgcctcatgctgtaggggggtctcctttgcactgctagtgtcttctccacccagaatgcccatccttctggcctctcccgtggctggatcttgcttggcattcacttctcagttgaaatgacactgcttccgagagacctgtcctaacgtcggtgccagctgttttcacctaatgctgcataacagcccagaactcggtggctcatgccaggcattcctcacttgcacatctgtgggttggctggggtggggctgatctgggctgggctcggatggctttggctctaagctgcagcttgggatcagttctgctgtatcagtttattgttctgttgtaccagtgaggttcttagtgtgtggtgttctggtgacgggagaagcacaaaacaaaaagccagccctcatgggcatttcagaatgtgctgcttttatagatgctgaagtctttttggccaaagcaaatcacgtggtcaaagccagcaggaaggaaggagactttttttttttttttgaggtggagtctcactctattgcccaggctggagtgcagtggtgctatcttggctcactgcaacctccgcctcccgggttcaagcgattctcctgcctcagcctcccgaatagctgggattacaggtgcctgccacaacacccagctaatttttgtacttttagtagagatgagtttcgccacattggccaggctggtctcgaactcctgacctcaggtgatccacccgccttggcctcccaaagtgctgagattacaggcgtgagccaccatgcccagctggaaggagactttatactctgcaaggatgtggctgtgtgatgcttttgcgggggagtgaagaactagggccagctgtcttcctcagacctcatctaaagcagctacctagtcactttctaccacttttattctcttttgagctctgatatgcttacntttgaaatattatttctgctaagagcttgacaagggtaaggtcacagactcgtcataacatgtggacctccacaggcagcagaggcaggctgttttggttggagccttggatccctgaaatagcacatcttatagggaggactggagagaggcccattgtgattggagggaggggagcctgttgaggagcaaccagagtcaagacagtagagcctggggccaaggccgccatgttccgtgtctggggaagccatcacgacagatctgtgtagtggcacccctggcagtgcgcaacctgagaagctgctctagctgcctggcagatcatgagggacctngcctaacatgtcagatgggctggatgcctattctggaagtcctctttgttttggaagagggtagactttgaacatctcttaccaaaggcatgcacaagttataagcagaaagcttctggaggcccctttgttttgaggcacatggtggaaacttggcagatacccagctcggaagggcatggcagcagcaccccaggcttgagcctcgtgttgtattgattaaggttgcatttattggagatctcagagtctctcttggtgcagcgatgcttagaatttgcccaaggcagcatgggagagtcactcactgtctgcagaccttatgactcctccttcccacctgcccagatgttccaggtcctaactggatccttagctcttggggagccccctgtgccgcggctgtagccccgccttggcagacacccatcacagttcagctaaggtgatcgtattgagggaggggagccctggccccggggtaagggggtctgggttccggtctcagcgctgctgggagactaggggctcggaagcttatttctctgactttaagtctcttgcaaaatgagaataagaaaactctgccctgcctcctcttgttgtgagaaacaaatagaatgatgaacatgaagattcttgtaaaacgtcctcaaagtgttattattagttactaatttgccttcaatggaagcaaagaaaaagtcatgaaaggggtattttgtgccaagccctgtgtgaggtatgtgcagtctttcagtcttttttttttttttttttttttttgagacagagtctcgctctgtcgcccaggctgcagtgcagtggcgcaatctcggctcactgcaagctccgcctcccgggttcatgccgttctcctgcctcagcctcctgcccaccacgcctggctaactttttgcatttttttttagtagagacgggatttcaccatgttagccaggatggtctcgatttcctgaccttgtgatctgcccacatcggcctcccaaagtgctgggattacaggcatgagccaccgcgcccggcccagtctttcagtcttactggaacagcctgtggggttactgcaagggtgaggagccatgtcagagaggcaggcgacttgctccagggcacacagcctgcgggcagccgtgtgcaggtctatgtgactgcgaggcctgacctcttcccgcccctccatctgccagttgttgcctatggctttctatgtgccagtcccgggtgctggggagccagcagggaaacaacccgtgtcccggctgcatggagtttgctttccaggcgacgaggcgaaggagtgaggacagagaagggcaagtgcagaacattctgtgctgggcctcaaagcaggactggagaatgagtaggggtgggcagggaaggcctctgaggggtagggacatttcatagggacttaaggagccactgcagcagcctctacaggcgtctgcagcgagagtggccccagaagtgggacccatctgtgctgagtggcggcctcacaggctctggctgggcctccttgggtgggagaaggctggttgcctttggaggggccacctcccctcctccttcctgccccatggctgctaggagactttttcctaaagcatctgagtaagttttaatgacgagtttcccgtgcggctggcctccagccgcagaacgtcataggtctctgtgggcgacacggacactgcaccctgagcagctttctcttgctcagcttcttctccacagttccagagtgttctggaaccttcaggctggaatgagcttataggaagagattggtttgggcaagagagccaccaaaccgcctccagtggggtgacttccactcgacagtcccacttagagcagccccatttccctacgggttgttagcaaacgtgaaggatcttgcgatgcgtaaacttccaggagggaggattttgtaaaggaatgttctcatggttgcgttctgagccgggatattagaaacactttatyaggctgtcatgggttagatgacactttagtccaagtgtttatccatttgggagatgcattttattattctaaaaatgttgtatattttaaaaaagcagaacaattcttttgaaataagttatttccaggaaaactttaggattaagaaacttgtaaaaagatctataaatagagaccccaggggctgtgsacctctgtcaccacagagcctgatcgtgctgtgcagtctaaaggggaccacggggcaagaagaggtgactttggtggtgtccagagcaggcttctcaacctcatgggtttggtgagtcaccccaggacccgggactgggcagtgcagtcagctcccaggtacakctgttgcccttgggcccagaagtaaggcttcgagcgccagctgtctcgccccaggccaaggagcctcttccctctctgtctggtggtcagatggtgcctgtgtgtgtgcagaacactttgagcgggagccctgggaataagttgctcttcatgattccagagagggaggagtctcctgtgtgccactcacccagtgtggtgtctgagctcgtcttcgtgtttcagagagacccccatctttctttaatgctcacgtcttcgtgaagccatcctcagcatcaccctgattggatgtgatctccccaactgttcacacctctcctcctgcctgttggtctgctctgtctgatgttctagatcactcccaaaatgtaccctgtccgctgtcctcaggggagcnaccgagcctngttcctctttgttcttcaggcgggggtggactggggtaggtaggggatgctcactggaaggctagaagcagcaaagctgggtcccaggaaggatctagggccagaaggtcatgtttactgatggcttctgctcagctcgcctgctgaccagaggctgaagsggggaggggtgggtggtgagtctgtgagtgtagagtcgtaacccacatctgtgccacccaacagcgtgaggcttcctgggcacctagggctggatggggccaggatgggctgaggacacagatgtgaggacagtgcccaccttcccgcacacagtggcagggccatgtgtgggggacatgggggaggaggaggggctgccttgggtgcagcagtacaagtgatggagcagatgggaggtctctgcagggctcccaggtggacaggagcctgccaagtgggccaggttgggtagaatgggatgaggggtttgcaaagtggtgggtgtggggaagggccaccctggagggagaagagttctaaaaaggaaggtcacttctcactcgtaccttggagtgggaacaccggaaaattaatcccagatcagcagagctcaaggcctggtgcagagaaacccatgtgtcatggtgacgtgaaagacctatttcagattctcgctagggttcaagttttccccagaggcagaattttttcctgggtcttcagttcttcacctgtaatgagaggcgatcctgatggatgcyttttagaggaacggcagctgccctgcttacccagcatcaagttcttcctgcggccacacctgcctggccctggggacagggacgatgtcacgccaccgtccctcctagggccagctcagggccctgctcatgctgaaagagtgaaacttactttttacagacatattttgaggggcacattcattttgctaagtgagatacacatttatgaatatgaaacaggaaatntctgaatcttattagcttagagataatggccaccactgtgtatggaagctgtggaaatgataatggccaccactgtgtatggaggctgtggaaaatctgcaagtattgtttcagatttaaaatgcgtgcagctcacacctaagtgctatagggctagtatcttcgtgactatctaaatttcagttttaaaaatctctaggccaggtatggtggctcatgcctgtagtcccattgttttgggcaactgaggcaggaggatcacctgagcccaggagttcaagactagcctgggcaatatagcaagaccccatctctacaaagaataaaattagctgggacaagtgatgtgcacctgtcatcccagctactcaagaggctgaggtgggaggttcgcttgagctcaggagtttgaggctgtggtgagccctgaatgtgccactgcagtgcagcctgggcaacagagtgagaccctgtctctatctgcaccaccgccccccncccaaaaagaagtccacactcctttctgggaaaagatggggttgtgaaatatgtaaataagttgaggagtgctttagggaggggttttgaaccatagaataatgagatttgaaygctggaggagatctcaccctctagttttaacaccttgtttaatttaatctcaattccttctgtaaaaccagagtgacatcacctgcctcagcactggttgtaaagttagaggagatgaggctgataaagtgcgtgcttgtgtctaggacttaatgttgtgatgctgaggtgaggatacaggtgaggaaactgaggccgggagggggactccccacccaggctgcacgtcagtgttgcctgggagcactgctgccaccctcgcctcccgtcgctgcgtgagcaccccagggtgctgccaccttcccaggtgaccctgtcgggagcctctcccaccacaagcgcagctcctgcggctcactctggaatcatctctctcaaagctggctcctgcttctgccttgaggttttctgggcttggcagcatcacccagtgggatttgtggcctggccctggaggctgtgagttggcctgtagggttgtggctgagcctcccatcagctacacccacggggggtggggtgggggaggttgggggttgccaagctccctgcaggccttgtagccacgactttgtgggagagagggaccatagggatggaacagggggcagcgccccagggggtcctcctcctcagttgaggcaagttgagagaattgggggtgctttaggaaacccaagacctggcattcacagaattttctagaatcagctcactggcaggcagggagggagttccctggtagggatggacaaccttgcctggccatctcatagggacagatgggacaggctctatcgagtgaacagcactgagcttgtgcaaggagttactgtcattaccccctcggttgtctacctaagacctgctgtgcagcccaccagaacaactgtctcagaaaaacttcacaccaatcaccaaagattatgaccccaggctggaagcagggtcaggcttggctcatgcctggtgacctcctatgtaggacagtatttctttcattgatctgcaagtttttaaaaataaaatctgctttttcactgcacttgtaggtacatacaatatggggacataaattcggggggaaccctggactctgaycctgcccctcaccggctgggcaattttccaggtccaaccactactctgagctccagtttcacckgtgagctgagaatcagctcccctcaaagctccctccagccctgacactgtctggtctttgtccgcctcacttccaaggggaaaagcaaggccagaagaagacctggcccacagaagcccagccgggaaggaggctggagggaaggagaggtggccagctcccaggttggccagagagttaggctggctccagtcccggagcctcccccaagtcacagaggcctccccttcccaacctgcactcacagttcccttctggccccaataaggctggccattcaggtgttgactgggtggcctgaggacatatggtactgaccactcagacaggggtgggttgtcctgccccaacagacttgccccacaaacrgggtaggcgactggggctgctcagacccaagaggtcaacaggtcattacaagctggaaccagacgccagcagagcttgggaatctacacccggtgacttgctgaccagcactgagactcgcctgacctcctgattcgtcacgcaacgggcccttgttgagtgccacagaggctgcaggaacattctgccgggtgtggtggtggttgatcctcagggcaagtgttgatcagctctgatgaaacacaacacagttcagggaatatggcataaccaagagaacccagaaaattcatgtgagaaccagcttcccttgttgtctgttagaccatcttgtttaaaaataaaaaattgacttccctgcctttttcacctaccccagaatacagtctactctgaggccaatcttttatcccctgagggccagaaattgagaaattcttccgcttctcttcccatctcatttctcaactccaaactcggttccgagaaaccacacctagcaggcgaggcgtcggggatccagggctgggagggtggccacagcctcgggggaagggcatggagctggcgccagggaagctggaggagccagaccaggaaagaggccttgcttgaaaaggcttactgaggccagtggtcttggaggaggaggaaggattagcacttggtccagccatgttggggcccaggcatggccaaagattggagtagcagcagccaggcctggccgccaggcagggttgggatgttcagatctgtatccaaggttaccccagcaggagaccatcagatctgcagtccctacagcctgtggaagtgggccaggacacctggggcatcttcagggtgccagggatggggaataggcacttgatgccccagaagccctttgagccggggtactgaccttgcaggcagtgggggagacctcaagtcccaggacacccccacaatagcttgagacctgagtattggtactgggcacccctcacctgctggcaggtggggttagctgagaggatacctgtgaatcccagaaaactagaaacctatgacacatgtgtaaggtaaacattgtgactgccgaatcagcctgagacctcttcaggggtcctgccgcatcccaagccatctgagcttttaggattacacagtcctgctcagtgggacctgggatttgtgcaccctccttaccaacaaattggcagagcacctgagtgagtgctgcttgagcaaatgcgtgaaggaatgaatgggtggcagagggtctgctcaggcgtcacaggtggagggactggccagccttgctttgttgggaagccggaggggggatccacagcccctcagccaggcttgaacgcctgcaccctgcccctcgtggaacccttgagcctttcaggccttgagccatgcccctgggtggaccacccatccgtggtacatgtggtggtgtctgaggctctggggtccaaggctgtgctgggcccctccctggacattgggcaacttgaggtttgattttggtcaccacccaccccacctcctccatccccttctccatccccttttctgaagacgtgcyttcacccctggccttttctctcttcttccttggggtgcagatcctggccaacgtcttcctctacctgtgcgccatcgctgtgggcatcatgtcctactacatggctgaccgcaagcaccgcaaggccttcctggaggcccgccagtcgctggaggtgaagatgaacctggaagagcagagccagcagcaggtgaggctctcgggaggcctcgggcctggagcttgggctcagggactgtggccttgtcagagggagaggaaccagagcggcagcccctggctccgtggggcttggcgttcatccaccctgttcaggtgtttgcttctgaactttgtcttctgggctcctcactattagagggcagcttctgagcttcagggagcctctcactcctaaatctgcttctgcttgacccagatctctcctcttctgccttcctgctctttgttttgttttcgtaatgtaaaacttttccctttcaagaaatgcattgcccaagcagccagctatgacttcctgcattcctttctcagatgaccttctcgggaccaaggtcagggtcaggggcatcacgggcattccttcacgtcacgcctccaccaccactcttgctggtccaaccgcagatccaccctgtgcacctgctcatgccgtgggtggggccttgacccatcctgcggcctcagggccctgctgggtgaagtgtgtcagcctcacacccccactcaggggagctcctccctcccttaccttcccatctgaggtcactgctgaagaaggaaaaccagcctgttccccggggatgcccttgtttacattctccatctggagagaggcctcgctgtccctgcctcggtttcctggctttcctccagtctcttccatggccgcaccatcctcccagttctcatgtcactcaggcttgtacatagttttggcctggattaatctcacatgctttttgaaggtctccagaaattacacccaccaatttcctgttatccatagggttatttccccttcaaaaacaaactcaataggttgacactatgattctctgctctgggaaccatgtcatctgtgttcaggaggttctgtgtgctcctgattcactgaaattgctgttttcatagatgctgccactcgggtggacagggccttggtttcgggggccactccggagcccttggcttgcaggagccccaccgtcgggcctcactcacattctctagacagtgctgttccgaggcacacactaagtcatttagctgatgggcctccgattccactgtcctggggatgttttcttcctccccgtttaccaatctcattccttacagaaggcccccataggaggggattttccctggctgccattgtgacaaaggtccaggcttagtagcccatcgtattcgccccttcccctgggccctgtgacctgtggttattgaggagctgctgtggcctgtgtatatttaaagaatcctcctttcctggcttgtaaagccccttgaaaggcattcttcaactctgtttttttttaatactgtctcatttcttgtttgtatctgatctcgcactgtggaggcatccctctgggttctctgcacttaaaaaaaaaaaatgcatgtgtcaccgcctagctaggcgagcattctttttatataacatttgcgcagttttcagcatgtctgtctgcattgatcttgtctgtctcatattgtacaatctaggacatcttaactcacactgaaccgtcttgtggaggccccctggtgtgatgaggaaggccctgtgtttcaccctggggctgttctcgtgtagataatttagataagttatccaccctacagagcctcacttttcctcatctgcaaagtggaggtattgacatttgtcttgtaggtttcttgagggtcaaatgagaaacccagaagtgctttgtaacccatagagcttttttagaggtaggccgagtgcacggggccatgaggcctgctttctaacacccagggccatatgcttcctctgggcagggtcagtgcagggagcctgggcaccagcagagagggtcatccctgggtgccccagggctcctgagggtgctagcagcctgcccgggccacagtggtgcttctctgcattgcctgcccacgctgcagcggcagagcagacattggccccaggatggagaggtccaggttaggtggaagggaggtgcagaggtgtggggggagttgaggggtaaggtgcatcctcaggcctagctgggcacacagccggagcctagaattctccaagtgggatgaatttgtctagccaggctctgtcctgagtgtggccttgggctcgttgctgcccctctttggacttcagtatccccatatgtaaaacttttgagagatttttttttctttctttttttttttttttttgacatggagtcttggtcttgtcacccaggctagagtgcartggcacaatctcggctcactgcaacctccgtctcccgggttcaagcgattctcctgcctcagcttcccaagtagctgggattacaagcacctgccaccacacctggctaattttttttttttttatatttttagtggagacggggtttcaccatgttggccaggctggtctcaaaactcctgacctcaggtgatccacccgcctcggcttcccaaagtgctggggttacaggcatgagccaccgtgacctgctgagagattgttttaagggtaagaaggaatctatgtgaatcccactgggattggtaaagcactgttaccattgggaaggatggaatcctgccccctgtgagtttccatttacctacattctccttacgtcttctgtctctgttcaagagagaaacctgcctgccattttccttcctttccatgtgcttgacaggttttggtattacggttatgcccaactcattaaataatttgagaagtttctaacccytgatagtttgaagataatttgggttattccttaaatttggaagtcacagccaggcatgtggctggcctgtaggtgtggccaggcaggtggctatgcctgtaatatcagcactttgggagattgagacaggaggatcacttgggtccaggagttcaagaccagcctgagcaacaaagcgagaccccatctctacaaaaaattaaaaaattagctgagtgtggtggtgcatgcctgtagtcccagctacttgggaggctgaggtgggaggatcgcttgagcccaggaggttgaggctgcagtgagccatgattgtgccactgcactccagcttgggcaacaaagtgagatcctggctttaaaaataaaaaaataaaaataaaaaaggccctaatgaagaagtcctataggcctggagtgttctttaggggaagattctgtttccgtcatagataataaggttgttcagattttatatttccttttatataggttttagagaggtttttttcccccagaaacatgtccattcaaattttcaaaatttyggcataatattcttaatattttctttttatcttttgtctgaaatgggtaatgatgttcctttttttcattactgaagataatttgtgcctttttaaaatttttcttaatcagtcttgctaaggcttattgttttagcctgttcagcagaccaccgttaatctttgttgctttctttgtacatttcttatctctgatttatttatttattttgagacggagtctggctctgtcacytaggctggagtgcagtggcgcgatctaggctcactgcaagctctgcctcccgggttcacgccattctccagcctcagcctccygagtagctgggactacaggtgcctgccaccatgcccggctaatttttttgtattttttttttttagtagaggtggggtttcaccatgttagccaggatggtctccatctcctgaccttgtgatctgcctgcctcagtctcccaaagtgctgggattacaggcgtgagccaccgcgcccagcctcttatctctaagttaaactttgtcattgcctcttttttctttgggcttaatttgtgtccttttttaccttcttaaaatggaactttattgttgttttttggagactgaatcttgctctgttacccaggctggagttcagtggcgcagtctaggctcactgcaacctctacctcctgagttcaaggtatcctcttgcctcagcctccgagtagctgggaacacgcccggctaattttttgtatttgtagtaaagacagggtttcaccacgttggtcaggctggtctcgaaacctcggcctcccaaagtgttgggattacaggcgtgagcccccaggtccagccaaaatagaacttcagatgaccgattttcagcctttctttcctaaaacatgcatttaatgctacagatctcactcattacattgtttgagctttatctcacaagttttaatatgccatattttcagtgtcgtttaatttaaaatatttactaattttcattgaaatgcctttgatccatgggcgacgtagaagtgcactaagttctaaacatttgaggatttgtttacaattatgttgttttttatctttattctggtcagagaacatactctaatttcaagtctttgaaatttcttggaacttgatttttggcctagcatgtggtcagttttgatgcacttgagaataatgtatattctgccaaatctgtcaaaatctttaaaaaatgaaataatgtcaactatgtcatatttgcatctgccccaaattagtacttacctctttagtcatgawgcaaggacctcacaaccttttaacttcatttcacaagcctctgccccccactttctgcttattagtataatgtgttttagttcaacatattttaaaccccacaagtccttattgtgattattttatgtaatattcttattaatattctttacttatatttacccacagttttgccctctcaattgctcttcctttctccatttctttgcttcattttcttgaagaattccctttagtattaccttttatgctgatctcttggtaccaaattctctccatttctgattacctaggagtgtgcttattttgctttcattttcgaaagatacctgtcttcatccgttttgtgctgctacaacasaatacctgaaactgggtaatttataaagaacagaaatttactacttacagttctagaggccgggaagtccaagrtcaaggcaccagcatttgctctggtgtccatacatggcagaagggtgggctagctgaatgttatgtgatgccccttttaaaagagccttaaccctcatggcctgatcccctcttaaaggccccacctcttaatagtrttacattggcagcacctgaattttgaacagacacattcaaatcatgccaagactttttgcagataattctaggctgccattttttacttctagccctttaaaagcatttcactatccttcccgcttccttcattcctgttgaaatgccagttgtcagatagactgttgctcccgttacattaatgcatactttttcctgtggttgctttcccaatgctctttgtttttggttctcagcagttttacgatgctgcgcctgggagttttctttgcagttgctctgcttggtattcaaagagcttcttgaatgttggtttgacatctctcgtcagttttgaacattttcagccagtatctttttattgcttcttcccattcgctcctttcctctaggactcaatatccttgttagacatttttaccatgttccagaagtatctctcttctttttctgaatctttttttctttttgcacttcagacaatgttttgatgggcctaatctacagtttactaatcctgtcttcctctggtttgtcagatcagtggttgagctcttttattgagtcatcaatttcaattatatatttttctgtcctagaatttccatttgattttaaaaactggacttaggtccctaackatgtattcctattttgtcatctattttttagaatatattaaacatttattttaaagttcctgactgacaaccataataataccaatgggtatgcatttttttgttgttgaaacctggcatcttggcctttttttttttctttttttttttttttttttttgagacagggtcttgctttgtcactcaggctggagtgcagtggcttatgcatcttcgagttcctgggctcaagcaaaactcccaccccagccttttgagtagctaggactgcaggcgtgtgccaccatgcccagctaattaaaaaaatggttttttgtagagatggagtctcactgtgttgcccaaactggtctcaaactcctggcctcaagcaatcctcccactttagccacctggcatttttaaaaattaaatactagatattgtgratgggaaatagtagtgcttctgaataatgttgtgtctctccagggaagatttacttttcttgtggcagatggttagagcaggggcagataggaaatagcttctcaggggtcttacctgaaaggctggtgcttttctcatggtatcttgaactcctcagcaatgtgaggctactgaaagcttagcctcttagtctcactttctgcttggattcttggtctcttgccccatgcaaatactaaagggtaatagtgtacagaaagtcagactcactgttgtatggttctctttccccggggtcttagcccctctactctctctgccttggaatccttgctcacagtccttgtttctccagccccttgaaagccctcatcattgctctctctccagcctctcgaccctggtcgcaagggaaaagtggtggagtgcattgggctcacttaaatgtgtttcccttcccctgagatcttggcccctcaaatcctggctgctttggttgtttccattgcctttaaagagctaggttctttttatgtattttatccagcttttatagttgttcttggctggagggttggcctgctataagatcctctatagcaaacgtatacatgtataaaatcgtaaaagtatgaaaaagggtatactaggaaaagtaagtcatcccaccttcatttcccctagccatccagcccccatccatgaatcaccagtcactattatctttttaatgtaccctttcagaggtttatagaattttcacacacacacacacacacacacacacacacacacacacacacacagatgatagcctattcactcttttgtactaaatctatttttctttttttgagacagagtctcactctgttgctgaggctagagtgcagtggtacaatttcgactcacaacttccgcctcctgggtttaagcgattctcctacctcagcctcccaagtagctgggactataggcatgcaccaccacgcctgcctaatttgtgtatttttagtagagatggggtttcaccacgttggccaggctggtcttgaactccttacctaaagtgatctgcccgcctcggcctcccaaaatgctgggattacaggcactagatcttttcacctactatcttagagagcattctaagtctgtattgcattgccacaaccttcttaatgactgtgttcagtcattatacaaaagtaacaatttattttgttgcgctctccatagatttctaggttatttccaatcttttgctactgtaaacattgctgtaataaatatccttgtagcggtatttattatatcatagtatatatgtgcaagtgtatctgtggaagaataaaaacctagaagtggaattgctggatcaaaggacatttgcattttaaaaattatatatatagctactgtaaaatatacatagtataaaatttaccattttaatcattaagtatacaattcagtggcattaagtgcattcacaatgtcgtgcagccatcaccactgtccgtttccagaactttttcatcatcccaaagagaaactctgtgcccattaaacaataactgcccattctcccagactctggtaaccactgttctactgtgtctctgaatttgcctctactaggtcctttatataagcggaatcatgtatttgtccctttttgactggcttatttcacttagcatgatgtcttcaaggttcttctgtgtcgtcgggcagatcagcatttctttcccgttaaggctgatatctccttgcatgtatacaccacgttttgtttgttcatttggacatttgggtgttttctgcggctttgctattgggaatggtgctgctgtgaacacgggtgtacagatatctgtttgagtccctgttttcagttcttttggatatatacccaaaagtggaattgccaggtcatatggtagttctgtgtttaattttttgaggaatctggaatgtgctttttttgttttgttttgtttttttgagacagagtcttgctctgtcgcccaggttggaatgcagtggtgcgatctcagctcactgcagcttccgcctccgggttcaagctattctcctgcttcagcgtcccgagtagctgggattacaggtgcccaccaccactcccagctaatttttcttgtatttttagtagagacggggtttcaccatgttagacaggctagtctcgaactcctgacctctggtgatccgcctgccttggcctcccaaagtgctgggattacaggcatgagccaccacgtccggcctcctatagagcttcagacaatttatactccaccagcaatgagtgagcgtatacttaggcacttaagttttccttgtttatctagaaaatacctcattgcttttggaaaccctccccaaaggattcctatttgaaaaccccagccccagggaaccagcctcaaggcaggagtgacatcctgtgggctgtttcctgccttatcctcatttggctcaagccacagacagataaactcaagtttggaagagttcctttgctttcttggcctacactgtgtaatatttggcaagaatatacaattataaagaaataaaaaagaggttggcatagtggctcaacgcctgtaatcctaacactttaggaggttgaggcaggaggattgcttgaggccaagagctcaagaccaacctggccaacatagtgagacctccatctctaaaataaaagactgatagaggctgtattagggttctctagagggacagaactaatggaatagatatctatgaaggggagtttattaagttttgactcacatgatcacaaggtcccacaataggccatctgcaggtaagagcaaggagagcctgtccgagttccaacactgaagaacttcaagtccactgttggagagctggatgcatccagcacaggagaaaagtgtaggctgtatggaggctaggccagtctctcttttcacctttttctgcctgtttatattctagcaaactggccactgattagattgtgcccacccagatttagggtgggtctgcctttcccagcccaccgactcaaatgttaaactcctttggcaacaccctcacagacacacccaggatcaatactttgtatccttcaatccaatcaagttgacacttagtattaaccatcacagaggcatattccttcaagccttttttttggtcctgatatttgagagtgtcctagccatgttttatcctgattaagagattataaatgtaacaccttcctctcacatagtatagcagctgagagccaagtaccagagtctctgcccctctcctatggccttaggggagataagtgttaagtagttattgcacagtgcctgcacatagacaytcaaactctctaccatcatatgattgttggatacaattttgaagatatagaaaagtagaagaggccaccaaaacctcccttaatctgggactttttttgaaaaataatttttaaaaatgaatatggtattataaattagatatgcagttagaaaaactcaggtttgcttcatttttttttcttttttatagagctaaaatgaaaccccttgaaagtggtttagtayactcaccatgttgtgccaccaccacctctagctagttccgcaacatcttcccccaaaagaaaacttgggacccgagcttgatttttatttgtttttattttttttaattaattaattttttttttttgaggcggagtctcgctctgtccccgaggctggagtgcagtggcacgatctcggctcactgcaagctccgccttccgggttcacgccattctcctgcctcagcctcccgtgtagctgggactacaggtgcccgccaccatgcccggcaaatattttgtatttttagtagagacggggtttcaccgtgttagccaggatggtctcgatctcctgacctcgtgatccgcccacctcagcctcccaaagtgctgggattacaggcgtgagccaccgcgcccggctaccgagattgatttttaaaaccagatagaaagggacctggtgagccctgggacaggccttgcacgtgaggacaagggacccagaccctagcacagtcccacagtcctatgctccagcctcaccttgtggtggatacctgtctgtactgggggttggggagggatgaccccgctggtcatcttggacctggatttgcatccacagcctctgccagcgtttttgggggactgtgagccctggctttctctgtgtggtgttggtactttacctctctggtctttagtttaattttctgaaaatgggattaaaaataataccattgttaggggatagtttgggaatcacatgaaataaggcagaggggagtctaaaaaccatgaagccctttggggctccaagatgccgtcacgctggcccccagcccctggggaggcaccggctgaagtcagggtggtgaggtaggatgggagctggctggggcctgtgcatccttccccttctctcttccagccaggacagaggtcactccctcccaaggcattggggctgacgttgggagtggcgtgggctctgggctgatttgacgtttcagaaacatcagctgacgggtcttcggagctgagtgcaggccggtactagaggctgcatgaccccgtttcactttcctcctgtaaaagctcctcatgagaataaaaatgagataatagatggaaaaacactttggaaagggccgcagacagtcctggtatgagaggaaacagaacctggtttggaagtggctccaaagagccatttgaggtcagtgtcagagcaggccatcccttacttacatgtgtgcttaatgtcttttttaagaaaattctccatttaaaaaaattatgagtgtctcctataaaaacaatcgttaatctaccctctgcaaaaaaggggcctccttccagaattgagtgcccagggtccatgtctcactttttatttggtcaggtgctcttatcttttttttttttttttttgagatggagtctcactctttcgcccaggctggagtgcagtggcacgatcttggctcactacaacctccacctcccaggttcaagcgattctcctgcctgagcctcccgtgtagctgggactacaggtgcccaccaccacacacagctaatttttgtatttctagtacagacggggtttcaccatgttggccaagctggtctcaaactcctgatctcaagtgatctgcctgccttggcctcccaaagtgctgggattgcagtcgtgagccccatgctcggctatttatcttgttttctaagctgccttaagagtgtgcggctgaagggcagccctggccatgtggctgtcccagcaggtgtctcctcgctgggcctcagcttcctcctctgctgtgaagtgaggtgtagggatgcgctggtgacctgagcccgctctctctcttgccatcccctgggaagttgtaccttctgttatgaagatgaccagcctcctaatgacagtcaactcccagatgggtgggcagccagccatggtccaggagggtgaggcggcacagtccctcaagcacaggcatccctttctgcctcctcactggggtgagcatgtccacatgtcaaagggtgcattgaggcaacagagcatttgggtaatggcaagggtctcagattccagtggctttgctgctttaacctccctggctccagtctccttcagggaggtagtggagcctgccctgccctgaggccttgtggatttggagctcttggtgcagccctggcatgcgaagcgtcctctttgcctctgccgaacacatatctggcttcgcaggcagtgccatggcgcttccctgtggtgcggggccgccagggtgcatgctgaccttggtccagcctcccggctctgtgggcatgtgagggtagagcaggaggcccagaggacagaactggagttgtttgtctttattcccatgtgaccacacttcaggggttagttggggaccttgagggttgctaagcaccccagccgccacctggcaacaggcggcacccagaaaacccactcagcacacacctgctgccaggtggagctacaaaactgagcctctctgaatcatactcagaatcacttcccagggatcggaacatggttgacggaggatgtgggaagatggagggatgacaggggcaggcctgtgcttccttcacacgcgtcctgtgtggttaactggccctgtgcctggtcctccctcggaggtgaggactgtccacagtgcccaccctcagacaggaggatgctgcagccagggcacgtagagggagagcccagggcagactgcacagggtctagggtagaaagccatccccatcttcacccttgggatcctggggagacagctgaggtggacgctgggtgggtttccattcaggtcttgggggactgcacagagacacagctgcctctccccacctctccttctgctttaacccacktgcagggtcacctgttactagggatggtgtttttccttcakgccggtcttacagggaagaaccgcccattgaccacaagcgtcaggcccctctcctgggagccccggagcttgggacactgggaggctgccatttcytaagcttggattgtatctcttgcttttctgaatgttcttcctctgtaacctttgcccaagcctggtcactgtttcccncaagaccttttgctattaggacaaggtgtcatcaaccctgagccctgttcttataggcgcttggtaggggagaggggagtcagagccagaggccagttgcctcttggcctggggttgggcttctagtgccaagccccaccntgccactgttatcctggcaacagtgaggtcggggcagggggaccactaagagtgggaagaggagacgaagctggtgtcgagtgggagggctgtgcctctgcctgtggatccatagctgctctgcgtcttgctcgttgcaccgtggctgcatcatggcattctccgcgtctaatgtaatgggtcaaatccattgtctgcttcacaggagacacacagacacgtccccacccccagcatcagccttgcattgtactcgctatcttcttcacagaaccacccacaaagatatctaatatttttagtttttcttttagcctcgaatgcctctcagtgtgagaaaagccaggtgcgttccccataatgcgaagtaggcactggtccttctgttggttccaactctcacctcttggatgtcacagaatgctcttcatttcaacattccaggacttagcaaaacaaatccacatttcagataatgcagatgatgaacccatagaaaacaggttgtcctaaagcagtggtgggttcctggtggcagtgggaggatgttggctgtgtcagggtggacctgagcagagctggtgaggacagtcctgctgacggcccatgcatgggctgtgtggcctctgagctgggctctgctgggctgtggcaggtcttaagcctttgccacatcctccagcagaatttttctccaaacagttgtagaattgctggagaactgtagagttgtagaattgtagaattgtgcattgtggccagggttgtggcgcattttatatttatctggctgtaagaatgaagttttgttagtaatgagtgtagttttattgaacatttattttgtgccaggccctggatggtgttttcattggattatttcatttaataatgagatctctcatttaccagctggcacttcctcctggctctatttgggagatctgttaattaacaggaagaatcagttaggtagtccttggaccacagctggcctgtgggtatctgttttgtttgaccttcccagagtgttaacattttctaatacttaaacatttgtacattctggataaaaacctggatttttgactcacttagaaaatggaaagatctgtcaacaaaggttgcaagtaagacttgcattcacattctaactgggtcactgagcccctcttgagcccaggagtccaacaccagacatggcaagaccttatctctacaaaaaaacttaaaaaaaatccaggcatggtggtggtgcgcacctgtagtcccagctacttgggaggctgaggcgggaggatcacctgagcccagcaagatcagtgtgcagtgagctgtgactacacttcagcactccagcctgggagacagcgggaccctgtctctttaaaaaaaaaaaaaaaaaaaaaaaattcagaccacaagtatttcaggacttttctaggcactggggatacagttgtgagcagaacagattctagtgtgggcaacacacattaaacagacgagtatgtgctatgtcaggagctgggaagggctgtggagagaaagcagaggacggagcttagggagtgccgtgggtaaaggtggaaattttgtcggtataattttcttgggcctttatgcccagggtggtactgagttgctgcatctgggtcaaggagagaatgcaaagggtctgctttccgccagtcacagatacraaccctccgcatccttctcaacacagggctcgaggcagctgctctctgcccatcagagttggcacagtacttgtgactacagtgttctagagctgcaataggtagcagtatggtagccacttgtcatatgtagctatttaaattaaacttaattaattagaaaatgttagtctttcagtagcactagccacatttcatgtgctcagtagctaaatgtggctgccatattggacagcaaagatacagaacatttctgtgattgcaggaagttctattagcgctgttctagaggatggtggcttgccccttgggccaggtctcctagttgacagctcgttaactcttcaaacctctaaggagtagtacctgctctttgccaaataattcgtggtgagggctccaggtaccacacacgtggccatctttgggcccagtgggctgtctcctgagactgcagtcaccttggcctacacggtggcccctgtctctggggactgcacaggagaccaggccagtgaccagaagtcccacatgttcggtgtcccctctcctgctctggcagggtaagagctctgggctgaccctgggtctgtgtgatttccgcactgttccagatgacatggcctggtggcttgttagtctggccccgccaacactgagattaaatgtggccctgcttctcttggggcctgttgatctggggactctggggacactggtctggtgcctgttctcatgctggaggccttgtttccaaatatgctgacttttacagttatgcagctcctccctcctctacrttcctacagcatttggctgaagactgtgaagcactcctgccctgggagaccagtctctcccacgtgtgaccattgccccacccatccaagctctttggagtactgtttacctttgaccttcccagcatttagctcagggacatgcatagatgaccagtgactgtccttcgagtgactgaggtggggaacacatctcttgggcaggggcagcacacgtgggccccctagtctaaatggcggcagtattggagtttccagatttcacacattgtggtacttcgtcccctcatccgggagaggtgagctgtttgggctctggcctcccaaggttactaggcctggtccttctctccattccctgcctcccacagccccctctgcttaggtagtcaggccatgatggacgccctggtggggtgcagtgactttttggcttccaaattggctggacactctaagaatctggattaatcgggaccaagacagactggtttgtgaaacatctgtgggtatgctcacagcctgtgatgggttacagtgacatgtatttgtcaagcacatggcacttagaacacatgaacacacatggacacacctaccctacagacaaacagacttcatatacatacctcatgcagacactgtagacagtagacacgtacatgcagctgcatgtgtgtacatgtgcaagcgctaacgcatggacacacacacacacactctccacattcacactcattcccagccacctgagcactatgggtctctctcgacctaactgtctccctcttacaaggatgttgtagaaacttagcttctcaccagccaacctcatttatccaaatccctcctggcctccttgctgtaattaactcctgaatgcctcatcagagcctcagctgtaacagctygggcccctgggaacagtgctggctgcctcccccttctatctctgtcctgagccagtgcgaaccaggcctggcatgagtcatccctgagtagaagggggcttgggtggttccttctcggagccctgtggaggccatgccgacagattgccctggggtgagaagctcaacacatctgctctcagctgagatcccagcccaggaggcccagcatcttgccccaggcccttctcaactctctaccccactgcaggcctgggtgcttcttcccaggatctgggcaggttcttgctttacccaggaaacctactaggaacttccagggcttgttgttttttctctggactttgattcttttcccagagagggtcagggccttgacttttattaccatgctgtatttttaggataaccatcaaggacttgaaggctgaggagaatgaagastttaccctccttcttctctgtgcagaaccacatctgggcacccaggcctcggcccccagggtttggccacatccccctcctccggtccagccttccacccctgctcggctcttcccgcagtcttctctctcggtttctgggaatgggagttcaccacctctcagggcagcacattctttgaactgtttgactctttaaaaattcttccttctctgaaagcaacattctgttccccagcagcctttcctcattagctttctctcttggggcctccaaagcaagtcttgtcccttttmtacatagcagctttcctcagacttaaagacagcttcctaagaagaagggggtgggggggacctggggctaaggacacagcctggttaagctggaccggggcctttttatttttctgtcacacagcccrgagccaaggggcttgttcaggcagctactttatgctgggaattcattttattttattatttttatttgtttcgggatggaggctcgctctgtcacccaggctggagtgcagtggcgcagtctcagttcactgcarcctctctctcccgggttcaagcgattctcgtgtttcagcctcctgagcagctggtattacaggtgcccgccacgaagccctgctaatttttgtatttttagtagggatggggtttcaccatgtggcccaggctggtcttgaactcttgaccttaagtgatccgcccacctcagcctcccaaagtgctgggattacaggcgtgatccaccatgcccaggctgggaattcattttaaatctaacagcatctcaaatggtaggtgtcccccttctamcccccgcaacattggtacattgtgtctctcccattctgttctcctgcatttggtttgggagtctcaggtacagactatgacctctatcctttttgaatttcatcctgtatgttgcaccagatttcagcagaacaaaagccacgagccacttgtcccagtgacacgccagccacacatttctaaatacatcctctgtatcttctgagaagttctccttctggaaagatttacactttaaacaaagaggcctaagagatgcccattttatagataaggaaccaagcccccggggtgaagtacctgcccagggcatgggggcctttgcagcctaaccccagatcagtgagctttgctgtaccccccaaaacccctgggtgatatggccactcctctgacagatgttctgattttaaacatgctttgtttcttcagcaaagccacctttgggattagtcattactatcttacgtcaacagatactcctctgtttagtccaggccatcagataaaaagtagcttcaagtgaaggaagggtcctttttccacagtccggttctctggaaccctgccaccccctaccgaaagtcacagtccaagagtgaagccaccacaggccacagcttcaagacaccacagcctgaacaggtgcagtcctgggagaagtggcctctgtgtcctcaagtaatttttataaaggagagacaacaccaaaggggcctgaaatggatcacaagaattcacatcatgatgaatatcaccattcaattgtgtactgattattgtatatcctcattcaatggctatagtcattgtatatacagattcagtatatatgaatcagtatgtatgaataatgatgttcagtgatgggcattgaatagcgatgaaatgcccagtgccaggagctttcaagagataaggctcactggccgggtacggtggctcatgcctgtaatttcagcaatttgggaggccaaggcaggcagatcacctgaggtcaggatctcgggcagatcacctgaggtcaccaggctggccaacatggtgaaaccccgtctctactaaacatataaaaattagccaggcatgatggtgtgcacctgcagtcccacctactcgggaggctgaggcaggagaatcacttgaacctgggaggcggagcttgcagtgagccgaggtcgcaccattgcactccagcctgggtgacagagcgatgccatctcaaaaaaaaaaaaaaaaaaaaaagatgaggcgcgtttcaatctgaaaatcacactataaaacaattgtaacaataaaaaaggattacaggaaaagaaaacatacaaagaatatggaagctgccaagtgacccctgccccctgggcgctgccctgttgcaccttcccctgcggcagctcctcacagtggggtcctgtgccatccttgggctttgggaagggggcaaggtcgccatacgtcgtgtcctgaggygcgcagccatttccacctcaaaacacatcgcactggctttgagggtcttgttttctgcagcttccttataccccagtcctcggttacaggttttgcctcctagtttgatatggctggaggcagtgcctttagtaggtagactcttccagaatgttgtacaaataacacccctacacacacacacacacacacacacacacacacacacacacacacacacacacacacacacaccctccagctgttcctttccttcaaatcttgttcctcaagagagacttctcaaacctcaggtgcacaggtgtgcctcacggtccgtggcttccccaccctgatgagcacgggtgatgctgagtccacagccccaccagccacactctgggtagggcagcctgaagtcctggggatgggctcggctgaaccagggctgcacycccagcaccggctcggccactctgtgtggcagtgacgagggcaacccaagtttccgcgggcgttggcagctcgggtcctcgggcagcggctcctggccgtggagaggcaggcaggcgtctgctgggggtgttggggagcagcaggcctctgtcgaggtccggggctgtcctggcatcaggcctctcacgctcagcccagttgagtactttctgagtacacggtggccactcatgcctgctctgaggccgggctttgccacgtgggcccctcctctcctcagcctgtgaggagtagcacagggcagtgaggccggggaggccgggtgacccaccagtgtccttaggccacagggtggggagggagccatggaggcagcactctcctcctccgcttcctcttctctgcttaatgtgggtcccagggaggactctaggagccgccaccaccactgcccctgtaccccccacccctgcctggtgcctggcaatggcagccacaggacgtctttgaggacatcagatgccgtggggacagtggattgcagaggaggagcggaccggggtgctgggagacacatcagaggctgttgcaagttccccccgaggcagccgctgggccgtttctgtgaggaaggacccaccggaaggggctgcctgattcccacgcccaggtggcatggagccctggggagggtgtccagagccagagccgcactgtcagggccttactatgttacaaaacaccagggcttcggtctgggtcctgctgcttgcacagaaagccaatcactgtgacagcanttattgccaaggaatacggctttaatcgggtgctgcggtagaggatatggggactcagtctccaatccatctctctgacctgctaaatccggggtttacacggcagggaagaaatggaacaacgcgcgagacaataggaatgaggggtcctgagtctcattgtctggatgtggtgacctggttggtgagtttcagttattcagtacttcatttgagaggcctgaaggtcctttgctgaggaaggaactcagataagtagaagttttaagccttaagagcagaaggatccatttctatgtttatttaaaagaacagtctatgggacttttggaaaggttttaaccgatgcccctgggcactggggggaccttcacatctgtagcagaacaacattaaagcagatgagagaactggggtgggaaaagcacaaaaactcacccattccaggggtctcagagccctgggttcagggtctaccgctaaccctttgggatgtgtaacagacaacttcatctctctgtgcctaggctttgtcacctgcaaacttgagacaatattgcacataaataataccgggttgatgcagaagttttagcaaaggagagggatgattttgactgggtggatggtgtctgtcacctggtgggtgctgggttcatgagagctacagagcgaagccagcccagggtgaccgttctgtctttggcttcctaggaggaccactgccttcccccacccccattttggctgtgtgtctccttggttcgtgcctggccataggttccccmtcctcaggttatgtccaagctgactaggaagtctggagccaagcccaaaggccttgagggatgttccctttctaagaaaactgtggtccttccagagaagccgaggtcagggataggatcacagctggaggcaacaggaagttccatgtttatttccagtttaaaaagtatttttaaaaagaacaaccaccagcaccctatagcaactttgaaaaacgtttcaggttttccctaattcggtcgtccaagttaaatgagccttttctctttgcatatagccttctgcctttatttctatgcacacatagatcccagcgtcagcttcacagaacacaattttgtcccgctcttctctctctgtactttattgcaatgataaacaatactgttgtttcattatggtcattcttaaggttgtagaatcttccatccagaggatgtgtcattttaattagccatttgctgggtatttgggcgacttacagttttttccacaagggttaagtcaagttgcaatgcagatcaccttctacgtatatctttttacttctgttggatttggggggataaattctcagaagagctattaatgggtcaaaggtttggaacattcttgtgactcttgaaacgtatagcaactgctatctttggaagagcaggctctgcttccacgctggggagaccaagccacattgatcatccctggggccctgagcaatcctaggctgctatgggtggcctctctcccctgcactcctgtcccccactgtgggacccatttgccagttcacctggatcccagcctccttccttcccccaggaacacaaatgaaggggtgtcggagtctttagccagggctctggaatggtaatcagggatcttctgtgtgtgtatgagcatttttctagaaggtccgtagctagcatcacgcactcatgaaaggggccaggatccaggaaagggtttagaacctctgaactctaagggcaaacaaggccagcaccaatcgagaggcaccaacaaagtgggtgttagtgaggagggaggaacagacacccctgggcaggggccaggggctctctggagaggtgacatgtgaggtgggtgtcgaaggtgtggggagggaggaatgttccacagagagtgacaccagaagcagaggacagggaggggtaccgagaagaggaaacagtccagctcatctaccctaaggggccacaaggagagcagtgggggacaggactagaaagacaggtcagtgccaccactgagggtgctgggcaatggtgtcgcacagcttagaggacatccagataccgtgccaaaggtggactgaatgagaggagccggccggcacctgggagacacattcagaggcggttgccagaggccctgaggcttggggggtggcagggggagggcccctccctccgtgggccttcgtctcccagacccccctcctcctttcccctctgtcaggttccgtgtgtcctttcttctgcacgcactgacgtcttgtttaaaactcgtcttgttaccagaatgactccaggtagactgttggcctgcttcactttttgagcctgactataaggtttccacaaaccacacagggaattggcagcctgaatttataagcatagctcctttcttgttatttaagtttgattttctgctttcagaacatatttgtgctcttagcaaaggttatggaaatatataagggaaaaaaatggaaattccccctgtcccacccccagagagaagctcacggccgcttcactcatgtggcccttccgaggctcctgttttgggctccagggctgccctggttttgtgcctctgccgctacttttgttctgtattggtagacagtctccgagaccccagccataccgggaggaggctcagcagtgtctggagggagaaccagtactgtggtcaggggcatggagctcccacaggactggattggactctcaggtccccaaggttccaagagagcctgaagaggcttttctgaagggacagaactctgaggtagacccaggagggcaggaaaggcctgtgtgggctgtggctgcaggagccactgcatgtaggctgggagggaggccagcacggtgctgtgacgttcttaaacctcacgttccacgtccctccctgcccacacacctgaccacgcctccccatgctcctcacacatctgcgccctcctcacccaagcagcaccctgaatgcacacgtggcggggggggctgagactcaaatggaaggcagggcccttccttgtatccctttgttgtcccacctgcagtaagcagagctcaggagaccaggctgagtgacccagagggtttgtgctgaccctggcacatctcactggaactcaacctaaaaacttctggccaacttcaaagcccagaggaacattaagccctgtctttttgagccacctgctgtctccacaccctcagtcactcagtcatactttctatcatgtgactgtaggaaaagctggactatggtgagcgcttcctgtgggccaggcactgttctaagtgcttgccggcaatgaattgtgtccttcctgctttcctgcctaggaaaccaaggcacagggaggtttagtatcctgccttatgccgagaccagctcggctggggagaccctaacccagtggtgctagagaaattaaagacacgcacacagaaatatagaggtgtgaagtgggaaatcaggggtctcacagccttcagagctgagagccccgaacagagatttacccacatatttattaacagcaaaccagtcattagcattgtttctatagatattaaattaactaaaagtatccgttatgggaaacgaagggatgggccgaattaaaggaataggttgggctagttaactgcagcaggagcatgtccttaaggcacagattgctcatgctattgtttgtggcttaagaatgccgttaaggggttttccaccctgggcaggccaggtgttccttgtcctcatttctgtaaacccacaaccttccagcatgggcgttatggccatcatgaacatgtcacagtgctgcagagattttgtttatggccagttttggggccagtttatggccagattttggggggcttgttcccaacaccttatagccacagtgagtgcaggcagggctgggggctgagccaggccagcactcatgatcctgacggctgcctcctcctgccccgcgagcctcaagcacaccagggccgcacactccagtgcgggctgggatccccgggattactgaccagagaaacccagccccagcccagtgggtgctgcctcccacctgcctcctccagactcctcagctctgcctgcccctcaggactcccagcagctgtctgccttgayaggctgccctcaagagctggtggggcccyatctctggcttttcttgaaaaccttcctagaggctcatcttttctgcaaacccagagctttttccacaatgtctggttagttaggttccgagacgggtcctgtcccacccagcacttcacccatttctttgcattgggcatcctctcaccacacttgactggcagagagaggggagttgccaagcaccaaggctgcctaagttgctatccctgggctgcagggccctgggagaactggatgccacttcccaggcttcggtggagccagggcagggcgtactgggattactttgccttctcattcctgagctgtagtgccatgcttgaggttaacagtgaagagatattgctgtggaaatggaagaataagagtgtcttagtccacattcatgctgctgataaagacatactcaagattgggaagaaaaagaggtttaattggacttacagttccacatggctggggaggcctcggaatcatggtgggaggtaaaaggcacttcttacatgctggcagcaagaggaaatgagaagcaaaagcggaaactcctaataaacccatcagaccttgtgagacttatttgctatcacgagaatagcacatgaaagtctggcccccatgattcaatgatctccctctgggtccctcccacaacatgtgagaattctgggagatagaattcaagttgagatttgggtggggacacagccaaaccatatcattccactcctggcccctccaaatctcatgtcctcacatttcaaaaccaaccataccttcccaatagtccccccaaagtcttaactcatttcagcattaacctaaaaatccatagtccaaagtctcatctgagacaaatcccttctgcctatgagcctgtaaaatcaaaagcaagcggccagacatgatggcttacacctgtaatgccaggactttgggaggctgaggcgagtgaatcacctgaggtcaggagttcaagaccagcctggccatcatggtgaaaccttgtctctactaaaaatacaaaaattagccgggcatgggggcaggcacctgtaatcccagctactcaggaggctgaagcaggagaattgcttgaactggggaggcagaggttgcagtgagctgagattgcactacagcattccagcctgggggacaagagcgagacttcgtctcaaaaaaaaaaaaaaaaatcaaaagcaaactagttacttccagatacatggggatataggtattgagtaagtatagccattccaaatgggagaaattggccagaacaaaggggttacaggccccatgcaagtctgaaatctagcagggcttctttggagcttaaattttaaagctccaaaatgacctcctttgactccaggtctcacatccaggtcacgctgatgtaagaggcaggttcccatagtctcgggcagctctgcccctggggctttgcagggtacagcctccctcacagctgctttcataggctggctttgagggtctgcagcttttccaggtgcatggtgccaaggtgtcggtggatctaccattctggggtctggaggacagtggccctcttctcacagctccactaggcagtggcccagtagggactctgtgtggtggctccgactacacatttcccttccacactgccctagcaggggttctccatgagggccccgcccttgcagcacacttttccttggacatccaggcattaccatacatcttctgaaatctaggcagaggttccccaatcctcaattcttgacttctgtgtgcccacaggcttaccaccacatggtagctgccaaggcttggggtttgcaccctctgaagccacagcccaggctctgcattggccctttcggccacggctggagcggctgggacacagggcaccaagtccctaggctgcacacagcatgggcaccctgggcctggcccacgaaactactttttcctcttacacctcagggcctgtggtgggaggggctgccgcaaaggtctctgacatgccctggagacattttccctattgtcttggtgattaactttcagctcttcattacttacacaaatttctgcagccagcttgaattatcagaagatgggatttccttttctatcgcatagtcaggctgcaaattttccaaatttttatgctgtttcctttttaaaactgattgccattaacagcacccaagtcacgtcttgaatgctttgctgcttagaaatttcttccatcagataccctaaatcatctctcaagttcaaagttccacaaatctctagggcaggggcaaaatgccaccaatctctttgctaaaacataacagtcacctttgctccagttcccaacaagttccttatctccatctgagaccacctcagcctggaccttattgttcgtatcactaacagcatttttgtcaaagccatttaacaagtctctgggaggttccagacttccccacagtttcctgtcttcttctgagccctccaaactgttctgacctctgcctgttacccagttccaaagtcacttccacgkttttgggtatcttttcagcaatgtgccactctactggtaccaatttactgtattagtccgttttcacgctgctgataaagacatacctgagactgggaagaaaaagaggtttaattggacttagagttccacatggctgaggaggcctcagaatcatggcgggaggtgaaaggcacttcttacctggtggcagcaagagaaaatgagcaaaaagcaaaagcagaaactcctgataaacccatcagatctcgtgacatttattcactatcacaagaatagcacagaaaagaccggccactgtgattcaattacctccctctgggtccctcccacaacatgtgggaattctgggagatacaattcaaatgagatttgggtggggacacagccaaaccatatcaaagcgcaaaaccactattactgcttcaggcaggggccagtgccaggcatgctcaccttgtcctaatggtgtgattccctgcaagaaaggtgataaattctccccatgaagccacagagtgcagaagatggggacctgtagcagagctgattctcacaagggaggcctctggtttaccaggtgctgagggcccaagtacaacagcagactctggggacctcttggcagctccacccagaggagtggagttgagccttcacctcctcctgccccaaagcaggtgcatctgacatgcaggatgagctggcctctctcgggcctcagggacccctgaactcagcagagtcagagcacttgcatggtgcccccctgcccaggccttgtcaggaggcaaggtccctggctcctgctcctgtggcctgggacccacagccatccagccaggccctaggtgctgaggaccaagccactagttcttggttttctggccacccaggacccagggtggtaatgcctgggacctgcaccctaggcacagagctcctgggggtcctgagttcccgcccatgcactcctcacctttcagcagccgaccccatggcgacacgggcctggccacccggaagcactccaccctgaaggtcagcgggcacctgtcctccagccacatctctgccttccggttccctggcctccccctgtgcctgctgcggtttcatttgtatcttggccccttgctggacacactttctttagttgtgtccctgccatgagctagttctcatgccccttggccttttacagtttccatcttgcaaaacctcaacttgggattctcccccaagtgccccccaccatccttcaccagacgccatcatcaccctcctcccctcagggatgggggcagtgctcccctcttgaccagctccctgctgagcctctggtccctggcttcgcctccgcagcaccacattctgtccctggttttctctctccgtactgcttatccaacccatggcttccaggcggatggttcagcccactgcctctcctgagcgctgcctgcaggtgcccgcacagaggccccacagcgcctcagaaccaaaccctgtctttgccctcatatctgccgctcttcctctgttccctgttccagagaccggcaccgcccaagccacagacctcttctgacaagagccacatagtaaatatctttggctctgtgggccatacggtctctgtcgcatctaccccactctgccattggagtgttaaaacagccagagacaatatatcaacaaatgagcatggctgggtgccaggaaaactttatgaaaacagaggatgatttgagcgcaggagtccaagaccagcttgggcaacatggcaagaccctgtttctacaaaaaatgtaaaaattagctgggtgtggtgatgcatgcctgtactcccagctactccagaggttgaggtgggaggatcacttgagtccaggacgttgaggctactgtgagccatgtttgcaccactgcactccagcctgggcaacagagcaagaccctgtataaaaagaagaaagacagcagcagtcagattgggcccacaggccacggtttgctgaccctgatctaaaccatgcccagctctcaagccatgtttctgtttttacctccacagaaatccctgaaggaccctggtgcgctttgcgtgtgtctgtgcgtttgtgtacacggctgcctccaacaggagtgccctcagcgtcgcgtcttgggctcgaccaaggctccttcaggaaggcctccttgatgcctcctccccggccgaccttggcccctgcttctctcttgcgccgtcctctgctctctcctttctgggcacagaacttgccatgctgcgctgtgctgggcatggttacctgtgtccccgtgagaccctccgctctctgaggtggacgttcttgctggttttgtgtcgctggcgcctcgtgtagtgcctggtctgctgtcagtctttgatcaggtcaaagcagaattttgtgagcgatggctctgtgcagccgtggcgggtggctgaggtgaccccgcagggctcctgccgggagggctcacggtgcagcagcccacgcaggactgctgcgcttcttgtggcacgaggatgctgagcacagagccacgttgggatgcttcactgcgtttctggctcccctcagttgctctgaaggggccattgccaccctcagccttgtcagggccagaagctgcctgtcccagacccctggctgctcccgaggcagatctgtgaggtctctctggagggcagcatggttccctgctcacgtttcttgccaggatcggggcatttcttcccagaagtatctgaacttgcctctagcagggcctacctttgcctctgmccctctcctgcccctcacaggagaacctcatgctttccatcctgcccaagcacgtggctgacgagatgctgaaagacatgaagaaagacgagagccagaaggaccagcagcagttcaacaccatgtacatgtaccgtcacgagaacgtcaggtacgccggcccggggcgcgggctctgatggcagagcaggctgtggagggctgcatctttgtgggacccgctaggtgctgtgggcttcaagaggttttccagggactagaagcaaggcctcccacagcattcatcagcctggcggaggaagctgccagcagatgttgaagctacagtgtgctctaggctgcttggtccaaccccatcatagaacagatatcacctggagcggggaagggactcctgtgaggtcacccagctgttgagggccagcactggggctagagccctgacctgtgattctaggaagaaggatgagttcagcctgggcaggagtgggcagtgtggggtggtccccaggcaccacagggagggaggcctgcaggggaagtctgctaggacaagtgcaaggtcagagccctgactttacctggaagggtcagggtctcactgtctgggggtcgtgagggaggaccttctcctgccctgatcctggctgccctgtgggttggagagggagctggcagtggggtcgggtacacctggctgcctggagcgtcacccccacggttccttcctcatgcagcatcctctttgccgacatcgtgggctttacccagctgtcttytgcctgcagtgcccaggagcttgtgaagctgctcaacgagctctttgcccgctttgacaagctggcagctgtaagtccctggccccgcctggctctccagcggggcctgccctcatggcctctgcctggcccccatccccggccccatgattttctcccactgtccttcctctgctttcttggccactcctccctcactgaggaggggctggagcacaggccaggccctcccctttcagaaataccaccagctgcggattaagatcctgggcgactgctactactgcatctgcggcttgccygactaccgggaggaccacgccgtctgctccatcctsatggggctggccatggtggaggccatctcgtaagtgggatgcctctgggagggaggctcccagagcaagggccccggycctggacccagggagaagcaggtcttccgcgctggccatggcccctgggtgggggatctgctggaagcagagactgggacacagcactggttgatgggtggcgcaggctcccgctctagaagctgggatgtggcttaccttcctcacagcccaggggacctgcgaggctcccccagcctgtggggcacacttttccagccttagtccacgtattctctttttgccagaagttgcagttgtgaattttctcacgcctcctcacacttgctgggacccccacaggggctccccatctctcctcagtgttttctcaccgtgacccccgaaggcactgccctctccatctcgtgatgcagtgactgtaagaccctggcagaggggctcagggatgaggctggatcccaccccggcctctgtgctccagccttaggctgtgagggaggcaaactctcctgccctcactgtcccctactcttgcccctgctccaagtgggcttgcagctctcggatgggcagtccctctggttgacttccagcctctgcgggacccggggtgacatcaggcaccaacacggaaagggaagctcctgccgaggcccctcccccatgggatggagtccaggaagttgcctgctctttacccccttctccgagggggcggctttgcatttttaccatcttccaggttaaagcccgtctagtattgccctggaaagaaagcagtgtggcctttaccccaggggtggtagtccaggaactctaacattctctccctgccctgtcagacacgttcaggcagggggctgttcacggctattttcttcacctctgtgtctgcagcaccttgaacgtgcctggcacatacttgatgctcagtgaaatattaactgcacgaatgaataaaagagtaattggcagagagaaactgaggcccctygggaagtggggatagggaggaaagtcgcttggtgccctcgtcctgctggcctgtgatgcctgactctgggctggccctggcctgccttaccccccacccaacaccaagctgtggggaccttgccaggccccctcttgtggaggggaagaggcccacaatgaatttctcctgcaggagcaggggcagctggctgcctcgtgaaggccacaccctgaccctcctttctgtgtgtacctggcaggtatgtgcgggagaagaccaagactggggtggacatgcgtgtgggggtgcacacgggcaccgtgctggggggcgtcctgggccagaagcgctggcagtacgacgtgtggtcgactgatgtcactgtagccaacaagatggaggccggcggcatccctgggtgagtgccattccaagggggcaggtttgaggactggggaggggaccgtcccctccatcccccagggctgtgaccctgatgagggacagggggcctcagagaaggcccccctacaaccccggaacagcattcctcctgtctcgccctggtyctggccctggctaaggccgttctgacctgccttggggtgaggcctctttgggcctgatattggatgtggcttttccttcctggaccctgcagtagcctgtcctcctgtcccctttaccgacttagggggctgcctcccctttacccactaagggggctgccccagctctccttatgncagagcccaggtctccccaaagggagagtaatgagcagtcatcagctagcgggctcgcaggcagcgttttgcaggtcgcagtgcgattacacgtcttacttgagctcccttacaggataatggaggccctgcctttagcagggcgaggctgagggaggatcagcccagccttccccatctgggccagggagcttccttcagtggcatttaggattcttggcctcagtggtgactcctcagaaacaggttttattatctcttggcagcaggggttgcaactgagaaacrtgcaaggtgggggataattggatcttgtggctcacgcctgtaatcccagcactttgggaggccgaggtgggtggatcacctgaggtcaagagtttgagaccagcctgaccaacatgacgaaaccccatctctactaaaaatacagaattagtcgggtgtggtggtgtgcacctgtaattccagctactctggaggctgaggcaggagaattgcttgaacccgggaggcagaggttgcactgagccaagatcaagccactgcactccatcctgggcgacagaacaagactctgtctcaaaaaaaaaaaaaaaaaaattccttatcgcatttgatctgctttacagcggatcaaagattgaagaaagattgtactcctgtgtcgtggctccaacactgaggctgagatgggagtaagtgccatacggcccacacagctagttagcggcccacacagctagttagcggcccacacagctagttagtggcagaactgcctccacttggcctctgccccacatgcccgagagacacggggccgagcagcagccggtgcagccgtggtccgtggactgtcccctgggggtgtgagggccacctctggccgacgctcagggcctctctctctgcaatccaggcgcgtgcacatctcccagagcaccatggactgcctgaaaggggagtttgatgtggagccaggcgatgggggcagccgctgtgattacctagaagagaagggtattgaaacctacctcatcattgcctccaagccagaggtgaagaaaacagccacccagaatggcctcaatggctcggtgagttccccaccccaccccacccaccccacccaccccacccctggattagggggttggaaaggaggagattaaggaaagattgcagaagaggtggcaggacccagcagtggctggctgtgagaggtgagtggcaggctggcacccttcccaagggagagctggtttctgggggagatggtgagtgtaattcatggcaggttgcaatggaggtgactgaagcatatcccaagaccacatccaggagggggccgctggagatgtgtcggtggcgcccaggagagcagctgggttggggctcagggtctcctgcatggaggaagtgagtgaagccacaggagtgacgtggatgctcagggagaggctcagagaggagggtgggggtggggtgactggtcatgggggaggaggaccaaggccaggaaggtttcctgagtgggaaatgagggaggaatgagatagaagtaatagagcaggggtgtctaatctttcggcttccctgggccacattggaagaagaagaattgtctcgggccaaacaaaaaatactgtgggttgaacaagcttgcaatcgtgcatcctgtgggcctgccctctggtctttttgtgggatcccccgaatatctacagacctgaagcactcagcagcttccccaggtctgtccaccaacccccaaacacctcctgtcagtctgattagaaaccaccagcagctgttgcagaaatggatccctttaccatcccctgctgaatctggaggttgtcttattttttgtaatctcatgtcaaaaccctttcctccagttatgagagtccatctaacaagacttggaattaaggagcttggtgactgtcagggaagtcgtgtcatttgagactgctctatggctgaggctttgcctaattatggctaaagcaaagcccactctggtgaggctgccggagtgaaggctgatactccccgctgattctaacctcgatgtcagtctcatccagtgtcattttaaaggctgtctctgacaactcccaaatttgtatctccacccccagtgtcttccctgcactcaacatacagccacttgtacgtctccatttgtacatataataggtatcttaaatgccacctgcccaaagctcctgccctccttcccactccataacctgctctccctcggtcttcccatctcagttaatggcagttccatccttttattaacaactgctcagaccaaaaagtttgaaatcatccttgacgcctcactttgcaatccacaagcaagttctgtggcctcagattgctctctaatcccaccgcctcccacgcccttgtcacttccagacctgtccacgccactctcwtcccatgcccagatcatggctgagctctcctttcctctaggccctgcccaatggagcaccagcttcctcaaagtccagctcccctgccctcattgagaccaaggagcccaacgggagtgcccacagcagtgggtccacgtcggagaagcccgaggagcaggatgcccaggtatgtgcagggctcagggcagggggtcactgagggccagmtgcrggcaggcaccaggaagcaatacgttcctgcagcaggagtcctgtgctggggagacctggccaccacccaggacctgctcctgcttagcactgtaaccatggasaggtcacccctccagccccgcaaaaccccactgtctcctcatcagttacatgccggggtgagtaaggtcaaaagaggtgcttagctcggaggcctttgtagctctgatggcccggaatcctgtagatttgagatcagtgaggacatccatggaaaattatataggatctgagaccattttggaagtgagatatcagacctggactcacccctctggctaggttcaagccccacaagttccatgcaagatgggatatttccttagcccccaaaggcgaggaattagcatgctgtcccagagtgcagggtgcctcttggggagcacccagaactggtccctgaccgcagggcgtctggagcacgttcactgatggaggtcagtgctgcagagatgggatgtctgccctgctcgggctcaccgcgtgagggggacaggagagctggccctggtgccattagagcagatgccgtagaacaagagggtagatggggctcagggtaaattaggtttttcttgagtcccccaacattcagtaacttttccttgttgcagttttcttgatagaaagtgggggtccagactcagggcactcactagcaaggaggacacagatgcagctttagcagcctgatttttcgggccctgaycctcagccagggccacgctgctcccggatctgcttcaggaacaggttcccgctgctgccacagaccatccacgtgattttacagaaggggaagatgtggctggggaaacattatctggggtcaaactgtcaaccagtggcacacctgtgcctgtgcttaagaccagggagtctttttttttttttttgagatggagtcacgctgtcacccaggctggagtgcagtggcgcgatcttggctcactgcaacctctgcctcccgggtgcaagagattctcctgcctcagcctcccaagtagctrtgattacaggcgtgtaccaccatgcctggctaatttttgtatttttagtaaagatggagtttcactatgttggccagtctggtctcaaactcctgacctcaagtgatccacccacctcagcctcccagagtgctgggatgacaggcgtgagtcaccgtgcccggccccagggagtcgtgactgtggctcccagatgcactgttgaacccgttcagacagctctcagcccgtctcagtgactattcagactgatggctgtgtcatcacagccaggattcctgtttttggagttgatgctttttctttggaactgggaataaaagggtagtgggtgccccagctccacctacccgccccttgtcagccctctagtgatgaggacattcttctctctcccatcactttccccctcagatcttcctttccaaatgagccagatgtgagttcctttaacagttccctgaagccctagagttgggagccattcatgtccccaggctgccaatgtatatggcccccacatcaatacagcaggaagtgccaggactgcctcagcccagcagctgtctccgattacaggtctcctgctcaggagccaggggctgctccctacaatgctgtcattagcggaccctccctgcagagctctgggtggggggcccggggagccaggaaagactggagctttgggtgtagatccaggccacatggagccacgtgggagcatggggaagacttcccggaaagggattttagagctggagggattggtcctccgagtatgccctcttttgttcctttcctcctccacctctgtctttcccagctcttccccaccactctgtcccatctgccccactcacgctgcctccctggctcacaggccgacaacccctcattccccaacccacgccggaggctgcgcctgcaggacctggctgaccgagtggtggatgcctctgaagatgagcacgagctcaaccagctgctcaacgaggccctgcttgagcgagagtccgcccaagtgtaagcgccacccggaagcgtccaggcccaccactcctcccgggccctgacaagggattcaggaaactgagcatcccaaatacggcccccctgctaggccaaggcagatgtggcatttgggattcatggggcttgttcccactgcagagtaaagaagagaaacaccttcctcttgtccatgcggttcatggaccccgagatggaaacccgctactcggtggagaaggagaagcagagtggggctgccttcagctgctcctgcgtcgtcctgctctgcacggccctggtcgagatactcatcgacccctggtgagggaggggccggggagggccacgagtttcctcggctgcggtggtgccgggcggggggcgggggcaggtgtctcagcgggagcctgatattggggagcaagccagtctctgctccctgacccccactgggacggcccccacaggccccaggagtgctagacggcaccctgggcatccttccttttccctgccccgcgttttggagcagtcctagcgtcagaatggggatctggccaggatcaagagagctgagggacagaggcctccagaaggctggagaccttggctagatgggcscacactgattcttgggacaaagatggggacactgcgtcagtctcagtcaccaaggctgacctggcccctctcttggctcatcttggtaaagatagattttaggctgtgggcacagactgacgccctctctaacgcagcagtaggtyctccagggcaaggtgtggcctcctggagtccccagctggtgaagccctgtctgagggtgacgaccactctcttgttctccctttctcccctcggccaatcggggattccccgtcacagaggaggggtctggaaccctgctgggattacagtttgtcaggagccttgggctgggtcacactatctaaggttgcgggtgtgtgaccacgtgcaggccactgcaggctccggcagcatctgtttcctcatctgtgaaatgaggagaacaacccctgccctagcggacactcaggactgtggtgaggctcaaattcactcattccataagtattgattggttgtctgcttcatgcgtggggatcaagggctggggctatggcagcgatgcggcacacagaaacccctgctctcgtgaaacttgggttctggtaggggaagctacaggcaaaagcaattaaacaattaaaatatgcatccatgcgagagtaagtactgcagacacagggaaggcaaggaagggaggcgggtatgctgctggggagctttgttttgttttgtttgcattttgatgtgggatggtcagagcaggacttgctggcaggataatatttcagtaacgcctggaagcgggtgaggggcgagccttctcctatctgggggacacctgcttcggatagaggtgctgaggctggagtggcctggcccctggaggcacagtgaggaggcatcgcattgggaacgggccacaggaagagtagcaggagtccagcacagacgtggggcctcctacacgccactgcagggtgccagcttccactcttaacacaggaggccgccagaacaagggagcagaggagtcccctgttgtgacatatgcctggagaggctcactcctgctgagaacagcgcttagtgagcacagcgggagcagtgagaccaaatagcggcccagacaagccactgtggtggccaggccaggccgaggatagaggagmatcagtggttggattccgtcgatagatgctgaatgtattttggagacagagctgacaggatttgctggcagattggttgtggggcgtgagtgtggagttgaggatgtctcctgggcttctgatctgagcaactggcaggatgggggtgccgttaaccaagatggggacaaggtggaaagatgagagtggagaggcaaagatgaggagtttgctttgggacacgtgaagtttgcagtgcccacaagccaaggaggccagcatccatgatctggagtttggagggcgggtggggttggagacgtgaacctggcatcyccagcatgcaggctgtgctgcaacacgagacttgctgagctcaaggcagcgtgtccagatgcagagacagaaaaggactcaagaaaccaagcgagaaaagtgtctcaaggaggggtgagaggtgactgaaaatgggacatggatttagctaccaggaggcttctggggctcttggcaaggacaccttccagggaggggttaaacgggaatgggtgtgagcagagggtatagagaacaggtttccgggagttgtcaggttaaggtggatgtgttgagtgtgtccactgtgaagctgggggrggctgtcacaggcagactcttagcccccggcagcgagggagtgatgctgctccgtgctctgtcctttcagcacagcgacatggcaggggtgcattcctaagatccctgcccaagtttatcctgggctgtgcccaggccacctgtgagttgttccctctctgggaaatgtcccaggcagcagctgcagctggagagtggcccgctcccaggccggcactcagctggcggcccgtctcatcagggcctttgtcctgttctgcacggcaggcagcagcaattccctggcaccgcgtggagctgtacaggctcgtgctgtgctgagaggcctccccgtcccctgcccccggcccctgtccccttcccccttcccccggtccttgtctgctggcccctgcccccggtccctgtctgctggcccctgcccccggcccctgcccccagtccctgtccgctgccccctggcccctgcccctgtctgctgtcccctggcccctggccactgtccgctgtcccctggcccctgtccgctgtcccctgccccctggcccctgtccactgtcccctgccccctgtccgctgtcccctggcccctgcccccatccccgtcccttcctctcctagcccctcaccccatctcactgtcccctctggcctctcccaattgtcttctctctgtcacaggctaatgacaaactatgtgaccttcatggtgggggagattctgctcctcatcctgaccatctgctccctggctgccatctttccccgggtaagaggcacttttctactgagctcagaagcctctggaagtgagtggcactccctgtaaaactgggcagtgatggagttattctttctgtcaaatctgacaggcagacactcctctgttaggacggtccaggcacttgcccatccattcattcaccatcagcagagcactccctctggctgggccaccaggctgtggcaggctgtggtgggccacggctgggccgtggtgggccttgttgggccgtggcgctgcagcacgtatgagtayggcagagtctgggtaaacaagaacctgggtagagaggaagtggagggccggctggaaggtgggttggccccgatggtgaaggcccttagaagccagactaaagggattaaaactttctcctgtaaggcactgaggtaccaagcagagtttttttttttttttaatcagaatgacaaaggtaaagcagtgtttaggaacataaatctgacaggtggctcgccaggtcacttggagccaggataggcaggagtagctggccagagacgagcagccctgaaaactgttcctgccctggcctcacctcgtcaccaygtctgctgtggaaagggctgcgacctggaggctgtgctgttgaacaggcacatcgaggaggtccaacacagcgtcagaactcccacgccctcttctcagctctgccccttggtcagctgtcnggtgactcccaggcagagtccgttttgaggctcctgggactggaatacgggaccagcctgagttgctgtcagtcacgtcgcaggagaaaggactggcaaaggctcatggcccttgaaattctgttccttctaggcctttcctaagaagcttgtggccttctcaacttggattgaccggacccgctgggccaggaacacctgggccatgctcgccatcttcatcctggtgatggcaaatgtcgtggacatggtgagctcctgctgtccttgttgaagggacgcccctgttctcagtggagaagggcttctgtttgggtcacacaagcagtttctcagtccatccctccaccgtcatgtagctttggagtggctcttaggttcccaaacacatcatccccacctagtggaaggagtcttrtccctgtcatccagggagcctctgggatggacttgtttccttgaagctcctctcccagagtccgagagcacagttccatgtgcccaggcctgtgctaggtaccttatgtatgttgattcatttaatctgtgaaaaagtcctgagcagttgtaccagtatctgcagtttcatagggagaaactaactctcaaaaagggtaattggttgggcgcggtagctcacgcctgtaatcccagcactttgggaggccaaggtgggcggatcacgaggtcaggagttcgaaaccagcctggccaacatggtgaaaccccatctgtactaaaaatacaaaaattagccaggcatggtggtgcacacctgtaatcccagctacttgggaggctgaagcaggagaatcgcttgaacccaggaggcggaggttgcagtgagccgagattgagccgctgcactccagcctaggcaacagacagcaagactccgtctcaaaaaaaaaaaaaaaaggtaattcacttgctctaggtcacacagccaggaagtgacagagtccagaatggaggcagttctaagtcccagtcctgtgtattcttcctccctgagggggcagccaaatgctttcttggggaaaagggacaggagttgggagcccagatctattggtttagaaccactgggcacgtattgagcactacatgcctggagctgtcatcagtgttctcttgtcagttgtcacggcctcctctaattgtggtagtaccatatacactatcttccttttttttcaaatataatgttattgttgtactttaacaattggagcacacggtgccgggcgcrgtggctcacgcctgtaatcccagcactttgggaggccaaggcgggcggatcacgaggtcaggagatcgaaatcatcctggctaacacagttgaaaccccgtctctactaaaaatacaaaaaaattagccrggcgtggtggcrggcgcctgtagtcccagctactcaggaggctgaggcaggagaatggcgtgaacccgggaggtggagcttgcagtgagccgagattgtgcactgcactccagcctggcaacagagtgagactttgtctcaaaaaaaaaaaaaaaaaaaaaaaattggagcacacaaatacaaccaacatggagacttattctgccagtggtataagtgaaaaagctccagggctgcagctaatcagaagtccagtggggggccgggcacggtggctcacacttgtaattccagcactttgggaggctgaggcaggcagatcacttgaggtcaggagtttgagaccagcctggccaagatggtgaaaccccgtctctactaaaaatacaaaaattagccagccacaatggcacgagcctgtaattccagctacttgggcagctgaggcaggagaatcgcttgaacctgggaggtggaggttgcagtgagccaagaatgcaccactgcacgccagtctgggcgacagagcgagactccatctcaaaaaaaaaaaaagaaagaaaaaaaagaataagtctactgggaatgaggagttaggggctccagagcctaccttggccaggggttgctggtgcccactacccagggaagagaagccccaggccccctgcatgtcacaacatgcctggaacctggcacccaggtgtggaggtcaccactgcatggggtcctggacactgtacaggacacctggagatgctgtcactcatggaggggtaaaaagctagggaggtgtaacaactgctcatgctagaatgacatggcgggaatcgcgcaagcaagacaaggttgccctgtgggtgaaagttacaaaaagggggggttgattccggttctggatgcgctttctcccggccgcatctgcccagtagcagaaccagtaaagaatccagaaggcagtgaacatccccccaatggaaggatttgggcagagactagctgtcatcacggggaggctgtgagtggggctcatggtcccgtggcccctcctgaagcaacagtgtgatatggggaagaacatgttggatttgaagcctaaagacttggctcctacttttggcttttctgcttgctaattgtgtttgggcaaatctggcccgagttttctgtacaatagggacagtactaaaaatactcgagagagtttttgtgaatgtcaaatgaggcaayggcgaggctcttagctgcagttactaactttcatatgattagtccctggtaaatttccccatctttcccggtatttctgggggagccgcgggaggtggcagctgagcgtgcactaccatgcacagccctctgtgaccagcacctgctgttctcttgaacgtgtgtccctgcccgccgtcctggcctccagctcagctgtctccagtactacacgggacccagcaatgcaacggcagggatgganacggagggcagctgcctggagaaccccaagtattacaactatgtggccgtgctgtccctcatcgccaccatcatgctggtgcaggtcagccacatggtgaagctcacgctcatgctgctcgtcgcaggcgccgtggccaccatcaacctctatgcctggcgtcccgtctttgatgaatacgaccacaagcgttttcgggagcacgagtaagatgaagcgtgactggggatctgtattgtctccttcctcccgcccgcaaagtcctcagttcaagctcatgggcctgtgctgaggtggctttctgccactaggggtcctcaaaggcttgttcaagaaccagttcctggctgctcacagacgtatcactgtttggctaggacctgagaatagattcttcccattctccccgagtggaggacttgggataccccggtgcctggctgggcatcaggctcttgttcccagatggggcctgactgtgctgttatctgtccaacagcttacctatggtggccttagagcagatgcaaggattcaaccctgggctcaatggcactgacaggtaagggccacggcttcccctcctggcctgcactcacagcccttcttctagagacaggaatataacaggcccaagcccygggatctcaccctccygggaggcacgtgacctgatacgtgcaggttagagaagctggcatgggttcctccaggagggctgcagcagtgcagtgaggagggaaggaaataccaggtggatggcagctgcatgtaactggctggcaggacagacaggcagcaggaaaatgaggagggaggaagacgctttggatttggacctggcttctgagcctgcagcaggcagtaattctctgtgggtcacaggcaggtccgtttccatgagttgcaatttcatctcttgaggaggatactgaaccagaagttctctaaggtccctgccagtgccaaggttttaaaattttatgattccatgacttgaacagaccttcaaggaagtttagaaataaaaagatgacctaatagaagaggggtaaaacctgcatagcccttagcaaaagaagaactctaaatggccactaataaatggcactcaagtaatcaaggaaatgccagttacaccctagtgagataccatcacacacgtaccggtccagataactctgacaatatcaagtacaatagtaactcttacactcctggtgggagtatgagttagtacaaccgtgttagaaaatattttgatctatttagtaaggttgaaaataaacctgtgtcccagcaattccactcctacatacacacccacgcagacgtgtgtatatgtgtatatatatatacacacatcttagagaaattcatgcacatactcatgtcccaggatatatgtatgagaatgtccaargtggcactgttcgtaatagacataccccctcccccaaaacaaatgaaaacaacccaaatgacatcaacaggaaatggatacataactggtatattcatgcagtgaaataccatacggtaatggaaactaaccacagctccacataaaaatatgtatgaacaaggtaaaaagccatggtgagattgtaccccagtcccatggctatgaaatcccatcactgatgtctcttgcttctccaaattcctgcatggttgtagctacctctgtgatcagtcaggcaatgcagtgtttcttaaatacctggggagcagccctgatgtgaataccaggtgcagccaggaggggccaggggttgcctggctgttggagaggagcccagtgagttaagaaaantttactgcccgggggagcccgacttgatgtgaaagggcctaaggagccggggtgagctctagggctggggtggcaggaagcagcaccatctagttggagggaatcaggccccctccaggaggcagatgacagccctttcagttgcacacgctctgcccagcaggctgcccctggtgccttccaagtactctatgacggtgatggtgttcctcatgatgctcagcttctactacttctcccgccacgtgagtgccgcctgcacgatccccgctctgtgcccacagcccacagggcctcctgagaagcagcccngggacctaagagcccaagctcctaaggaatggggcttcccttcacccagccccacacgtgagcctggtcaggccaccgccttctctattcaggctccttcctcagtcacacaggaagacagttcctcacctcttccgtccgaccccctccaggatggtgaaggaagcatgggagtgaaggtgggaggggatagagtgaaggcacaaacatcttgaatcaaatcaatatcccctaggccaggggctcatggcccccgcactccccgtggcgctgagggacattaacacaactgaccacagagccagaagagaaagagaagggagctgatggactttctgttgggttaaaaggaaaagagaaggccggtgcagtggctcattttgggaggctgagggtggaggatcacttgagtccaggrgtctgagaccagcctgggcaatatggtgaaaccctgtctctactaaaaaatacaaaaattagccaggcatggtggcccgcacctgtaatcccagctacttgagaggctgaggcaggaggattgcttgaatctaggaggttgaggctgtagtaagctgagatcacaccactgcactccagcctgggtgacaaagtgagacaccccccccaccccgccacaaccaccgcactcaaccggacaaaaaaggaaaagagaaggaagagagggaagagaaagatcctctgtacttagggcccaatgttagttcaagtgccccctactggctttccagggaagtacagccttcccaagccacttcttacccaaatggcgcctgctagaaagggggactccaccctgagttgggagatccccactgctgccacctccacgagacagacctgcagctgaaattaggtcccaagaggccccctacacacggaaggcctcctggatctctgctgtaantacggaggctgggaaccgcaccactattgggtggccttttgatgaggtgcaatctttgcagggtcttacttcccttgccatttagccatcttccttccagcctttccaaggggagttcctccattcacgttcctgtttttcttctttttttgagactgagtctcactcttttgcccaggctggagtgcagtggtgcgatctcggctcactgcaacctctgcctcctgggttcaagttgattctcctgcctcagcctcccgagtagctgggattacagrtgcccgccaccatgccyggctaatttttgtatttttagtagagacagggtttcaccatgttggtcaggctggtctcgaactcctgacctcaggtgatccgcctgcctcggcctcccaaagtgctgggattacaggcatgaaccgccangcctggccattcctgtttttcatccttctatccagtggccagcttagagcacatgcctcgccttgtctgtgtctgnaggtagaaaaactggcacggacacttttcttgtggaagattgaggtccacgaccagaaggaacgtgtctatgagatgcgacgctggaacgaggccttggtcaccaacatgttgcctgagcacgtggcacgccatttcctggggtccaagaagagagatgaggtgaggggtgtggtctcagcccggaaccatgaggccatttgtctccatctgttctttctttcaggcagcccccgctgggcccaggccttctcagggacaggggactggggcctaggtagggctgaayctaaacagcaaacacaaataagcaaaagaggaatttctccggcctcttataaagtgcactgctgtaggcatcgtgatgtgggccgtacagctctgaggccatgtgtcagaagacaagactttggctagagcccacctttctgttgcctgtgaacttctccaaacagagtggttcccagctctacggtaccctcgtcttcacagctggggctgttagaggaactagagaagctgttttaaaatttattcaaagtagtggctgggcacagtggctcargcctgtaatcccggcactttgggaggccgaggcgggtggatcatctgaggtcaggagtttgagaccagcctgggcaacaaatagtgaaaccctgtctctactaaaaaatacaaaaattaactggacgcggtggtgcacacctgtcgtcccagctactcgggaaactgagacaggagactcacttgaacccaggaggtggaggttgcagtgagctgagattgtgccactcaactccagcctgggtgacacagcaagactccatctctcaaaaaaaaaaaaaaaaaagtagcgatgagctatttttaaattattcagagttggaataatctacagccgggcatggtgacatgtgtctgtggtcccagatacctggtgttcaaggccgcagtgtgcttcgatcatacctaattgtgcttgtttactgccactgcactccagcctgggaaacacagcaagacccactcttaaaaaaaaaaaaaaaaatgctggrataatctgactgatgtgtgagtccaaaaagctgagtgcacatgtcatgcatggaagatagatgcatttctccaacacatcatccagtcagtcggacatgctttgagcacgttgtccgcacctctttttaggagctgtatagccagacgtatgatgagattggagtcatgtttgcctccctgcccaactttgctgacttctacacagaggagagcatcaacaatggtggtattgagtgtctgcgtttcctcaatgaaatcatctcngattttgactctgtgagtgcccatcccaccctgcactctggccatgaagcyggcccattccacatcacatcctacaataggctgcagaggccagagaaactggcttcattttcccagataagccccttccgcaatacatggacttctgcagccacctggaactgctgggctggggaaggggaggtgaggtgggagcccgggaaatcacccacagggtcacaggataaggataaggactggccaagcaacatctcgagacctctctgtcctgggactgtctcctcaaattcagagccggtcagcattgactgggtgacctgtataccagggagaatgcttttacacacgcgcggagcccccctaggagactgccgattttatgtcagtgttgaggttgtggaaacaggcccagaaagttaggaagttctcccaggatcatgtggcagataagcggtagactaagtaacaactttgataggaaagtgtctcttgggtttagtggggtccttgtaaacaggtacatctgtcactgggttgggtcattcctctcccttgactgctgacaattctttcctgaatcctggcctcagctcctggacaatcccaagttccgggtgatcaccaagatcaaaaccattggcagcacgtatatggcggcttcaggagtcacccccgatgtcaacaccaatggctttgccagctccaacaaggtagctaaccccagtagccagagagatgaggctctgcccccaaggcaagagattggcagcccagacctagcatgggggaaataagaactgctgtgcaaagtggtcccagacacacaccaccagcaccacgtaaatataaataagaaatagggtttattgagaaagttcggcaagcagagaaacaraacagacacacaaccccctgctgttcacagctcaggcctaagatggttgtgttctgtggccaggccccctaaggctctgtgctttcataggaactggagagcaattgtcaacaagggaaactgaaagcatggccttcagaactctggctgacggcagcctgttcttttgttaagctaatttagacctttgttcagctaccaggagagaaaattaggtgtaggagccctggtcccaagctctggtcttaaaacaccatcatcctgctttacctctacaaccatcccacggccctattatatggatgaggttaaagaaacacgtccaaggcgggtcatccccctccagtgcttatcacctagttgagggatccaaacaaggacaacctgacaaaacctaaggaccaggaccaggcccagccaaggtgaaggggyccgcctcryggtcagactcacaggtccgtctcctctgctcaattgcccagtctttgcctagacctgctacgtgaactttgtcacagtggcaagtcagagctagcgtggctgcgactcctttgtgggaggaaaagtaaggccttgaacatctaggtgtagggaatccacccccagaacactgccagggaaggcagcagagcaggctgctgcagtgagcggcccctgacactttctccacggtcccctggcacaggaagacaagtccgagagagagcgctggcagcacctggctgacctggccgacttcgcgctggccatgaaggatacgctcaccaacatcaacaaccagtccttcaataacttcatgctgcgcataggtgagcacccccagctggcctgccccgcagcaggctcccttcccatgcaggggcctggcccaccaccaggagagacatgaggctcaggacaactgaggcaattcgggtggggaggttcacgcactcacagggcaaggagacctgaaagacctttagtccagacgactctagatgactaaaccaaaaacccagctgatgtgatgatccgactatactgtgcctactgttacaatagaagcttggcctgcctggctgagaagtgagtttgtgatccatttccagaggggttgctgtgcctgctgaggacatggcttcccagacaggcctgctctttgaaaggagttaagatcacctgctgcttctactgagggggtatcattcctgagtgaggtcccaggagacttgaaataccagctgtgttagaagctggccactaccatgccgagtaaatctgcatatggggggggggtggcggctgacacctaacaagcacacggataaacaggagatgtgatttccaccctccaatagcatacagccaagttgaatgaggacaatgatgtgttacattaggagctttgtggtacaggtctggagaggagatggcttctgaggcccataacaaggtgtggcctgtggctgtgctgaactttatgcctctaccctaggcatgaacaaaggcggggttctggctggggtcatcggagcccggaaaccacactacgacatctggggcaatacagtcaatgtagccagcaggatggagtccacgggggtcatgggcaacattcaggtatgtccagtggcacagctggcacgtgctcagactcggcatgagaacaaaaccggaacagtgctttcccacgtgcccctgcctcccaccctggccctgaacagtaagtccagaggcagagacgtggggcaagtggaaaagaatctctgcaatagctagcctcagcacaggaagaaacacttccacccatccacaaaatctgggctgaagttctagatgcatatggcctacctttgggtatgaaccttctaataccttgtgatctgtctcagtggcgtctggcagaaaagctccacgaaaggggcaaagggacagaagagcaggcagtggcagtttccaggtaacagtgctgccacccaggtgaccatggccatcctaggagagaagtctctggatgagaggaggcccccagccagtcactccagggttctccttcccacccgctgctcgccacgggtggaagggcttggccctgggaggtttggggagtgtcccgtactgcttgggacccatggatcagtgctcggctccaaccacccaaagcccccacccgccctcagtctaggctccccccgtaacgccacgttcttgctccccctccctctccaggtggtagaagaaacccaagtcatcctccgagagtacggcttccgctttgtgaggcgaggccccatctttgtgaaggggaagggggagctgctgaccttcttcttgaaggggcgggataagctagccaccttccccaatggcccctctgtcacactgccccaccaggtggtggacaactcctgaatggcctcgagcctgcaacagtccaaaccggaagggagaatttattttttgaaactgaaggaagtcccgaccttcctggattgaagtgcacactcatggactttaggtttagaaacctcctcagccttcatttgttcgtggatgtgtgagctctgagggtggccctgctattcctstgygtgcctgtagtgtccccagcataggggtcttaggcatagggctgaacagtccttccagagccctcgttccaatccctgccgtccttgcccctgaggggccctgaccactgtgagcaggagggtggcagagctgggacaaagctgcctttgccgctgggctttccgggactgtggagggagcacaggcggggaagctccacttcagacagsgcttggtggggcaggacatggctcccattttgaagggaggtctccatgtggtccgagtgaggtgagacggccctcgtcctggtgttcctgatcatcttgaaaggttcttctggaactcctgtccccttagtcatgagaacagaaagtgcaatatttcctttcacctggcaggggaggggggatttatttctgaaagaaaaatatataaacagatcttctacatttatatttttaatcttctgttaaatacactttccgatattgccttgccttttgagctcttgctacagtcgcctttgctactgctttaagagaatttacaggtattgataaagaacaagactgttttattaaaagctttattcaacttgaaagtgattgtggaaattctgttaatatcacttatctgaggagtgctggtactttgctgactcatgccactggtccccaccacaggcctggaaggcaagagcttgaaggtctcatcatagctcactgtaccccggaacgcctgctgcctggccctgtctcttttattcttaaactttcttctaaagggtactccaagctggctttaatcccctgcactgttcctggagctctcccacacggaggttacttcgtggccattgcagggttaagtctgaacgtggccttgggccagtcatgactcctatctgtgcctgggcaagggagggctacaggagaacctggtcagccagacacaggttttcatatctgtgagtgacccacacgccaaggaaccagaggtgccagcaggtcagaggcccatggttacggcaaatcaggacactaaccggagagcctgcaggagagggaagacccggggggcgcctgagtccccctgagtttatgggcagatttctaactaactgtgctttttcagaggggacttcctagtacattcacagctctactaaacttttaggaaacaaaatatgagacacactgaactctgattattttatcctactgctttctcacaccatatttataaagcagtggcctagaatacactgcgcctaaccaaacactgaagaacttccttttcaaaagtttcaaacaggaaaatgaggaaaaattacttaaagctttcataaaagctaaaaatactttccttttttaaaaaaaaaaatattgggtcttccttattatcttcattagtgaatgtgggttatttttccatttatttagatcagtgtttctcaacagaatcaagctattgcagtttgagtggagtgctacatttctgtgagagccctttctgaaaattttaggatttttggcatctctattcctggcattaaattagtagcagttactgtgacaacttaattgcctggtctttcccagaagttaatgccctcaataatttgatatttttccataagtacttcttgagtgatacacctttttcaaaaaatggcttttattgccccacaaatgattttcaactaaaatgtatgatcaactaatacctttaaaaaacatcttgagcattttaagaagggaccaggtgatcatgggaattgttcaaaaatgccagtgtctatactcaaacctgctcttccatccagatgaacaggtaggtgtctgttttcatcagaagggtgatgtacccttcatcagacagtactacccacctggtactgtcttcagtactggttacttacctctgatgtgctcccagtgcagtgaaaacaatctattaggagaccagactcatatccaacttttctccttttcttgtaaatgaggcaaacacttgatgcaagggcttcgtacagaacagagtttcatgagatgctcgttgctcctcccatgaagtggataatacttccactcctaaaaagaaagattccatcaatctcattcagtgcagctgggggaatcggagcctggatcactgatattcaatctcattcagtgcagctgggggaatcggagcctggatcactgatattcaatctcactcagtgcagctgggggaatcggaacctggatcactgatattctggacccactggacccatacagttttttttttttttttttggtctggactaaggctgccccttactggaccaatgcaatctagagactggggactggaatctaactgcgcagagaaatcaaagaccgatggtgtgaaatctggggcagcttcaaaatttctgcctcctaaaaacatttcacccaatttttcattattgcccatgtcacatttaactgaaacaggttcaccaaaaaatctctctctcagccagtctggaaggatttccatttagagactgctccgtagggaggagtaagtgtgtgctgacgtgtcatgtccatttgtcttcacagtgaaatgagtcttctggctccatccaccataactgacccatgactcagccttatcattaggtgtctttcctgaagcagggcccccagtgaaaacaaatcataggctgcgagaacactgctgaggtgggtgggcaaaggagaagggaaaatggggacaatcatgtttaccatttacaaagaggaaggaaaagactggtagaaacaagaatgttctatcttaccggtctgagtaatgtatagtatataaacagagaaagtgtctcaagaggtctacttcatggattctacctattttccctgtttcactcaaataaactgggatatgagaatttctgcactgaggcacccttcttaccttgacatgtcacggtgacgtcagtgggaagagttgctgtgaggtccttatacagcaatctagcacagaacgggaaggactgaccccctggatccagtttgtaagtaaatgacagcaagttacacagtgggtttctctgcaagggcccagtcaggagggctgcaaagtcactctaagaggggtgaggaacaaaacgaagtagaggatgactgcagttccaaaggtggtgtttactgacccttcaattacgtcaaccaaaaagaggcccatcgattacatttcagagaaataaatgagggacagaaaaaggtctgaaaaaaggactaatgaaaaagatgcctaagataactaagagtcactggcagcctggaaaggcctataggcctaaatggccaggggtacagcttcgcaagagactgtttctgcagaaacttcactgacgttacacggctaagatgcttcatgactgcatccacatttcaatttaagttaaatctacagctgagagcttcagagttactccaaatccatagagggggaaatgctaagcttgtaggaggcacttacagcctatttgcattaatttcctatctacttttttcacccaaccttagctcaactgcaacccaaaaaggtaggctagagtttaggggaagatggacagcattgttccatggcactgcagaaacctttcttctctaatgagatctatacccaaggttcagcaaggcactcggtatggtacatagtaggcacgccataaatccctgatggatcaaaagtatagcaactgcactctgtacaatcttaggataaaagcttgaagaccaccattcaggggtgcataatcctttaaccagtacccaggcttcaacgccatccagagtttcaaaagaaaagagggtgggatagtgcttttatataaataagaaacaagcatcggaaaggtaacggtcaaacttctaactcacagttaggaaacactgaaaatacaaaaaacatcccccttttaagttgatcttgggcccacggatgaggcatataacatcccagagagatacctgaagccggtctgcctggtacttcctcccagagtaagcattcaggtactcgcagagactgaacaggaagtgctggatgttggtctgtaaatattttgcagctatctcttccaggggaatgaagactgggactgaatggtgatgwatccggagtggtttctgtatgacaaggtccacaaaataggaatccaataggttcccctcaaaagcagtactgatgcagacacaaactcctcggctggtcagtttaccactgaggcctgaggcaaacaagaagacacctcaatagacagcaggccaaggtgatgtcttactcatctgtgcctccagtagcttccacagtgcctagaatatgtatactttgtacacaaatgtttgttcaatgagtatcataggctcattcttccccttggctccggctcactttgagactgagttgttaaaaccatggaagaatggtaaaaatgaaaaaacaacctaaatgtcaaactattgagaaatttttttttttttttttttgagatagggtttcactctgtcacccaggctggagtgcggtggcacgatctcagctcactgcaacctcaacttcctgggcttaaatgatcctcccatctcagcctcccaaacagctgggaccacaagcgcatgccacctcacctggctcatttttaaatttttagtagagatgaggtcttgctatgttgcccaggctggtctcgaactcctggactcaagtaatcctgcctcagcctcccaaagtgatgggattacaggcataagcaaggccaaaaatttaatttatagctattctttatttctgagtgtgaagtaatttgtcagagtccccagttcttcccacaactatcttgtggcatagatgggagaataaatccctatttacggtgaaacggagacttggaaagttcaaactatttcactagtggcagaaaacaagccagcagtaaagacagttctagtacaaggtctggcacatgacgaactgttaagatgagtggaataagccagccaccaactgagctgctgtacaaaggggccagtcaatcttgtaggtgaagataggcctacaaatagcacgtcagctgtgtgtgtgtctgtgtgtgtgtgtgtgtgagtgatgagggcagagggtgtaaaatactataaattatgaaataattccaggactgataacacatctagcaaactaactcactagaggcagacccagactaaattaggttaaaaaaacaaacaaaacctgtaaaatgatatgcctgcagaatggctttcacattttccaatttctcttccaatgcttcttgctcattgatctccactgtttggttgggttctacattggcaatacatgctttcacctgcaagatatgcagcaaatcaatcttggtacaaagaggtacactacaacatccccgccctcccccaactggatgaaagctaaatacaaggcacatgatataatacatcaagaaatgctacagtggccggtcagttattgctatgaattcactgcagaggaagaatctcatgggtcacaatgccaggaatcagaagtggagattgtacaggtctgaagaacaattcgatttttgatgggaatggacaggactgagagagcagcaagaaaaggttgtgtggaaagtctaggctaagcacagggtggacacaacaggtggctgtgaagaggcaaggctgggtaagttgtgcttggacagtgtggggtttcaagtgccagggctccaaggcttacgctgctagctatggcccagcagaaggtaccaggctgacccgccctctgagaacaactatgcaagctggataaaataccaaaaagaaacaagcaagcaaagagagcaaatggtttgaaggcattccagaaggatccaaatagccaggattggagagtactgacaaatgctctgagctggcttccctgcagcctctggcctcagagcatttccttattcatatgcaaggcacactgggccacatagaaaggcataaactagactccgcagcagtctcatccggaacaaacactggacattaatggtatcaaagcagactttctacgggccaagattccatagaaacaggaactcaacgttctgcttgcaatcttccctcccggcatttgctaattcctaagctgcacaggtgtgactggggactgagaaaccaaacggaaagaagctgctaaaggggaaaaagccaagcagagattttgctagaacaaaatgtggatttcagggcctgccagggaacaggagccttaatagacccatctccaacacactcccaaactttcaactgaaggtcctaaaaaaagctaagccctaggagtaagggaaaccggaaatagaccacctcaactgaataaaggtgatgtgcccatacacgatctacttgccagaaaaacactaaaatttcctctggaggaagataacatactcagaacccatatatttttccttctttctttcttttttccagacagagttttgctgttacccaggctggagtgcaatggcacaatctcggctcactgcaacctccgcctcccgggttcaagccattctcctccctcagcctcccgagtagctgggattacaggtgtgcgccaccacgcctcgctaatttttgtatttttagtagagacagggtttcaccatgttggccaggctggtcttgaactcctgacgttagatgatccacccgccttggcctcccaaagtgctgggattacaggcgtgagccacagcacctgacctccgtatattttttcatacacaatactcatcattgaattaaaaaaaaaaaaaaaaaaaaaactacaggcataccaggaaagagaaacagatgactgaaagccaagaggaaaaagaagacaacagaacagatgccaagggattc

SEQ ID NO: 10687 - DNA, 52299 bp, Homo sapiens
  misc_feature (1)...(52299): n = A,T,C or G, or insertion/deletion polymorphism (see Tables 1-2)
aggatctgaacattgagagtacacatggacacaaagaaggaaacaacagacactggggctacttgagggtggagggtaggaagagggagatcaaaaaactacctattgggtactacgcttattatctgggtgacaaaataatctgtgcaccaaacctgtgacatgcagtttacctatataataaacctgcacacgtacctctgaacctaaaataatttttttaaaaaaataaggtgaatttaaaaatatgtatattgatgggggtgaaacttagagaaaaattagagtcatgggactcatcccagcaaggtgggaatcttcaaatggttattaagaaatggaatgaataaaatggaaattgatggggttaaaacaaaggtcttaatacaacactgccaaaagttcggtggaccaaagggagcccctgctggtccctcaacattaaagggccaattttctgtatttgcccgattggagaaatcgtaaaagagaaagctgaccaacaattgcctgaggtaatgttgaggtggttaatgaagatatacaaagttccttggctcaattccctactgggaacacaaagtgtttttcaccagaggcttttttacaaaatgatcttgggtggagaagaaaagtttctggggctagaacacaaaaatgtaaagattgataggattatgaaagttaaaaagtttgtaaataaactttatataaagttgtgacacctttacttaaatgtttcatgaaaacggacattgtatctgaccagagcatgtttctcctacttagtactgcaaactagaaggcatttctagtaatggtaaatctgccatttaagcaatattaactggacatgctaaatgggagccagtaaattgctcaagccctcagagggtagagtagaagatggagtgctggtagggatgaaacctccacttgatagccctttgtggagtgtttactaggggtcatagcaaaggcctgtgagcacctcccaacaaccactactgggactgtggactacagaatttctacttgagaggcatttctgccttggaatgggacattaacagaagctatccctatgactggaggacataaaatgatcttgacacctaaaatacacatgctgtctggagtgatgtcagagaaacactctaacggggatagcagtgcccagaagagtacataataaaatgggaatggatcttgctacctgaggagtgcaaagaggatatactcatgagctgcgagcctctttctctcctaggactgatcctggaactggtgaggagttgctggataccatagtacctgacaaacagctctaacctaagagttgcttggcttgtggatggcagttccaaggtcatcaggcaacatcctgtttggaaggcattactctgattgaagaagagtcaagaaaacttttttgttttgagctctttataacttataatgattaagtgtatttttgtaagcaaaatttgtccttctctctatatgagttctcccaaatttgaaaactatttgtgttattttatggcaatatagttatgtacatatgttcaatatgaatgttttcttttgtaataggacacaattggagacacattattttaccaaggctttgactggaatggtctattttcagacatgatcaatctgcttggggatttgaagttgactgcagagagccaataaaaagcccatggaaagactggttccctaagaagtttcctgacccgtggtaagtaatgaatgtcactttctaacaggatcagaaatctcaagatattttgagacctcaagaagagagaaatttgtacaggtattataaatgcagtctaatggtgaatccttggctttgcttctggcgttgaggctttaaaacactggaataaaaaattctgatagttctagcaaagccaacttaaaaggagcctatatggctgatcactattcctgctacaatttattcaaataaccaggccaatataatgagacaaatttattttgcaaataaattggtcctagtataatttatccttggtagaaataagaaaactggagaaaaaaaaatcttagattctagccctgaccactgcttttgagtttttataatttgcctataatttggactaaatcctgaattatttcctggctacaagaagtctctaaaaaggaacttggttttaattttcttcatgatgcttttagttggctgcttactcgaataggctcctttcatttttgttctggcatacaaattctcttctgattgtaatccttgtgtggattgtatttctactattcaaattattgatgctatgtatcttttgttgttttacttccgagaaaactaaagtcatagtattctgaagactagagaaattcaacgaagcctgtcaatctcccttgtttgaaatcccaaggagtatgttggcaatgagaaaccaatatggcccagtgggatttcaaaggctctgggaccattgcaaaaaagaagggtgcgtgagactctacacatgaattagtggaatgtggaggacaaagcaacgccacctaggatgttaatccaccatgtggacttcccctgttctgggaaggcttctaagatttcccctctctctattgtttcttgtgtaaaagcatgtacttactgtaaatcctgcccttagatcaagacaactttgatgttattgtatttcaattgtcctacatgtcccttctgagtcaccctttccctgtggtatacaacccctgggtctgaggggtaatggcactgggatccaccatcttgtctcactgccgcctgagatgcagacagggcttctgtttttaagtctccattaaatgtttctttttgagaaacgttaatgtgtcagcctctttctttagcctctcagcttccttagactttggagcgtaggtctgtatagtcctgcttaccttgaaatagatgggttagggagaaggaacaccagggagacgttcgaattatttcacctaaaaatgtagagaagttttgtgaaacagtgcttaattaataaaaaggtatttcttgagagatggttctattcctactactggcaaaaatgtagatgaaagattgtttggcatgatgccaaatattaccctataaattacttcctaattgcaaagggaaaactataactttaccatagaaagaactgtctgtcaataatcaaatgatcaaatagcattgtcaacaaagagtcaaactttgtaaaatatttgaagagatttattccgagccaaatatgagtgatcatggcccacgacacagtccttgggagatcctgagaacatgtgctcagggtggttggggtgcaggttggttttatatattttagggaaatatgagacttcaatcaaatacatttaagaaatacattggttcagttcagaaagacaggacaacttgaagcaggggtggagctgggggggtaggcggggggaggttccaggttataggcagatttaaacattttctggctgacacttggttaagtttatctaaagacctggaaccaacagaaaggaaatgtctgggttaagattaaaggattgtggagaccaaagttcttattgtgcaaaggaagccttcaggtgagaacagaaaagcattctgttatctctctccttcagagagaagagattgtaaatgtttcttatcagacttaaggtctgtgttgatgttaacatcactgaggtataaagaggcatgtccaacccccacttcccatcatggcctgaagtagtctttcaggttaaatttaaattttagagtgccctagcctacgagaaagtccattcagatagttggggggaatttagaattttgtttttggtttacagcaagcttgtccaacctgctgcccacagaccacatgcaacccacaggccacatgcagctcaggacagctttgcatgcagcccaacataaatttgtaagctttcttaaaacgttatgaaattttcttgcgtttttgttttggtttgtagcttatcagttaacattagtgttagtgtattttatgtatagcccaagacaattctttttcttccagtgtggcccagggaagccaaaagattggacactgctggcttacaccatcaccaatagtgggacaaatctgatattaaatgcctcctaatgtaatacaatattaactacacagtatgacctttgaagtatccttatccaatgtttaatctgaactcctcaagcctctggtaacttgcaactgataggaaatacaaaatctagaggtacaaaataaataaaatcggacaatccagcattagggcattcttcatgacaactgcttggtatcttaaatttgtttaaaaagacagttattattgggaaaaatgaattagattaaaagctttagattaaaagaagccaaagaaagttaaagcccaacttcaatgggcaatcattcataggatcctggttcaaaaacaaactatttacaaaaggtattctggagacaactggacaactggagaaatgtaaatattctctggaccttaaataatagtagcgaataattgttaattttcattgatgtgataaaggttttataggaaatggttatataggaaaatgtccttgtaggagacatatagctaaagtattctgaactgaagtgtcttatctacaacctacagatctgagaaaaataaaaccaacaaccaaaacacacacacataggtacacatataaatatataaataaatatggaaaaatatttgaatctaggtgataatgatattgagaagaaattactcaggccgatagtacgagtatgggagtcctcagtgtaaaaagtgaagtagaggttcctcttcaaatggactttcctttccgtctaattaggaataaacagtaacttctcttaaaagcaaaatttattcaaagaactgtgctaacatattggaggccgaaacaatgaggttcgtgatcaactcagtatatcactggaggctatatgagtaagcagcaaactgtttctcataaatgcagaacgttggcgaactgacaaactgcgtatgccacccaggaggactgctgagggtagttacgatctaggcacaaatgtttcttatgattaggcataattgaagcctgtcagtaacaatatgaacctgtgatcaattaagcagctgaccaatcgttaccacctcctccctgctcctgttacccaaaaaataggaagggctgtggaagctctgtggctgcctttgctcacgagaagcagggagctctcttcttcttcccctggccctttccttaaaacagttccttttgtcttaagttatcatttctacgttcgtcccttcatttgatctcacaatgatggtctcaagcagtaacagtagtaactgctgtaacgatggtctcaagtagtaaccgtggcagttggccacactaacattctttgatatctgttggccgtaataaagaaatcaatgtactttgtgctcttagctgccacattttagcctagatatttgccctggcatgcttatactggtccaaggaagcattaggccatagcctgttttcttccttatctggaggtgtttttacctttctcagcattccacaagttgcttcctccttcctttgttctcctctgtctttgcctcttttggaaagttctaagttgctagccaatcaggacaagtacagaggtccccttccagccaatggaaaccggacacggtagtagggtgcacgtgtcaggttataaatgaccctgtctcctttatgcgtgtgtgctctcgtggcaagactactagcgagcggcaacctttctgcagaaagtaaactagccttgctaagagctcctttgtctcagtgttgatttttgcaacactgagcgcccgttcccaacatcagtaaggcttttctttttaatgaaaagcagccccaaatccttttctaagagcagcctgtgaagtcgagctgcaggcacagacaaacaagggggtagcttgcttgggtgaatggtggcaggaactaccgactagacatgtttaagatgagggctccatcttcgcttctctgccagccacgtgtacagtaagaaggggttacaataggcatatgggtgattttgtgcttttcgttcatcttttctgtgtttaaaatgttcagaataagaaattggaacaaaggagacatgaatagacaattcctaatcatctttaagagtccgctttgtgttttacttaccaccwccactttgaaggctttcttgcctataccaggacaaactcagctctttatcccttttccgaattttcctggtactttcactttgaataragcgcttaattaacattctgccttgtacctaggactaacacastataaattcccagaagacaaagtaggggaatacaataacaggatatagaattttaacagctaaattagatgaatttatgggtgacctttattgggcaaaagaaaatgttaagttagtataagatttagtataagctaccatctcaaaactcagggtctcactggaagagaaagtgactccaggtagaattcctcagggagacattcacttccatcattcgctgaaccaggagctttggacagcctcggattgcaccsgcatatccaaggacaccacatcagcggacaagtcataaacagccttgggaatacgcggaaaggtcaaatttacctaaacaattaaattctcttttaaattttaaggaaacacaagtatgctttcgctttaggtagggcatttgagagcaaaatgtactaatactttgaatccgccaagcagacacgatctgggtttgaccgttctctccgggtaaaggtgaaggctgaccacgggggccgctctccctccaggccccagccacgccctctaacccaggttcccgtcctgcaccgcgccgcaagtccccccaccgttcagcgcaaccgggccctcccagccccgccgccgtccccctcccccgcccyggctctctttccgcgctgcggtcagcctcggcgtcccacagagagggccagaggtggaaacgcagaaaaccaaaccaggactatcagagattgcccggagaggggatgcgacccctccccaggtcgcagcgacggcgcacgcaagggtcacggagcatgcgttggctacccggcgccggggaccgctgccaccccgcctagcgcagcgccccgtccttccgcagcccaaccgcctcttcccgccccgccccatcccgcccacgggctccagtgggcgggaccagaggagtcccgcgttcggggagtatgtcaaggccgtgacccgtgyattattgtccgagtggccggaacgggagccaacatggcagcggggttcgggcgatgctgcagggtgagagggagcccagcggtgcggtggggctggaacatgggtattgtggtgtcggagcagggggccstgggccaaaaataggtgcggccgggaggagtgggaagtcgggctgaggaaggagccagcctaggggcccccaacctgctttcacgcctcctaccaccggacggaacgtagcctagcgtttcattttccgtatcctcccgtcaggcgaccccgttatagccggcatcctctctttagaatatcgtttttctttctctggtaaaccctccaaatatttaccgcgggaatcccacctttttccaaagtgaccccgtctctgtgtcagaaccacgggaaaaagaaaaatggagcagctactccttgaaatacttaatgtttaataagcttttcgttgtaacgtttccacgttgcttacgggaaaaaaaaaagtaaaaaaaaaacctgcagaattttatgtgaacttgtgtgtatattctagtattggatcttaatagattctaaataagtttgtcactagatgaattttggtatcttaaatattcttgatatgttcacaccactgccatttagatgtcacttaaaattaagttaaagttatgtcttggaccaaaaaagctgcggttttagaataatcctaaagaattgctgcccatgttttgctggtgttatgcaagttaatgtgcagtgaaggcagaaattgggagatttcagctatttttaactcctacaccagaaaagcagatttctcaacctccaaggaaggatctaaaaaaaacctgatatagaaaacttacaccctttttctcttctttaacccataaaactgacactcttatattcccaagaaatgcacaaaagtgttcaattctagtggtgctgtttcgatatttggaatttcattgttctagacagagagcccgaagtaataaaaccaatagttatatagcattaggctttcaaaacattatcgtactttaatcgtccgaaaatacgcagtgagattagtcccattttttggttttgaacggaagctataagcagtttgtaaacctgtctacggccacaaatatggttgtggaacctagattcacattcagcaattataactccagatcccgtgctgtttctgttttctatttgcaaaccacctctctaattaactggctaactttgttatgtaattaacaggttgatgggcattgtattctggtaatagcaacctttgcactttgttccatgtaacatattttcctgaacagtcacatgtgaagtgactttttccctatttaaattccctcggttggccaggtgcggcggctcacggttgtgatcctagcaccttgggaggcctcggcgggttgatcacttaaggccaggagttcgagaccagcctggccaaagcagggaaaccctgtctttactaaaaataggaaaaattagctgggcatggtagcatatgcctgtaatcccaggaggctgagtctgcagtgagcggagatctctccaccgcactctagcctgggtgacagagggagactctgtcaaaaaaaaaaaaaaaaagtctctcagtagaccatttaacctggtttgagttctgacttttgtgcatggtatttaaaaacgcatttataatagagtcaggttttttgttctgatttttgtggaatgttttcctttgttatggaacctagtgaccaattaggatactaacagaaagatcagtatagcaaggtggttaatagcatgcgctcttgatagtaaatgttagaatcctggttgcactaatagtagagtgactttgcctaatttagttgactttctgagccttcgtttcttcacatgcgaaagtggaataaaagtaatggcttaatcctagacttgacctgggattcagtgaattaacctgtgtaacgcgactgtaaatcagagtagatttggtctgtgactgctggacaataagcaccagagaaactgtttcacttttttttttttttttttttttkagacggagtcttgctctgtcacccaggctggaatgcaatggtgcagtctaggctcactgcaacctccgccttccgggttcaagcgattctcctgcctcagcgtcccgagtagctgggactacaggtgcgtgccaccacacctggctaatttttgtatttttagtagaaatggggtttcaccatgttggtcaggctggtctcaaacccctgacctcgtgatccgcccacctcagcctcccaaagtgctgggattacacgcatgagccaccccacctggcactgtttcactttcaaaataaaattaatgaagatgcaaagaaaatgcgagttttcatactctgtatgtttttattactgtagtatgaggtatgttatttggaaagcactgtttcaattacaaatatttgacactcttaattatattgtcaccttacatgtaggaattcgtcttttataagttgaaattgtcatctacaaagacagtttctttttacggattttgaaaaacataagaatttaaataaagaaactttagtatattcttcagctgctcttttctcttagtatctaagcttgttaaaattgctggatagttcaattaaaatcttttacagtgaaaattgtgtaattttgactgtcctgaaacctttactcaagaacaccattgtggttcccagtttggcagctttaataaatgcaaatttttacttttgtatccattaanctgtcatgaatataaaaatgggttgcaaaacaataatatatgtatatttgattgtttctttatatgttcctttgaagaaatatgactatatttcagatcctaagacaagtagtgtattagtagtttagaagagggatggcaaacgtgtttgtaaaggaacggatagtacatgtttttggctttgtgaaccagatggtctctgtggtaactacttagatctgctgtgaaagcggcaatagacagcatgatgtggctgcnctggtttggtgactccttgctcagaacattgtaagaatccctgtagacagcagaaaatacagaacatggttttatgctaatttgttttgttagagtggggtatcctaaaaaatgagatcctctgaggggaaggtttccagaggcatgcatgggaggctcacagtgacagggtatcaaagttgatggactaggcaactcttgaacacagtatgttcacttccagcctatcgttctccccaccccaactctccaaccattaatgtcctaggagcttgtaagatacccagaatagtggtcctacatctactactacccttgactgttgtttgtcctaaaccctccacttcagtagtataaataccactgactttattttcattactttttaaaaacatctcctctgtaataggaatttatataactgataattggcttatttaaattatgattgaaggcatttaaatagtgatgactttaaaaactatgagtatggtcaaaccagttgctgtactcacttatgattatcagtagtctcttatctgattaatgtttaacttatsaaatttattttaataaaagtgttctttacaggtcctgagaagtatttctcgttttcattggagatcacagcatacaaaagccaatcgacaacgtgaaccaggattaggatttagttttggtatatgttcggttctatcttttgactttaaacttatacatatgaagctttatatgtttgtttggaatatgtttgtaaataaacttaataatgtctttcaatgagtagaaccagtccactgtccacagatantttacaataactcacactccattcttcctgatctcattttcttcctcagtatactacactgtacattagatctgttttagcagcatacatacacttaaattccttcctttttttctgagtgtttagcccaaaataaatgagatttactgatatatatgaatagtcttcaacttacatatctgaatgccacaaatacattttaaaaacacttgttagattacaattctaggtgcctggtaataagctaaagcttgtttttgctataatatatccaaattgcaattttggtactattagatgaagttctcactcctgggaccagggagccatgattttttttcctctgccctctataaaatgaaaactacacacaaaaaatttgaaataatatctatctttggcattcttggccttctaaagtgcttcttcaaaatttttattttttctctagttaaaaaccatttactcaatttatttggtctcagaaaatagttaaaggcagctgcrataactcacagctaggtacaaatgacaatctcaaagctctccagagttattttttttattatttgttgtgttttttaaagatttttcccttttctttataaaggttttttttttttcttaccagaatttaatgaaatttttcttttctttttctttctttcttttttcttttttttttttttttttaagatgaggtttcattgtctcattatgttgcccaggccgatcttgaactcctaggctcaagcagtcctcttatttcagcctcccaaagtgctgggattataggcatgagctactgcacccagaccaaatgaaaagtttctgtgttttttttttttttttctgtgacttctagccaaagactggatgaaaattttctcttttcttttttttgagacagagtctcactctgtcacccaggctggtgtgcaagtggctcactgcaacctctacctcccaggatcaagcgattctcctgccccagcctcctgagtagctgggactacaggtgtgggtcatcatgcctggctaatttctatatttttagtagggatggggttttgccacgttggccaggctggtctcgaacagctgaagacaagtgatccacccacctctgcctcccaaagtgctgggattacaggcatgaaccactgtgcccaacctaaatgaaaattttttttcttttctctttctgtagccaaagactaaatgaaagttttcaagcastgtgaggatagccatttgggatggtggattttttttttttttttttttttttttgagactgagtcttgctctgttgctcaggctggattgcagtagctccatctgggctcattgcaacctctgcctcctgggttcaagcgattctcctgcctcagccacccaagtagctgagattacaggtgtgggccaccatacctggctaatttttatattattagtagatatgaggtttcgccatgttggcaacgctggtctcgaactcctggcctcaagtgatccacccgtcttgtcctcccaaagtgggattatgggcattagccagcatgcccagccagggtagtggatcatactgagataattagcattaatttggtatgattgcttgtcactttaaatttctctctcagtagtaagagacttgcaggagaaatctatggtggttcactgagtgacagaggatgagttagatataattgtttgggagggagattgtgaagttcaatacgggtctattccttgaaccagttgcatctggttctttatctgtaaagtggaaataatatctataacacagaatttctatgaagattaaattatatgctgtatttaaagcccctagcacttagtgactggatcaaagtagtttctcaataaataatacataatacatacttgtcatttttccttttttttttttttaagagacagggtttcactctgtcacccaagctggatgcaaccttgacctctggggctccatggattctctsgcctcagcttcctgagcagttaggacaataggtccatgtcaaccacacctagctgattttttaaatttttaaatgttttgttgagacaggatcttgctatattgctcaggctggccccaaactcctggcctcaaatggttcacctgcctcagcctcccaaaattctagaattataggcatgagctaccgtgcccagactttctctaccctctatctacctgcaagattgctatcaactggcaccaatcttagaagtaaagctgtgatagagagaacactggactgaaaytcttaagtatacttctgctaattcattgtgagactgatactagaatttccttactctgcattagtttatcaataaaaagagagatttggctgggcgcagtggctcgggcctgtaatcccagcactttgggaggccgaggtgggcggatcacgaggtcagaagatcgagatcctggtgaaaccccgtctctactaaaaatacaaaaaaaaaaattagccgggcgcggtggcaggcacctgtagtcccagctgctcaggaggctgagacaggagaatggcgtgaacccgggaggcggagcttgcagtgagcctagattgcgccactgcactccagtctgggcgacagagcgagactccgtctcaaaaaaaaaaaaaaaaaaaaaaaaaagagatttgatcttatgctcttcaattcagcaccagaattcagcttttakgtattgtttctcacatccccatacaaatgattactgtagtcttaaacattcctctgtgcatttgctctcatttttcttgcttgaaataccctattatctcttaaattttacctaatctttgacgttagatgcaaccacattaaaacacaaggataccatggatttgaaaagatgcagttagcaattgactcctctcctcaatcaagccaccatactaatttcattaattttaaaacaatcccttattttatgtaaacaaattgttggacaccatttattagcattgcagcaggattttatgttattatcttttgaaaaacctttctaccacttttaccagttgctttgtgctaatttataagcttgtctgagtttaaaggagctgtaagcctaggcatggtgtctcatgcttgtaatcccagcactttaggagaccacggcaggaggattgcttgaggccacgagttcaagaccagcctggcatcatagtgagaccctgtctctgtgaaaacaaaaaaaatgaaatagatagggtgaggtggctcccagcactttgggaggccaagatgggagaatcatttgagcccaggagttctagacccatttgggcaacatggcaaaaccctgtatctacaaaaattacaaaaattagccagatatggtggcatgtgcctgtgatcccagctagttgagaagctgtggtgggaagatcatttaaggccaggaggtcgaggctacagtgagtcgtaattgcaccactgcactccagcytgagtgacaaaatgagactgtctcaaaaaaaaaaagcaaaattatgatattgatattcttatatgacactttgaaataagttttattgctttatgtcactgagtgtgtttcatctatttcgttagattgattcttgtcgtcagggagatgtcttgtatattagtttcacttcagtgttagcaaacatttgataaattggcttaggaactaataataagttaaacgttttttatatcaccaattggaaaagaaaaactcacttgagctctacaggttaatatctattactcatttgtaaaagttaaaaatcttacctatttcctttagcatttgtattgacataggtttatttatattgtgtagtgaactcttgattagtcaaaaaatgcactgtagtctgagtttctgataatcaaggatttaagtccccacaataaatacacatttctacatactgacttcataggacatttttccttgttatccagttttaacttttctaaataattttcccttagagttcaccgaacagcagaaagaatttcaagctactgctcgtaaatttgccagagaggaaatcatcccagtggctgcagaatatgataaaactggtgaagtaggtatanacattttaaagagggaaaaatcttttacattttttacaagattatgtaatcaaactatctggatttcaaaatatattttaactcagttctttttcttctagtatccagtccccctaattagaagagcctgggaacttggtttaatgaacacacacattccagagaactgtggtaagctttctttatatttttaatactggaatgcatatgagtamgaaaaattgtggaactctactcagtcatttttttcaaatatttcttgccattaaatgactttctacctttgtcttcctgctcagactacagtgtttgcccacttttggaagcttgcactctatacctagatgcytttttccttcttctaactggttccaaccttaacttgcacctaaaccttggtaacttccgtttctagagttggtcaatttgttgtgttttattcctatcttctatattacattttattgagtcttttttgtgaaccatgattcttttcctcagacccagttttagagttgaattgagttttaacaaaatcaagttagaacaggaatacaggttcaaattacaaatagtaaaataattttttgaaaattttagagctttaagaaagtataatttcttattgtgccagccagaacacatgtagatattatattgcaaatttccttttaaaacaaattttggtcatattgaaagcaattaaaatagtttacctttatttctattgtgatgtactacatattacaatgtgttgaaacattttgatactgtaggaggtcttggacttggaacttttgatgcttgtttaattagtgaagaattggcttatggatgtacaggggttcagactgctattgaaggaaattctttgggggtaagtgacttagaaaattaactacctaactsagctcttgttaatgagatagttactcctgaagaagttgratttttagaagaaaaaaaaaggaaagtcagttactactaggtaaggttagtgggtacacacagttttctttaaagaggaacacaagattcagcagtgaagcctggagttctgatttcgaggcttgataactctggccttgtctctagtactcggagttctgactgtcctttggaggaaactgtatactttggctgcagcttcagtggcaattcttaggtaaagccaagggctaaatccagaattcaggagcaggattgggatggtttgctgccactatggcagtactgaaatttagcaagcaattcttttttttctcactctgtcgcccaggctggagtgtagtagcgcgatcttggctcactgcaacctgcacctcctgggttcaagcaattctcctgcctcagcctcctgagtagctgggattacaagtgcgcaccaccacgcccagctaatttttgtatttttttttttttttttttttgagacggagtctcactctgttgcccaggctggagtgcagtggcgcgatctcagctcactgcaagctccgcctcccaggttcacgccattctcctgtctcagcctcccaagtaactgggactacaggcgcccgccaccatgcccggctaattttttttttttttttttgtatttttagtagagacggggtgtcaccctgttggccaggatggtctctatctcttgacctcgtaatccgcccacctcggcctcccaaagtgctgggattacaggcgtgagccactgcgcccggcctaacaagcaattcttaggcctgatcatacatactgtgtcacatattctaaacataattttttattagtgcatttcactatagtagattttcacagattataatgccacaggtcctacatataacctaattttatgaaaatacttagattagcagatttatttcctcattctaacttagaggcaaggtataggccagttctttggacttacctgttaggtgaaaaatagttattttttcattttgaattatagcatctctgaatttacatatccaataaaaatgacttgattttttaatgtcaattttcttcggtagcaaatgcctattattattgctggaaatgatcaacaaaagaagaagtatttggggagaatgactgaggagccattgatgtgtgtgagtatgtgtaactgccgctttatttcacacttaagaagggaacaaaggtgctatttctccttttcagtctatatgtatatattgggatatttagcattgaaacaaaacttagcaacatattattacaatgatgtgtcaaggatgccaagaaagtatcataataggccgagggcaatggctcgcacctgtaatcccagcactttgggaggcggaggcgggcagattacttgaggttaggagttcacagcctggctaacgtggtgaaaccccatctctactgaaaatacaaaaattaaccaggcgtgatggcgcctgcctataatcccagctgctcaggaggctgaggcataagaatcgcttgaacccgaaaagtggaagatgcagtgagcagagatcacaccactgcactgctacctgggcgacagagtgagtgagaccctgtctcaaaaaaaaaaaaaaaaaaaaaggtgtcatcataattttgttgcttatttccaggagaagagagatctacttgtgatgtttttgggatgtcaaaaagtgtcataataatcctcttacttcaggagagagagctctatttagtggagcattctacactttaagaactgagtcattgtgtcaggaagttcagattgaatgtagggcaatgtgtgtttgaactagtagtgttttgaattagtaaaaaattaatgttggctggtcgtggtggctcacgcctgtaatcccagcactttgagagtctgaggcaggtggatcacctgaggttaggagttcgagaccagcctagccaaaatggagaaaccccatctctactaaaaatacaaaaattagctggatgtggtggcgcttgccagctacttgggaggctgaggcatgagaatctcttgaacctgggaggcagaggttgctgagtaaagatggcggcactgcactccagcctgggcaacagagtgagactctgtctcaaaaaaaaaaaaaaagcaattaatgtgggctgggcatagtggctcacacctgtaatgtcagcactttgagaggctaaggcaggagaactgcttgagyccgggagttcaagaccagcctgggtaacacagtgagaccctgtctctaaataaataaataaatgaataaataaataaaaattaatgtgaacctgtaactgaagaaatagcaacttatttgttgaatgactgaatgacttgggaagaatagttgtagagtttatttaaacctctgaaagcaactcaacaaatttttaaattagatttttttaacaagataaatacacacacagacatacacacacacacacacacacacacacacacacacacacgctctattctgaaactgttgtttacctaaggatttttacttcttgtttactcaaacatatttcaatctaaggtgtggttgttatactgaaatacagtagatgtattagttttgagctaatgatgagaattcatcttaaagaacagaaaataatatttgaaaataaatgttttttatttcagatacctaaaatttcaagcaaactgtttaataaaggaatttgtacatatttgctaggaaatttgcaattttttttaacaattgagaggttagctaaacattctcactattgtctataagaactgtgtgaaacgtctagattgttctcctgtagcatatacagtcagctctccatatccatgagggaatagtttaggacmkgttgccctccatatcaaaatttttggttgccaagtctgttatacaaaatgtacagttagccctttgtatctgtgggttttgctccacagttggttaaattccaaaattcgtggatgccaaaggcaaacttttaaaaaattaaaattttataacttttctaattataaaatactgagtatagaaaatttagaaatgttttaagtagaayaaaaatatctgtaatccctcagatatggagttaattagtattacttccttattgtagtgcctaccacatttttaaatatgtaattgtgtttttaacagttagcccccattatatacatgtagttttatgtacatctttatttaacaacatgaacattttcttatgccttccttctttttacatgctgtaacartactgcataatttgctatctaatggatatgctataaattgtttcacttttctgtactgttgaatgtttaaactccttgggtttttactttggaaaataatgttatggtaaaaaataatacagaaaaaaaataaataaaaatgatcaaataagaagccaagaacaggccaggcatggtggctcatgcctgtaatcttaacactttgggaagccaaggcaggaggatcgcttgaggccaggagttcaagaccagcctggacaacgttgagagactgccaccacacacacacacaaattatatatatatatatatatatatatatatatatatatatatatatatatatatatatgagaaaccaaaaagaagaaaagaagacaaaaacaactctgaggaaccagtagtgacaagccattttgtatagaaaaaaacaggctcatttacttcacaggctctaaaaacttcactgtattatgaaacagacagatgtctaatagcatatttcagggaaaaaaataccttaaaggtggttaaaacaaaattttggtacttaaaaggggcatcttttatggacaactccttaatttgtcatgatgctgaatacatcaaatctccaggtagcagagtaatctagttcagttaacttgagtgacacctgaatcccctctacagaatccctgtcaaaagaccatctggctgacatgtttttatacctcaggtgcctgggaatcaacaccttctgaaacagcatcatttgcgagcatctgttatcattagaaaaatattttggattacatratgcttaagcacagaacctgtcatttttttttttataattttaccagttcatactgtaataggtgttcaataaatgttagagtgatttcactgtacttttctttggctatattgcccttcagatgtttgagtatagttatatttatttatttatttattttttgagayggagtctcgctctgttgcccaggtcggagtgcagtggtgtgatcttggcccactgcaacctctgcctcccaggttcaagcgattctcctgcctyagcctcccaagcagctgggactacaggtgcgtgccaccacgcctgsctaattttttgtatgtttrgtagagacaagatttcactgtgttagccaggatggtctctatctcctgacctcatgatctgcccaccttggcctcccaakgtgctggaattacaggtgtgagccaccatgcccagccaagtattgttattattttttttttctgaaatggagtctcgctctgttgcctaggctggagtgcagtggcaccatctcggctcactgcaacctccacctcccaggttcaagcaattcttcctcagcctcccaagtagctgggattacaggcgcccgccaccaagcctggctaagtttttgtatttttagtagagacagggtttcaccatgttggccaggctggtctcgaactcctaacctcaggtgacccacctgcctcggcctcccaaagtgctgggattacaaacctgaagcctcagccaccacgcccggccctaagtaatcatttctagtgcccctatatatgcttactactttgaattaaaatgtatatagtttctttcttttttgttgtatatttttaaaaaataaattgacatgggttctcggcatgttgaccaggctggtcttgaactcctggtctcaagcgatcctcccatctcagcctcacaaaatgctaggattacaggtggggggccaccatgctcggcccagtttctttcttctttggactgtaagtaccttaagggcaagtaacttgtttctttagtatccacagtaccggccactcttgaattaacttgcactaacacttgccttctaccacccccttttatccattactgcttgtgtcttgtcactcctctgtttaagagctctaagaggctcccctgtttctaccagataaaattttaaatttgtaatgtgatataaaagattctcgtcgaccatttccttcctttctttccagactcatgtcttaccattcccttacatgcacagaatttacatactgtggaactctggtactttcagcattagaaacactgggtaactctgtttcttatcttagtgtcatagcatatgccattacttgtacctggaatgcatattcttcctctttttccctcctcgcaaagaagccattttcctttttgagacttaatttaaacatcctctgccctgggaaactagtttctcaagccccttgtctgactttcacacatagagttgcagtatagttatttatcttcactgttacattgtgaaaatctctaggactgaatgtcttttacctctggtttccccatatcctaatttacatcgtggtrcatagtagatattcaatacatgtttgcatgaatgaatacatgtgaaattgaatttaaygaacttgtttaaagctatctaacattttcactttttattaaatatatgatttgttgatatacctatgcctaatttgaattatatattaagtgtttttaggccaggcactgtggctcatacctgtagtcccagcactttgggaggctgaggcagaggattgcctgagcccaggaggttgagaccagcctaggcaacacagtgagatgccatgtctacaaaaaatttaaaattagctgggcatggtgatgtgtgcttgcagtctcagctattatacacgggaggctgaggcgggaggatttcctgagtccaggaagccaagactgcattgagcctctgcattccagcctgggcaagagagtgagaccctgtctcttacaaacaaaacagaaaagtttttacatttgagtggtttctttgattttgtaagaacattttaattttagatatttaaaaatatttaaaatacagcttaaaaaataaaacaatcctgtttccaaacagtcaaaatttaatcactaacatttaatttcatttctcttgtttttatatattcaaggcttattgtgtaacagaacctggagcaggctctgatgtagctggtataaagaccaaagcagaaaagaaaggagatgagtatattattaatggtcagaagatgtggataaccaacggaggaaaagctaattggtatgttgttcaaaacatctttgtatattttttcttaattgttttatcttcaaatctctctttctttctgtatatttttaaaccactacagttaaggtatgtttgtggaactggaaggcctaaaggagattataaacagttcagtgattttcaaaaactaattttaagcccctgcactgttttttcaaattaactctcagaagtttaatgtgtaaaataaaatacaaatgcgtgctctgtttgaatctgattaggaaggctagcactctgtctacttggcttattatctccactcctcatctcctataccagccgctccttggaatccctaaaaccctaaggaaaaaggagaacctttggtatagtgcctgtctccagatgtcagaaataaacagagtcagtcttaaaacaggttatctattagagaagacagaatttgactttaataaaatctgaaattttctaatatatggtcaaaaaatatgaagttcaacaaaggatcaaaaataatttgtataaatataaaatactaaaaaaaaacactcgattatttgttgataaaagatgaggaaagttcaataactgttaagttcaataagaatcaatagtatgagcctttaaaaagccaatgtaattttaagccaaagtaatagaagtacagcatcaaatagagaaaaaatggtgacagttctggkcaacacattttaaaacatgtattgaaaaacttgactaaatctagaagcatgtaagtatcttgcattaggaggagcctacaaaacatgttctgaaaagcaaagccttggttattttggaagaatcttgaagtttttcaaatattattacacagaaagatgatcaggcttatatgtttacttcaggatgccagcttagaattaatgagtgaaagttagaaaaatgtagaatttagcttaacataaggacaggctttctatcagcagtgctgttaagttgtcatgggaaatactgtatttacccatcactacaagtatatagagagtttctagaataactttttattgattggaataatgtactaaatgacctgtctctctttgtaaaaaattcagattcaatatatttgtgtgccatatactacagttttctagcaaataaaacatcattttttttcagagtgagcctactaaaaagttacttagattaaacatatcagtcaattccttatgagcatcctaaatatattcagtattatggagtgctatatctttacctttaaccaattcctggtaatatcagcaactaataaaaagtgaagaaactattaaaatttaacaagttgagagaaatctaacaatgcagtttgaagttttcgtaattttaaaaacggattagccaggtgcaatcactcacgtctacaatcccagcagttttggaggctgaggcaggaggattgcttgagcccaggggttcaagaccagcttgggcaacataacgagaccccatctttacaaaattaaaacaaaaagaaagaactgattacaactgttcactgttcatatagtaaggcaaattaggtaatatatgaaaccagataacaatttttacgattttgttactattattaaataaaactatagaatgagtggtaatgtattggttttaaccaaagaaaataagtttgtgttgtttagggaagaatatacctttttaaaagaatttttcgtgtaccaggatatatagaacatgaattagacagatgcttggatatttgcatttttttcttatgttgcacttcaagatctttctgagaaattcttctgtaggaaaaaatcagcaaatattcataataactcagctataacaaaaacactgacttgctgcataaagaaacagtagttggaacatatgggtctccattttatttatttatttttttgagaacatctgccctttaatttgcatttaaaatcagtttctttaaatactttagttacaagttctgaatagtgaagacagagtagtagatgctgcaggcactcagtattggctcccaccccttcccccctccccacccccaggcctcacttcttggctcaagatacaaaaaggcactctctactggccctagtgtcaaatgtcagcagcctcwggcctggatgcagttggatacaaagccatgaatcccagtagctccaaggaattccaatgattgtgcccagatccaccggcaacacatcttagaaatgacctcatccattacaccactatctactaacaccctcagggtggtttcctaccccagtccacgtcctccaaatctgtgtcctgcagaggaagagacaaggccccactataacgcaggaaggaacaagaactgcctcctcagcccacgggcttacagcaacttacttgaaaagctcaaggcaatctgagtctagaggagacctcccttccctaatctctaccaggctctggcccttcttcgggactacgcttggttccactgccatgatgtgctagaatctgctctaagtaagaacaaggtgctagaatgaggcccagcaaccaggaaagggttgctacagccccagctgtgtgagattgtgccaagatgagtcttcttggtgtgagcctatgatggagagcgtgagggcagacctgggctctccttctatgatgattacaacacgtgacctcagggaacctctgctctntcctcccattcacacacccagatcccctggcctgtgcttcctggtagaggtagaagaggcatcttgaagtcaatgacaatggagaatgaaggtgccattgaagaaggaaagcagcacctctttgcctgtgttcaatccctccatacaagtggaatcgagaatgtgcacagccaggacagaggctgctctgagcttgggaggcacagcatcctcctagatgtctctgcagaacaaactttcaaaagataggaacttaatcacatggtcctcgggggtttctctatagtataccagcactagggagaagcaaaatcatctttgcagagagctgatggaagaaaggcaggaatatgaatgagcatccattaaggctctctctcaagcctaaggaattaagatattcgagggtatgagacaggtgcagagagggagagagccaggcaggaacaccaagaaaaaagctgtgactgctggttacatagtgctctgcttccttgcktgaggccaacagcatgtgcctgtcaccaggctaacctgggacccatgaggggacagggagaagactggttttcagttcctgcatgatcaatttgtagggtgtgtgggttcctcctaaagatcaaagaggaggactctgggatcctctaccgctgccttgattttgcggaggaaagtcacagcctctctgccatcaatcagccggtgatcataggtcagtgccacgtacatcatgggctgcacctctaccttgcctcctatagccactggcttgtcaaagatgccatgcatccccaggatggcagacaggggggttgataatgggtgttcaaagagtgagccaaaaacacctccattgctaatggtgaaggtaccaccatccatatcttcaatggcaaattcattctttcgggccttctctcccagttcagtgatggtctgttcaatatctgcataattcatagcttccacattcctgatgactggaaccaccagaccctgtggggtggccactgcaacactgatgtcaatataatccctatataccacctctttggttatatcatcaatcactgcgtttacaacaggctgttcctgcaaggcaaaggctgaggccttcacagatgccgacatgaagcctagtttgaggttatgtttcttcaaaaaagcctctttgtgccgagccctcatcttctggatgttactcacatcaatctcattaaaaattgtcagcattggcacatgtattctgggcctccttcagacgctgagcaatgcaytgccgcatcctgttcattttctccngatgttctgaatgcagacctttgccagctcctggctcagctagtggtgggacagcagtgggttttactgcagacacaggtttgctagaaggaggttgtgagggcgagggcactggtggcatcgagtgggtatgggtgctgcanggggaggaactgccgctgctataggttctgcttttggggctgcagcagcaggagcttcagccggcttggccttagcaggagcagcaccagttttcctgagtgtgaaaagcggagtgcctccttcgacttttcccccatcaggtacgaaaagagcttcaatcatgccatttgctggtgatggaacctgcaccaatgtcttgtcagtttcaatctcacaaaccacttcatcttctgcaactgtgtctccaacagctttctcccacctgacatctccctctgtgacaggttctgcaaacgctggggttttgactgtaaccaagtcatacttgcatacagttgtagttctgaagaagcgaacactgaagacactgttgttaatgacaaccttcctgctgttagggtaacctggtccctggcataaggagaccccaggcagggaatgtctccctagagggcagttccccttctggaaggcagagagcgagtggctgaacgcccgggacacagtgggaccgggacagcatcacggcggccgggtctccgttttatattattccttttcacaggcagctctatttgccctccttttcaagatagcatgccccttaaagaataaaattagttttgggaaagaaaaagtgccagtttcaacaggcatagactgtcttgttgtaataataatactataccaggaatttttacttgcaactcatattactaaaagaaagttaaatagcatactatagtccctccttatccttgcaggatacattccaggacccctaatggatgcctgaaacctcagaaataccaaaccctgtatatactatgtttttttcctacacatatatacttattataaagtttaatctataaagtgggcccagcaagagattaacaacaactaataaaatagaactataacaatgtattgtaataagttatgtaaatgtaggccaggcatggtggctcacacctgtaatcccagcactttagaaggcccacgtgggaagatcccttgagtccaagagtttgagaccagcctgggaaaggtagtgagacttcatccctacaaaaaataaacaaaaaattagctaggcatggtggcacatgcccatagtaccagtgactcagaagaggtggaaggatggcttgagctggggaagtcgagactgcagtgagccaagatcatgccactgtactccagcctgcgcaacagagtgagatcttgtctaaaaaaaaaaagttatgtaaatgtcctctttgtctttcaaaatatcatatatatactgtrctgcgggtaactgaaaccacagaaagtgaaaccccatggaatgggggagggcctactgtgttattaagacatagacctcaaatactagctcttccatatactaggtacgtgactaggcaagtttttaaacctgattatttatttcctcatttgtaaaatgtaggtaataataattgggattgttaagagaattaactgagagagcaatcaccatgtgttatttgccgatattatcaccattatccggtatgtgtatctcttaggtattttttattggcacgttctgatccagatcctaaagctcctgctaataaagcctttactggattcattgtggaagcagataccccaggaattcagattgggagaaaggtaaagtatttattaatgattagggccccaaatattattttaattataaattgcaaaattacttaactttcctttaataaaaacatttgtttgtattaagttggagtaaaaataaagctatgttttgatgatattagatcaaatagtctatatactactgaagattttgtgaacagtcatttcaagtcattttgaaagagtagtaccaacctgtggagaaggctaataacagctgtgaggaataatgaagtaaaatcaagctatcatttatattacctgaccaataataagaattctggatatttcaagggactttcccactcttttccccattggatcctcacagcaaccttttggtaggataagtggcattatgcccattttacagataaaaacaatgtgacataactgagattttactaggtcatacaacactaagaaaaaagtctatgcctgaaaagagtgtagaaaatagcaaatagccttgaatatggaaaggcaagaaaatcttacttaaataagaaaaggtaatttaacatatttgaaaaggtttgtattctgaatatgtggagataaatttggcatttaaagtagactaaagagaaaagagtttaaaattttataaatcacaatttaaaattataaattttataaagaaggaaagaaatgaagtcaataaagtaattttttttttttttttttgagacagcgtctcgctctgttgcccaggctggagtgcagtggcaggatctcagctcactgcaacctctgcctcctgggctcaaacaatcatcccacctcagcctcctgagtggctaggattattggcatgcaccaccacacctggctaatttttgtattttttgtagagacagggttgtgctgtgttgcccaggctggtctcagactcctgggctcaagcaatcctcccaccttggccccctaaagtgctgggattacaggcatgagccactgcgcccaaccaaagtcccaaagttagaggcagagttgaaatcaatatgaaggtatcctaggaccttacccagtatagtttctgatactgtattgtgctatattttcaatcagatattaaaggtagactgcacttgacaaaacagatgatactgttgtatgtaacaaaatataagaattaaaaattattgtgcttttcccaagaaattgttttttatttgtataacagatcatgtttctgtcttagggatagttgctagcaaacttggccaaatgtatggcccatctttagaaagtataaaggacctaacagcttatactttttttagtagtaaactcactcctgattttatcttgctatttctagtttttttctttgcctaattttctcacttaaaaaaaaatctacttcaataaatatttatgtagtgcatactatatacagtattctanctattagggatacagtatggatcaaaatagacaaaaatccctggccttaggtaaattactttctggtgagtgatagagataattatattgtgtatatttaagcctccttaaatctttattgaaacaaatggatatttacaaatttgtgaaatttaatgttttcaggccaggtttggtggttcatgactgtaatcctagcactttgggaggttgaggtgggagaactatttgaacccaggagttcaggaccagcctgggcaacatattgagactttacctctacaaaaaaatttgaaaattagccagtggcagtggcgcacacctgtagtcccagctacttggaaggctgaagtgggaggatcacctaagcccaggaagtcaaggctgcagtgagccatgctcctgttgctgtctgtactgcagcctggatgacagagtgagacctaatgttttcaaatcttttgtgttttagaaattatatggtttgagatgagcccaggaagcattttggttttaaatgttgtggggtttgggataaatctggtagggtgttttctcattatatatgcatggtggtccaagattctagtttattaacttttaaagacaaaataaagggatgttggcttctttctaggtcaaactatcgttattatttcttcaaactcagaagcagactattaaaaccagcaaattaaagggttagtttatagctctttgtttccattgctcctgtttcttattctgcttattaaacatgagatcaagtttttttccttattaagagttatgtctgcaacttcctctcatgatttagcataacactaatagtcatatacaaagagaaagagaaataaaaaataaagcaaatgtatcaaaatgttaacaattggtgaatctattatagatgaagggtgtataagtacttacatgcctgttacaactcctccattggtttgaaaatttttaaaacaaaaagttgagggaatgtagctagtttagtagtttcttataaagtcaaacatacacttatcacataaccagtgcccttaaataaatacccaagagaaatgaaaataaagacctatatacaaatgtttattgtaattttattaatgattgctaaaaaggaggggagtatccgtcaactagtgaaaagataatggatatatggtacatccaagagtgggatactacttagcagtaaaataaatgaattattgatcatgcagcaacatggatgaatctcagaagcactatactaagtgaaaagtcagacacagaaagcggactttattatttcacttaaatgacattctggaaaaggaaagactacgcggagagaaatcacacagtggttgccaggggataagtgtagaataaggaaattgactataaagggagaacaaggtaactttttggggttctaaagtactctgtatcttgagcatggtggtggttacacacatatacatttgtcagagctattagaaatgtatacataaaaatggtgacttttctacatgtaaattatacctcagtaaacctaattttaacaagagtcaaaggaaaacaaaatcaatttttattcagtagattattttactagctctattaagattaaaggtctcaaatcagattgtgtttactaaatgttttttctgacatggtaaaatagatagctttcaaacatataatgagatttgtctttgttgataagatgtacttgtagacctttagactagtgttggtttcaaaatttgtgaaacattgttttagattatggttggcaaatttttttgtaaagatccaaattataaatatttcaggctttgcaggccatatctctgtcacaactactcagttctgccattgtagyaagaaagtaactgtagatgatatatgaacaaataggcgtgactgtattccaatcaggctttctttgcaaaacaggcattgcagactacagtttgttgatccctgttttaggtaattgcagaaagtcatgaaacagtgattaaagcaaaaattgatgctggctcaaaaaaaattccttaaaatatatcaattttcttattaggaattaaacatgggccagcgatgttcagatactagaggaattgtcttcgaagatgtgaaagtgcctaaagaaaatgttttaattggtgacggagctggtttcaaagttgcaatgggagcttttgataaaaccagacctgtagtaagtaatatgggttcataatctttataggatcttttatttattacattaaataagtatttttactttaaaattgtatgttcagtgtgtttctctttttaatatctgcttattttattaaggatataggaaaaatactgttacttttctttcttttttttttttttttttgagacagagtctcactctgtcaccaggatggagtgcagtggtgcaatctcagctcattgcaaccttcacgtcctgggttcaagagattctcctgccttagcctcatgagtagctgggactacaggtgcacaccactctgcccagctaatttttgtatttttagtagagatggggtttcatgatgttggccaggatggtctcgatctcttgacctcgtgatctgcctacctcggcctcccaaagtgctgggattacaggcgtgagccaccgcgcctgaccatattgttacttttcttaattttttaaataattcttcaagttttcttactatacattatagaaattattttagcaactgcaaaattactgtagttggtgctagatttagagaggcagtccaccctaaatatgatcatcctgttaatatgtactcattttctgtttttactcattaagaacatttcccctagtaagatttctcttgttaaacaaaagcaatgacttttttctagagtatgatactatgcctaacaaatgcctcttactacctttaattaacaaataatataaacttacgtgcctattccctgttccccaccagtttcttgttgctgtacatcaccttctctttgtacactccctaacatagacacttaggcagatattgtgtgttttaaagataacatgaacttttgctttataatatcttaaaatactaggtagctgctggtgctgttggattagcacaaagagctttggatgaagctacyaagtatgccctggaaaggaaaactttcggaaagctacttgtagaggtaattttaatactgcttgctttgttcaaatgtaaagacactcattttcatttaatatttagaaatgatttttaaaccacaaactaatcaatttctacyttgatagcaagaagataatgtggttttatcaagatgagtttcaaagacatttctttttagagtgtgccactattggttacttctgaacctgacactgtgctatgcatttttttttttttttgagatggagtctcgctctgttgctcaggctagagtgcagtggcacaatctcggttcaccacagtctccgcctcccgagttcgagtaattctcctgcctcagcctcccaagtagtgggaactacaggtgcgcaccactatgcctggctaatttttgtatttttagtagagatggggtttcactatgttggccaggctggtctcgatctgcccgcctcagcctcccatagtgctgggattacaggcatgagccactgggcccggccttgtgctatgcattttaaatatattttctagccgggcgcggtggatcacgcctgtaatcccagcactttgggaggctgaggcgggcggatcatgaggtcaggagatcaagaccatcctggctaacacggtgaaaccccgtctctactaaaaatacaaaaattagccgagcatggtggtgggcgcctgtagtcccagctactcgggaggctgaggcaggaggatggcgtgaacccaggaggcagagcttgcagtgagccaagatcacgccactgcactccagcctgggcgacagagtgagactccgtctcaaaaaagaaaatatatatatattttctgattctctcagtaacccttttttgggtggtgttatctcttttaaggatcaagaaactgaagctcagaggtattaaatgatttgtccaaggccacacaatttataagtcacagatccaggatccttgcttttttttttttgcggggggtgggagacaaagtcttgctctgtcgtccaagctgaagtacagtggcatgatctgggctcactgaaacccccacctcctgtgttcaagtgattctcctgcctcagcctcccgagtcgctgggactacaggcacacaccaccacacccagcaaattttgatatttttagtagagatggggttcccttatgttggccaggctggtgttgaactcctggcctcaagtgatctgcctgcctcggcctcccaaagtgctaggattacagacctgaaccactgcgcctggcctatgttatactcttaattcttgttacttcccatgtcctcttgagtatcagataattttagtactataaagagtcgtgtcttccatgaatttccagggtaattcttaactcttacccctttaaatattgatgctcccccattatctgtattctttcctgcaactcactatgagttgtatagtgaacctcctatttctctttttttttttttttttgagacagggtcttggttgcccaaatgcgagtgcaatggtgcagtcatggcttattgcagcctcttgggatcaagcaatcctcccacctcagcctcctaaataactggaactataggggcacactaccatgcctgcctaatttttttatttttgtagagatggggtctcactatgttgcccagactggtctcaaacacctgagctcaagcaatctttccacctcagccccccatgagcctcctattcctatctccatttgtcagtggttctcaaactatttgtggtgaaagaccagtttgttttaatttccagttaatgtggaccattatttttgtaaaatataagaatgtcacaacaatgttaaattgctgtaaaagtgtctaaatgcttattctcatcttctgtaccatcaaccagtaacagtttgtgaattggcactgtggacaaacttggattagcactgctctgtgtcccttaaccttagtttcataatgtatctttctacactatattctagataattttttcagatctgctttctagttctcttatcttgtgcctaatctatttaatctgttgattttttattaatgactacttttcatttccagaagttatatttggttttttccattataccttctgttcaacatcataccgccttttccttttttctcattaatcatgtaaaaattcttcatttataatcaatttcagatttttttgttatcttcaattctttgggtgctaatctttcaaggtgtattgtgtcttctaactcttttatggtcaattattttgcttttattttttatttgtaaacaacttacctgcaggaagtactctatttctcagagcattatggaagcattttagaaattggcttttgtacttttttggcacttttgttaggtactccagagatttcaccattctaagagctgttattttacattaatttcttgacttggagaatcctgtatcacagagctcgtacattgatctcacacattaagaaactccgtacattccagtctgggcaacagtgtgagaccctgtctcaaaacaacaacaataacaaaagtccttttttttcttgttctttttttaaccctcctgggcaagagatcagcttctttgtggccctcctatgctgatgagcccagacttttaattgcccctttggaaagcaaagcttttacatgcagtgattctcagttttagccccttagattgttcatgctcacatcgaaatctcctgttcttatgtgtttcttaaaactctggttcctatcctgctgagcccaaatctgagtctgatttttcttttcctccatgttatctcttctcaggatttaaattcctttttagaggcacttagagatttctgtttctttcctatgagctttttttttttcttaaccaagtatttctttgttaactccttcatgttgccagaactacatatgtacattttactaaatgttagtttatcttattcataaacaaatttcaacctaatgcttttcagtgaagatctgtcatcgtcttccaggtcctccttacccaagtatctgatgataactgtatttttggctttcaactcaatatagaatcttctccttttatgttctctttcttataaattctaaagatttttttcttattaaatattgaaaaatcttagtttttccttactgcttaactcaaaatagtcttttatcatttgatttctactgaagatttgcttatcttttaagcactctgcaaaatgctgatagcttcttttttttttttttttttgagacagggtctcactctattgcccaggctggagtgcaatggtgtgatctcagctcactgcaaccactgcctcctggcttaagtgatcctcctaccttagcctcctgagtagctggaactataggtgtgagccaccatgctcagcttttttttttttttttgtagaaatggggttttgccatgttacctaggctggtctcgaactcctgagcttgagtaatccgcccatcttggtctcccaaagtgctgggattacaggcatgagtgactgcgcctggcctagtttttcatttttaattggtaggtacagtgatatgacactgtaattccttgtcactcctttgctaggtgtctctcaacccatttgtgtgccctttgaaacttcagttttttgttttttttttttttttgagacggagtcttactctgttgcccaggctggagtgcagtggtgcgatctctgctccctgcaacctctgcccccggggttcaagtgattctcctgcctcagcctcccgagtagctgggtttacaggcgcccgcaactgcacccggctaattttcttttgtacttttagtagagatgaggtttcaccatcttggccaggctggtcttaaactcctgaccttgtgatccacccaccttggcctcccagtgttgggattacaggcgtgagccaccgtgtccagccacttgtctttcagtctgtgtactctatgtatagcattatgaatgaaaagggtcaggttattcttggaatccacaattaaataattgtttagccatttcatgtgtggtattagaaaatatacaatgatctgcccaagggttccaagatggctgaataggaacaactccagtctacaggtcccagcytgagtgacncagaagacgggtgatttctgcatttccagctgaggtaccgggttcatctcactgggatttgtcgtacagtgggcgcagcccacagagcatgagccgaagcagggcaggtcatcacctcacccaggaagcgcaaggggtcggggaattccctttcctagctaagggaaactgtgacagatggtacctggaaaactaggacactcccaccctaatactgcgcttttccaacagtcttagcaaacaacacaccaggagattatatcctgcgcctggcttggagggtcccacacccatggaacctcacccactgctagcacagcagtctgagatgaaactacaaggcggcagcaaggctsagggaggggcatccgccattgctgaggcttgagtaggtaaacaaagtggccgggaagctcgaactgggtggagcccactgcagctcaaggaggcctgcttgttgctgtagactcccctctgggggcagggcatagctgaacaaaaggcagcagaaacttctgcagacttaaacctccctgtctgaaagctttgaagagagtagtggtcctcccagaatggagtttgagatctgagaacagacagactgcctcctcaagtgggtccctgacccctgagtagcctaactgggagagacctcccagtaggggccgattgacacctcatacgtccgggtgcccctctgagacgaagcttccagaggaacaatcaggcagcaatgtttgycattctgcaatatttgcagttctgcagcctctgctggtgatacccaggcaaagagggtctggagtggacctccagcaaactccaacagacctgcagctgagggtcctgactgatagaaggaaaactaacaaacagaaaggacattcacaccaaaaccgcatctgtacgtcaccatcaccaaagaccaaaggtagataaacccacaaagatggggagaaaccagagcagaaaagctgaaaattctacaaatcaagagtgcctcttctcctccaaaggaatgcagctcctcgccagcaacggaagaaagctggatggagaatgacgagttgagagaagaaggcttcagatgattggtaataacaaacttctccgagctaaaggaggatactggcaaactgaatccagcagcacatcaaaaagcttatccaccacgatcaagtcagctttctccctgggatgcaaggctgattcaacataccttgaatcaataaatgtaatccatcacatacagaaccaacgacaaaaacttatgattatctcaatagatgcagaaaaggccttcagcaaaattcaacagtkcttcatgctaaaaactcaataaactaggtattgatggaatgtatctcaaaataatagctatttatgacaaacccacagccaatatcatactgaatgggcaaaatctggaagaattccctttgaaaactggcacaagacagggataccttctctcaccactcctcttcaacatagtgttggaagctctggccagggcagtcaggcaagagaaggaaataaagggtattcagttaggaaaagaggaagtcaaattgtccctgtttgcacatgtcatgattgtttatttagaaaaccccatcatatcatcccaaaatctccttaagcagataagcaacttcagcaaagtctctggatacaaaatcaatgtgcaaaaatcacaagcattcctatacaccaacaacacacatacagagagccaaatcatgagtgaactcccattcacaattgcttcaaagagaataaaatacctaggaatacaacttacaagggatgtgaaggacctcttcaaggagaaccacaaaccaccactcaatgaaataaaagaggacacaaacaagtggaagaacattccatgctcatgggtaggaagaatcaatatcgtgaaaatggccatattgcccaaggtaatttatagattcartgccatccccttcaagctaccaatgactttcttcacagaattggaaaaaactactttaaagttcatatggaaccaaaaaagcccacattgcccagacaatcctaagccaaaacaacaaagatggatgcatcatgctacctgacttcaaactatactacaaggctacagtaaccaaaacagcatggtactggtaccaaaacagatatatagacaaatggaacagaatagagcccttggaaataataccacatgtctacaaccatctgatctttgacaaacctgacaaacacaagaaatggggaaaggattccctatttaataaatggtgctgggaaaactggctagccatatgtagaaagctgaaactggatcccttccttaccttatataaaaattaattcaagatggattaaagacttaaatgttagacctaaaaccataagaaccctagaagaaaacctaggcagtaccattcaggacatagacatgggcaaggacttcatgtctaaaacaccagaagcaatggaaacaaaagccaaaattgacaattgggatctaattaaactcaagagtttctgcacagcaaaagaaactaccatcagagtgaacaggcaacctacagaatgggagaaaatttttataatctacccatctgacaaagggctaatatccagaatctacaatgaactcaaacaaatttacaagaaaaaaatcaaccctatcaaaaagtgggtgaaggatatgaacagacacttctcaaaagaagacatttatgcatccaacagacacatgaaaaaatgctcatcatcactggccatcagagaaatgcaaatcaaaaccacaatgagataccatctcatatcatttagaatggcaatcattaaaaagtcaggaaacaacaggtgctggagaggatgtggagaaataggaatacttttacactgttggtgggactgtaaactagttcaaccattgtggaagacagtgtggcaatttctcaaggatctagaactagaaatgccatttgacccagcaatcccattrctgggtatatacccaaaggattataaatcatgctgctataaagacttctatgaccaaagatrtaggaggatttcccacccacaccaagcaacagacactagctgggtatcctccaacttagttctgacactacctacccagagatagcatcagatcccacaggcttagtctcacaagactgccccttcttttcccctagttgcaagtcctggactccagaacttctggctgactggcttcaagttggggttcccatgacctcatctgtgaattccagtaatttgctaaagcagctcacagaactcagggaaacacatttaccagtttattaggaaggatatctaatttttttactttttttttaattrttatttttttcatacagagtctccctcttgttgcccaggctggagtgtaatggcgtaatctyggctcactgcaacctctgcctcctgggttcaattgattctcctccctcagcctcccacatagctgggattacaggcacctgccaccatgcctggcctttttttgtttgtttgttttttaagtagagacagggtttcatcatgttggccaggctggtctcaaactcctgacctcaggtgatccacccaccttggygtcccaaagtgctgggattacaggtgtgagccaccacgcccagccaggaaggatattttaaaggatacagatgaagagatgtgcagggtaaggtatgagggaagatgcatatggcttccatgctctccctgggaatctcaccctgtaggaacctctggaagctctccaaaccctgtcctcttgagaggtgaagccagctggacttcctgggtcgagtggggacttggaggacttgtctgtctagctagatgattgtaaacacaccaatcagcactctgtaaaaatgcactaatcagcactctctgtctagctaaaggattgtaaacacaccaatcagtgctctgtaaaaatgcaccaatcagtgctgtgtctagctaaaggattgtaaactcaccaatcagcactgtgtaaaaatgcacgaatcagcgctctgtgtctagctaaaggattgtaaatgcaccagtcagcactctgtaaaatggaccaaccagcactctgtaaaatggaccaatcagcaggatatgggtggggacaaataagggaataaaaactggccaccccagcctgcagcggcaacctgctttggtccctttccacgctgtggaagctttgttcttttgctcttcacaataaatcttgctgctgcttactctttgggtccacaccacctttaagagctgtaacacttgccacggaggtccgcggcttcattcctgaagtcagcaagaccacgaacccactggaaggaagaaactctggacacatctgaaggaacaaactccagacacaccatctttaagagctgtaacaccgcgaaggtctgtggcttcattcttgaagtcagcaagaccaagaacccactggaaggaaccaactctggacacactcttgggtgttcatggaggcttcattacataggcatgattaattaaaccattggtcattgatgatttaacttgacttgtagcccctctcccctccctggaggttgtagggttggggctgaaactcccaaccctctaatcctgccatcgtctttccagtgaccagcaccacgctgaacctagcagacaaaagacagcacgttggagatcccaaggaatttaggagttgtatgccagggaacaggaacatatttccatcctataacatatcttggccatataactaactcatagagcacttactatcccttattgaaagtatttgttttatgtcttctatttaattctgagcctctagagtctaagaagcatcttttagttgtcctttcctctgtcttggtatctgatacagtgccacattatttttctctatctgtagcaactttctttttttttttttttttttttttgagacagagttttgcttttgttgcccaggctggagtgcaatggtgtgatcttggctcaccacaacctccacctcccaggtttaagcgattcttctgcctcagcctcctgagtagctggtattacaagcatgtgccaccatgcctggctaattttgtatttttagtagagacggggtttatccatgttggtcaggctcgtctcaaactcccaacctcaggtgatctgcccgcctcggcctctcaaagtgctgggattacaggtgtaagcccctgtgcccagccagcaatttcttctagaaagtcccagcagaggctgggtatggtgaatcacacctgtaatcctagcattttgggaggccgaggtgggtggatcccttgagcccaggagtttgagaacagcctggaacagcctgggcaacatagggagggacctcatctctatttaaaaagaaaaaaaagaggccgagtgcggtggctcacacctgtaatcctagcactttgggaggctgaggcgggtggatcacctgcgatcaggagtttgagcagcctggccaacatggtgaaaccctgtctctactaaaaatacaaaaaaaaaaaaaaaaaaagcctggtgtggtggcacacgcccagctactcgggaggctgaggcaggaaaatcgcttgaacctggggggcagaggttgcagtgagccgataacgcaccacttcaccccagcctgggcaaaagagtgaaactttgtctcagaaaaaaaaaaagaaaagtcccagctactttgggggctgaggcgggagggtcgttgaggctgcagtgatctgagatcatgccattgcattccagcctggaaaacaaagtgagaccctgtctcaaaaaaaaaaaaaaaaaaaaaaaaaaaaaaaaaaaaaaatcaggcaaactgaaattgaaggacattttacataaaataaccaatcaacattcttcagaagtgcaaagacgtaaaagataaggaaggattgaggaattataatagcctgggaaagaataagaagaaataactaaattcaacgtataatggtggaaaaagaacattagtagaaaacttgaccagrtttgagtaaggcttatagtttagttgttaatactrtaccagtgttaatgtcctgttctcgatcatggcactatggtttggtaatatgttaacattagaggaagctgggtgtaacttctataaacctaaaattcgttaatgaaaagtttaaaaaataaaaaggtcaggcacagtggctcacgcctgtaatctcagcactttgagaggcctaagtaggaggattgcttgaggccaggagttgcagaccagcctgggcaacatagcaagaccccgtcactataaaaatgaaaaagccccaggaaaaaacttttaagttttctcaataaatatcctttaatttttttctttttaattctagcaccaagcaatatcatttatgctggctgaaatggcaatgaaagttgaactagctagaatgagttaccagagagcagcttgggaggttgattctggtcgtcgaaatacctattatgcttctattgcaaaggcatttgctggagatattgcaaatcagttagctactgatgctgtgcagatacttggaggcaatggatttaatacagaatatcctgtrgaaaaactaatgagggatgccaaaatctatcaggtaaggttaaagatgatttttttggtttgcaaggagagagaatattcataaatgacaacgtggatttctgattatttagaaattttatgtccctagtagcaataaatgactgtcatatatggctgtgagccagtttttggaattaattaatagaaagaagaatgttatttgtgattaagtataagtctgaagagagaataggctaaaaaaaatggtacagacatgtgtattacgtttggattagatttctttgagttttaacagattggctaattgtaacccaaacttttctctccaaaaagtatgcatgtcatttaaaattaattattttgatttgaatcttgcctgacaactatttaatttattgtaactatacttggagtcaaaaaccaacatcaggagacagtgatgtagattaattccaaattaaattggtagtcaaaaaaacttaggaggaattcagtaaaaggaaatataaatgtgcatgttctctacatgtggcttaagtaattacttaataattaccacattcttgctcctcagtatctcttcccttgttccccctacacctagcaaattatttgactcatccagtcattggaaatactgagttcgaatcaaaatgctggagtgagaaggaatgttacacgtagtgcagcctctccatgtagacatgaaaaaactgaggtccagaatttgtgccttatccaaagtcacaggtttatgtggtgatactcttcctctcctagagcctttaattataattattactattattatcatcaacagtttrgcttttctctgccatctgagaagatgaactaacgaatggctaaagttagaagtttagaatggaaataaggtctgactcttgaaatccttccagcatctttttctttagcaactctgttccacaggyagtgggagaaaaaaaaaaaaattaagggtaagaataaaagactgaaggagacagctagctaagaacagttcagaaaattagacaaatattttggccacattaaactttagttttcccaaactttctgaaatgtaaatatcttttctttttttakattttgaagactcttctccaaaattttgataaatggctttttataataacttaaccaatctttagagaattccatattttcagactttcacaaaatcaggttttggaatctgtagaggctacagaccctatatatggtttgattcggttttatattacaacacagcttatgctactgtctaaaatgttgaataaatcaaagtatttatgtactaaagatatttaacctacacttatatttttcttgcagatttatgaaggtacttcacaaattcaaagacttattgtagcccgtgaacacattgacaagtacaaaaattaaaaaaattactgtagaaatattgaataactagaacacaarccactgtttcagctccagaaaaaagaaagggctttaacgttttttccagtgaaaacaaatcctcttatattaaatctaagcaactgcttattatagtagtttatacttttgcttaactctgttatgtctcttaagcaggtttggtttttattaaaatgatgtgttttctttagtaccactttacttgaattacattaacctagaaaactacataggttattttgatctcttaagattaatgtagcagaaatttcttggaattttatttttgtaatgacagaaaagtgggcttagaaagtattcaagatgttacaaaatttacatttagaaaatattgtagtatttgaatactgtcaacttgacagtaactttgtagacttaatggtattattaaagttctttttattgcagtttggaaagcatttgtgaaactttctgtttggcacagaaacagtcaaaattttgacattcatattctcctattttacagctacaagaactttcttgaaaatcttatttwattctgagcccatatttcacttaccttatttaaaataaatcaataaagcttgccttaaattatttttatatgactgttggtctctaggtagcctttggtctattgtacacaayctcatttcatatgtttgcattttggcaaagaacttaataaaattgttcagtgcttattatcatatctttctgtattttttccaggaaatttcattacttcgtgtaatagtgtatatttcttgtatttactatgatgaaaaaaggtcgttttaattttgaattgaataaagttacctgttcattttttattagatattttaaagacytcagaaaatataaatatgaaataatttaagaacccaaatctctgaatttaatatttctttgtaattctaaatatcgaatactgctaaactgtgttatactaaatggagtgctttctgacatcacatctcattctctagttctttgacatcaactgtgtcctacattttaattctgttctgacactatgcagcagagttagggtcaaccccataaggctgccctcacttcagaggccagtcacaagtcctgactccccaagctacccatactctgtccaacatggctacaaattcaggtattcccatgaccctgccctcagggtcgataatttgccagaatagctcacagaactcaggaaaacacttaacttacatttacctgtttatatcagaaagggtacaactaggaacaattaatgaagaggtgcatagggaaaggtatggagggagaagggaggtgcagagcttccatgccttcttccagcatattaccttccctgcatgtctctgtattcctcaacgtggaagctccccagctcaaattcaatagtttccatggagctcaatctccagtcctccactcctccccagaggaccaaggtgaaagctggaagctcccaactgtattagtctcctagggctgtcataaaaaatacactggagacttggtagcttaaataaatttattttctcacagttctggaagctagaatttcaagatcaaggtgccatttgggttgtttctagtgaggcctctcttcctgccttatagactgccaccttctgtgtccttacatgtcctcttctctgtgcatcatgaagggttgggttagggggagctcttgtgtctttttctcctcttctaaggacactagccctgtgagattagagtcctatcctcatgaccttaattaactccctaaaagatcctatcttcaagtacagtcacattgggagttaaggcttcaacataggaattttggagggacacaactcagtccataacatcaccctctaattacttagtccttctggtgaccagattcctcctgagattatctaggggccccaccctaagtcatctcatgccaaattcaggtatgattgaaaaggtttataaggaataacagaagataactccaagaactcaagaaattccaagggttttaggagctctgtgccaggaacaaagacctagggacctgggaacaaagaccaaataaatttcttataccacattaaattaccaaaataatcgaatttcttacaaatataaaatatttaaatgacatttccttcatgctcaatgatgaaattttatttaaatgatacaacttgagattggtaaggagatttagagaattcttaattgggtattatgtagaaatgagaagttaaatagaatgtatatatttcaaatgcaaatttgaatttgcagtacagaggcccaaccatttctaaacataaagcttctagacatgggctgggcatggtggctcgtgcctataatcccaacactttgggaggttctgaggtgggaggatcactgagggcaggaatttgaggcttcagtgaactgtgatggcaccatttatactccatcctgggtgacagagtgagaccctaaaaagaaaaaaaaggtccaggcaaggtggctcatgcctgtaatcccagcactttgggatgccgaggcgggcagatcacaaggtcaggagtttgagaccagcctggccaacataatgaaacccggtctctactaaaaatacaaaaaattagccgggcgtggtggtgagcacctgtaattcgagctacttaggaggtgaggcaggagaaacgcttgaacccgggaggccgaggttgcagtgagctgagattatgccattgcactccagcctgggcaacaggagcgaaactccatcaaaaaaaaggaaagagagaagggaggaaggaagggagggaggaaggaaggaagggagggaggaaggaagggaggaaaagaaaaggtttctataccagatataaatgtactccaaaagaagggagggagggagggaggaaggaaggaaggaaagagaaaagaaaaggtttctatacaagatataaatgtactccaaagccttatgatgagaatattatagaatccttgctaataaatattaagcacttatgtaattttgcatcagttaagcctttttagtcacaagtaaatgaatttaagcttctttaagcaaatatgtattttaagtatgtggaaatgactcataggtctgaaagggaggaatgaagtcagtctcaggaagggactaaaactagaatagtcagtcctcaggaatccatgaaatatatatagtcttttgctaactctctacttctgtcattttattcattgttgctctatagtctaactttctctgcttctttgatcccacaatagaatcagacttcacggtagcatatttatattttggattgaccaccacatttataagcttgctgactagggccattacaagaaggagggtaggtacagtcatggactacaaacatgactattagttgcccccatcagtgaattgatggttcctagagaaagcacagttttacatgtgatctagtaggtttaccagaattttaatgaatgtttaaggaatctaccagagtcatcaatttgcatagagggagaagaattattcagtgactcctctggattaaaaaaaaaatggttgttgatatggcttctagaattacagccattaatttgaatatattatcaaatagtacaaagggtctttggagattaaagattaaattccacaggcaacagtgttttttcttttcttaatatgtgaaagactgtatttaactcattggatgagggaactagtacaaagttaaaactggtataagggagaatttaaagagcagatagaggcagtaataaatgcttaaaagaatttgctaggctgggcgtggtggctcacgcctgtaattccagcactttgggaggccaaggcgggcagatcacctgagatggggagttcgaaaccagcctgaccaacatggagaaaccctgtctctactaaaaatacaaaattagctaggcatggtggcacatgcctgcaatcccagctactcgggaggctgaggcaggagaatcacttgaacctgggaggcagaggttgcagtgagctgagatcgtgccattgcactccagcctgggcaacaagagtgaaactctgtctaaaaaaaaaaaaaaaaaaaagaatttgctagtagattgaccatatcctatagggcaggggtccccaacccccaggccacaaaccagtagcagtctctgggccattaggaactgtgctgcacagcaggaggtgtgtgttgggcgagcaagcattactgcctgagctccacctcctgtcaaatcagtggcaacattagattctcataggagcacgaaccctattgtgaactgcacacatgagggatctaggtttcgtgctcctatgagaatctaatgcctaatgatctgagaacatttttatccccaaaccatctccccttgcaccccccactgtgtctgtggaaaaattatcttccacaaaaccggtccctggtgccaaaaaggttggggatcactggtatagggcaataaacctaatgggaccatcttttctacagagcagaaattagttgtagttaaggttcagttgcattactttcctttttttttttttttttttttacaatttaacatctacatttacaattgtataacagtctgtccaataaaaagacaatggtacatatcccatcagataatatgcagaggatccattagatagtacctagcacaccactaaagggatgcccaataatttattgtatcctttttcaaggctttgacagtgtttcttaacagtctcttacttttcatcaaaaggaatctgccacaagtattcctgatcagtaaaaagcaaatttcattaggtttatgtggattatttgcctaggtacagcaagagtgttcgttagtcatgtagatctcctcaaatttactttgcaaatccagaaccatacagtactgaacaaattactaaggccacaggattaacttctgtctgaaatttttcatcagagacctcaaatcggacttttaaaagcttctatagcttgacatcccaaggctggggaatcaaatccaagaaactctccactagatttctcctgtagtacctaagagcttgggtgaatctctctccttaacatcttcagaatttgctagggttcctggcctgccgagcattgctcttccttaccacttacaaacatttaagccaggcacttttccagtgttattgagacagctttgtaggtattgactctacatataaagtcaacttgtttttaataacgggcttctcataactgattaaattagaattattttcaaaaaggacactctaggtatggccctcatgacctaatcagttatcctggtaaaaaggaggtcagattccttttgaatactgctgtgaaataaaaggaaattcagcacattcctgaattctgagggcttaggatcacatgccatttaaaaatgtcagagctgggccctgtggtttatacctgtaaccccagcactttgggagactgaggtgggaggattgcttaagcccaggagttcaagactagcctgggcaagatggtgagacctcatctctacaaaaaattagaaaattagctaggtgtggagatgcacayctgtggtcccagctacacagggggctgagtcaggaagatcccttgcgcctaggaggctgaggctgcaatgatccatgttcaaaccactacactccagcctgggtgacagagcaagaccttgttgcaaaaaaaaaaaaagaaaatttcagtttacaaaagcggagtacactaaattggagtcaatagcttatgaagaattttaaagggcttcctcatataccataaaaatagaacactacatcaacaatattccaataaataaataaccatgattaaacttctctcatcagttcattcagtcctgtgtaattatgctgctggaaattgggttggtggactgctttcatgaatcagtctgtttccagaagagagtcctagaaatgcagactcagttcactgctatggcttgaaagttgtctaagctatgtctgctcagaagcctgtacccatgactctattttttgaagaatttatcagtagtccaaagcacctggttctttccatgaggctctaagactgccctttcttgaaaacacaaatttggcttctagtttatagcagagcccttgagcaagcatcagagtagcacagaaactctgtgtacatggccaaagctaaatggtgtttgataaggtttggctctgtgtccccgcccaaatctcatcttgaattgtaatcctgggggtgatttcccccatgatagtctcatgatagtgagttcccacaagatctgacagttttataaggggctcttcccccttcgctttcttctctttcctgccaccatgtgaagaaggtcttgtttccccttcaccttccagcatcattgaaagtctcctgaggcctccccagccgtggaactgtgagtcaattaagcctctttcctttataaattacccagtctcaggtatttctttatagctgtgtgaaaatggactaatacagtgttaatttattcaatatcagaaagaaagaatacaattctttgttatagcatagctgctacatttctttgaagggggatcatttttatttgaataaatgtaatagaatattcagtgaaaagtaatcctttcttaaaggattgggtggtagacagaatttaagaaaggattacttttcactgaatacttttctgttaggcagctgctttttgaaattctgtgcattcacagatatatattttttcctttgtttcccacataaatagcatactatatggtttgttgctttctttttatgtctgttttcacttggtatattt

SEQ ID NO: 10688 - DNA, 103012 bp, Homo sapiens
  misc_feature (1)...(103012): n = A,T,C or G, or insertion/deletion polymorphism (see Tables 1-2)
cccacacccagcaactttttgtatttttagcagagacagagtttcaccatgttggctaggctggtcttgaactcctgacctcaggtgaggtccacccatctcggcctcccaatcctgcctgttttgatgagaaaagtttttaagaaaagtcaaggaaaatcaagaatagctacacttttaccacagcagaagaaatcatggaattacagtgggaattagtgtaatggcttgactgatctgctagtccaggacttatttcagaaatgtgtcttcttcaaacagattgtattagtgcaccaggcaggacttctttggttgtaagtgttgggaacttaacttgaactagtatagaaaggatgtctgaaatcagagagctgattgcattctctttctctcctctccacttctctctgctttgatctccctgactggcttcctccaaatggtagcaaatatggcagctcctggtattatcagagagggctcaagactggctggctctaagatgtaagcaggcagacctggggatgagcttaccaactctggatcacctggtagaggagatgctagaaggttcttctggaagatggcagctctcatttgaacccctggtcaaagtaggggatgggcattcctgaaataagagaagtgttggtctagacacatgacccaacagctttctgtgcatggctggcactacgttttccttcatagcctggtgtgttttagtagcataaagtgaagtgctatttggttttagactctcgaaaatcgcagaaacagcatcatttgtgcagtagaatagagtaggaaaaattcacaccaacatgtccatatgaagtgtttagggaatggggaggggcagctggtccatctttgttcctgagcccgggtctcagtgggactgaatctagaggtgggagctttgaaatgtgcaaattggggcagggatagaagttgaggctagaaatgaggcagagacgaatatggctgatgcagcccagatccctgaggggttattgctggatgattctggacattattgagcacagctaccactcactctgcagaagagaaaacagagttgcaggaagcttagttgacgtgcccaaaacctgtggtgagttagtagcaaagaaggcactagggcctcattcccagagatccgctcaactttccactctgacactcgaggaggcttaaaacaggcacagggatggaatgagaaaccccagctgccctctggctgtggggtcagtggaagcctcaagtcctcttccttgattgggcttctaatccttcttgtcttgaaacaggcctagttgcctcagtggagcattttactttaagctgattttggaatgtcacatacctcctcttcaataagaggaaactccagcctcactgcaacaagcaaatctattaacatgattgcagatccatcactgggagctggttgggagggtgagaagagtggacttgagctggccctccaggaatatctcccaggatatcccagcataaaccctctggtctattctgggaggcagggaaacaggagcctgccccggagagactgaacttaggaacacactgcacagccgcaatccagggtttacaggacaaagatcgaggcacccttcagcagctgtctggatgctgggatgcggggtgtggcagatgctgctgctgtggctgcgacttccctttgagtcctggagactgtgatggaactcggatgcttagtctgttacacagtctgccactgcctcttaacattcagggagctggagtcttcatattggcttctctatgactgtgtgtatgttcaagttccttctagcagagcctgagacagggtgttgtgcaagcgattactgagggagagctcccaggggaaacctagaaggaaggcaggaagaaggatgagggcaggagaagaagccaggcaaggagtgggttctgagaagtcaggctggtcccatggcaggtgttctgcagtgagaatcctcttgccaagtttttctggcccagaggcaatggactggagtgtcacatcccacatcagacatcactggctgtgggccaccccaagggagatgggctataaccctgtactagttatcaactgctgtgtaacaaattgtcacaaaactagcaatttacgacaacatgcatttagtatcttgggtcaggagttcaggcttggcttcactgggtcctctgctggggtctcagaggctgaaacctccgtttgggagactacatttctttctgaaacacggagtcttttcaaagctcacgtagatgttggcagaagtcaggcccttgtggttgtcgagttggggttcctgcttccttgcttgttaggagctgctctcagctcccagaggcccccacatttccttgccattggccctcacaggatggcggctcactttgtcaaggccagtgtcttagtccatttggatggttgtaacaaaatgtcttaaacttggtggcttaaacaacaaaaattgatttctcatgtttgggagtttgagaagcccaagatcaaagtgcccgcagattcggtgtctggagaggtcctgcttcctaactcgtgcactgcaccttccctctgtatcctcacatggtgggaggatggagcagtctctccatatcctcttttataaggcactgatcccattcatcaaggcttctcctctacgacccaataacctcccaaaggccccatctcccaataccatcactttgggggttagaatttcaacatatggatttttgggggacatgacatccagaccccagcagccagcaagataatctctccctgccgtttcctaagacagagtcttctgtgatccctgggtgacttcccacgacccaactgtaacctaatccaggaagggacaccattcatttttgtcgtgttcaaaggctggaatcagggctcagcttccatttgcacgcaaggggggtggattacgcaagggcttgactcctgggggtcatcttggaattccacccacctcacacaccccaatgtgtccagaagagacagatcccagcatccacgaacagtcctccaggaaagggcgtgggtgtgaaccactaacatttgactctcatctgaggggagtcttgcagaggcacccatgggaccttccacactgtccttgcccgcaggagaaagggcagccaaagtctcagaaaatcgccatccctcaggccaccttccaatcccatagccgtgtatctggatggggaggccccatccccatcagggccacagctacaagggagcttggaaaatggagttctgaacttgctaacttgtgtagttaaggacaagataagggaagaaaatgggaagaggtgccaagagccagttcaagcctgcagtgaaggggaaacagaattgagatattccgtgacttatgaggtgaactgagagattcagtgacttatgaggtcccaccgatggccgggcctagatccaggactcaggacgtttagggcagctcaaacttttgaggttgttttcctcctgggatcaggtagcagagaggaactggaaatgtaagtgggaatccacatagtggtgattaaggaagaaagctgccatagaacccaaattctctcttgttagcacaagggaggtttaccatgagtttctggaagtttctagagccatgggcagtgctgaagaggatctggatcatcaatgagtaggtgcagctaaatattaaagattatggtttcctactgaatgggagcttttatttctttaaatcatgttctaaatgatttcttgcccttgctgtttaaatatagccatccattggtatccatgggggactgattccaggaacctccatggatacccaaatccacagaggccccaatccctgaaggaaggtggtgtagtatttgcacataacctatgcacatccttctgtgtacttcaagccatctctagattacttataatacctaatacagtgtaaatgccatgtaaacagttgttatactgtgtcatttagagaatgatgacaaggaaaaacatctgtacatgttcagtatatatgcaatcatctactttaaaaagcatttttgaaccacagttggttaaatccatggatgcagaacccatggatacgaggtcgactgtaatagaaactttcaataccaaggaatgcatctgcctagcgattttgcgaaaaagagtgtatttgtatttgaaagaaaccgtggagtggaaacacctaaaacgtgcttgttcagttaacctcagtttgctgagctgcttggagcatggggttgtaatcaaaggttgtcttcttcgcagcagacaatgttctgggagaaatagtcctccttagtgctgaagttgcagactctaaccaagggggtggcagcaagtatccccggtctctgtaggggcttgagtcaacgcctgcactgtgcagagaggatgagggcagagaattggatgccgctggaggggcgtgttgtccttctacatgtcatgcaggcagcgcggttctatactcggagcctctgctcagcgtgtcttcacctaagaaccccataattcaggttccatccttgttccctactccagtgctctgcaagtgagccctttggtttagagatgggttgggcttctttatgggagaggaagggagccctggagctgcagaggggagcaggcattctctctggggtgctgtctcctttcttccctaaattggagggagataatccatggaaaggagttaatgatttctttgctcttcaaacttggtttggaaggatctctcagtcaaaaagaacctttcggatgtctcttgatatttcacattaatggacttttcataaggaccacatgatgggagagcagtgagaagtttggggatggccaaagctgggttgtcatttgagctctgttactaacccagactggacaatgacgatgtcacttactctctcggaacttcttttcttttcttcttttcttttcttttctttttttcttttttctcttctcttctcttctyttcttttcatttcttttctttctttcctttttctcttttttggagtctcactctgttgcccaggctagagtgcagtggcgccatctcggctcactgcaacctctgcctcctgggttcaagcaattgtcctgcctcagcctcccaaatagctgggactacaagcgcctgccaccatgcctggctaatttttatatttttagtagagatttagtaggggtttcaccatgttggccaggctggtctccaactcctgaccttgtgatctgcctgccttagcctcccgaagtgctgagattacaggcataagccaccgtgcccagcctgtttctttcatctgtaaaatgggaccacaatttcacctaataaaagaagacatctttctatttaaaagggcttagggtgttgatgtttgtgataaaggagagaatgtatattgaagtgttttgaaatgtgcaaagctttctagaaacagaagttcttactcaagtattttcccgaagctttggcaagataaccatttttattaccccgtctgtgcctagaatgggcctataagcgccacaatcagaatcattagatatagaaattaagagaaatgtagcctccttttttttgccggtgaacagagctttggttaacagaaaaccaaggcgattttaattgctggtttttctatttgaagggggaagttattagtagaagtctcaattcagaaacttcaagaagaaatgggagggtgtggtgagggtaagcgggggactgcatttcctgttttcctttcagatggtgttggaaaacattgcaggaaaaccatggatacccacgaagaaattccaaaatttattctttttgacgccaagggcccagcccaaaaggtgacgagtaggagtggtcaatttttttttttaagagttggggcttgcaggagtccagctaaacgcttgtagggtgaagacagaattcagagggtgacatcagcctgagcgggggccagaagaaacagagtggaggagtctggtttcatttacagttttgggtcagttctgcagtgaggagggggagaggaggggtcggggagggaggaggaggaggaggaggagctggaggaagccctgactggtatccctggccccagtccagtttggagctcagtcttccaccaaaggccgttcagttctcctgggctccagcctcctgcaaggactgcaagagttttcctccgcagctctgagtctccacttttttggtggagaaaggctgcaaaaagaaaaagagacgcagtgagtgggaaaagtatgcatcctattcaaacctaattgaatcgaggagcccagggacacacgccttcaggtttgctcaggggtaagtgtgatttctcttctgtttttccaggtttggggctagaaggaaatgctcttaacctgaagtgatcctttctaggtagcgttagtggctcttacgttcatgctgatcgccagttttctgtacatgttttaggtctctggaagattccgctgatttttctttctcactttatggcaatgggatttccttaaattggttaaggtcatgattgcctaagagtgtgagcacttttccaccgcgtgtctgtggctgctacacgcgccctgtgcattccgggcggcagtgtgtttcggcccatgatttatttaagttactgccgccttctaaaacccattcgggatccgctttgtttgcagaagcgtctttgctgaggactagcatagctccctgccgggcggctccgctgggagatgttctctgagctctctgggtggtgacactaggtcagggtgcaacaacctgcatgggttttctgcccagggccgcccatgggaaggtcctggtggagcacatttgctgctttcacaagattggagtaactctggtgctcaggatcagggccaagtaaagggtcgctcagtcattgccgtcaagctttcgtctttccaggaacctgaagtctctattggagactttgtcccttggggttgcttaaaggagttgcaggggtcagaggagaagaaggaattgggcatttgggcagcatgctgagtgtctaaggcagggcccctggggctgcagggccagcccatgctgcacagaggtgaggccagtgccgagctgggaggccccgagggctgttctctggcccggaggatgcagggtggggctcgggccctctcttgctgaggatggacacgttcgctgacagtggccagcctgtttggggaacctgtttcaaggggmctactatgttagataatgaacgggtattgaagtatgggtggggtcactgggagggactagggagtggttaaagaaaaatctgcttccacaggaagcyccaggagccagtttcgaggccggtgcagaccccaggagcaaacccctctgagcacaggggagtctgctgtgctggatggggaggcagggctgtggycccggctgactggcttctctccccacatacagctcaccccggcgaggaccacagggtgctagagctgcagggtgctcagagctcacggggatggtggatgctcaacctgggatcccccagctccccagggtcccattcttaatgctgtaaaaaacaaccgaaatggctttaaaatcgaagttacattgctcctaagcaaaactatattgaaaactgagtgggtggccgttgatgacattactgggacttctgaggtttttgttgggctaaagataatggaakagatttttggtcagaagccactgatgcagtagtttcctggttttcaaaatgagcaaccaggggctctgagatgcggaattccttgcccaggccagggagcgagtgcctgagatggcagtgaaatccttccccattgaaggagagcagacaagccagtgacggaggatcccaaataactcacatctcgttgggaaaactgctttgggctcactaagactctaccaatgaaccgagaaagaagggaggtggaccgtggggcgggggcatcggttccgtgaccggaataccggggctggccgccctgctcaggccacctcctgggggtggagggcgctgaaggaggggacctgtatgctcttctttctgaagtgggcttgtagctgaggatgaaagcctgggtggggaggcgtggcttttacaaagatcaggatctaggaacagctgcctgtctggacttctttgtttagggggtttcttgctacccagaggtttagttctctcctttcctcactcatggtcgagagaagccaggaagcagacactgagtggagcagagggcttgggaaggaattccatgttggggtgaagtgaggctgtcctggcttttcctatccaggcattggagggtgtggctacagcacctttctgggaggtggctggggaagcctctagaatgttagcccttggccccgctctttccctgcttggcagggagcgtgttccaccccactatagttgtggcccacaggtgaggggacatgtggcaaatgtccaaacctggggtctgaatgatatttttgatacgaggtaggcacctttctgaaaaattgtctttacttcmcacttcattttatttctaaagcattcaggactcagcaaattgcactgactttatcatcagtgccttttgtgatttcctatcctagaacttaatacgtccccgatgagaaagtaggaagaagctcctctcttcagtcgattgttgatttatggttccaatgaggctgctcatcctgaccttagtttcaggaacggaacccatagacctggatgcctaaagccagcttgaaacaagaccgccttctttggaagctttggaagctggcagtgactttttgccagcgaggtttcatttgtttccttgctcagagtgttcagacaactggatcaagcgtagtcttcaccagcggttgatatcacctcccacttatatgtgaaattccatgtttaggacttaaaattcaccggcaagtcgtgaatactattgcgtgacacttccttgcaggcgcagtaacagctttagcaaaaatttttatttgaaagttcagttttgtcactgctctttttggaagaagctgaaaatctgctatctcttgggggaaggattgcaggcggtttccatctgacagggatgttgtgtaccaggcagcttttccaccctgacttacgggagcaaacttttcatggtgtcctggctgcagcaagcaggcagtaaaaaatacatcactgctacataaatagctgacgatttgaggagggacctgacatttaaagaaaatcctattagctctagctaagaaaatgaaagccgcaaaccctccaaattttaaagtgggggagctttaaagtttcctactaattcagacagccatgaactagacaagaatggttatcttcattctcccgtttctagatacagcttctctgtttccactgtaaaacttcagtggaattcagtgtaaaaattcagtgcaaagaaaggacaatcctattctttaaataaaacatgttgcttgccccctctaatgtgtggtcatgaatgtcttatttccagggagtattccacaggtcctgattttgcagagatattcccttcaacaattcactttgttaattttgaaaaatataatttttaatacattctggtcttatagtccattttgggaaagagatgaaattttgagggctgggcactgtggctcatctctgtaatcccagcactttgggaggctgaggtgggcggatcgcttgagcccaggagtttgagacaagcctgggcaacatagggagaccttgtctctacaaaagcgttttaaaaaattaaccaggcatggtggcatgtgcctgtaatctcagctacgaggctgagttgggaggatcacttgagcctgggaggttgaggctgcagtgagccgtgactatgccactgcacttcagcgcctgggtgacagaaccagaccctgtttcagaaaaaaaaaaaaaaaaaaagaaaagaaattttgagttagcacgttcatcctggtctgtttttgaaaaggcagtttggttttctttcctctagagggaggtgtatctctgcgagcttcagaaaaatctctgaagtggtgcctggagtctcccagggtggagtttcagggtttgtagtaactcagtgatgaccatctcagcagagcttgcgggcagttttaggactgatatttcaatacatgattgtcattattatatttattgtggctgttcataataacggaagtgtacatacgttagagctttgtttttcttctctgctcaggtgtaagtgtattgagatgaaattgtgccatcaaaggaggcatctttgttcccaaacaattgcattacaagggtattcagcaaataagacattttataggaagcattttacccatatctaattacagaggtttaaatgaacagtcgggtgcttgagaaccaaagtaggtttgcatattcatgccattgcgtatccctgtagaattaccggattttagaactgtaagggtgctcgtgacatgtcctttgatactttcccctaataatggacaatgggttttaacatacttttaaaaattcacacaagctatgattatgaatgtctcgtcttgaatatttattaatacaaatatatattactgactctcagatttatgtctgttcgcttgagataaccagcattaagactctgagggagacaattctagctcagagcaaaacaaacaaacaaacaaacaaacaaaaaaaacaaaaacctaaccctttggttggtctttgtgttctcatgtttacttaagtttaacaagacctattgtgcatcatggccttgagccctgaggttcagggaggggatatatcccyaatgctaaawgacgagttgatgggtccagcacaccaacatggcacatgtatacatatgtaacaaacctgcatgttgtgcacatgtaccctaaaacttaaagtataataataataaaataataaaaaaagagaatacattcttggggaatattaaaaaaatgactaagacatagccccctctcttctggttggcaaacatataatttctgtttggctaattgaaatatcaaaaaaackactaccttggtggatggtttctccacgccctttatgcttcagatgaagaaagagagctcagagaggtatgcccagtgacagggccacagagctagtagcagaattgtctgatgtttccaatatgcagacatcttggaatctggacatttcaagggggacaagcctttaagagtgtattttagggtgccatgtggagaaaggtactcttcccattcccagtcttccttggagtagcctcttttaagttgattcagcagaggagtaactgttgcttaaaaaaatctggaaagaaaaaggagagaagaaaaaaacaaatacgaaaagttctgccaaaccttctcccaaaggcaaattgttagtcttgtaggggtctggctgcattcagcatagtatgatcctactgttctcctgaagtttaaactcatgaawtacagagaaacatttgagaattgcaagtggccagggaaaagtacaatgggaaatgtttctgtaaaaccccctgtgtgtgctatacattaggttttcaggaacccagagcatcaggaattggtcactggaaggaagagctcatggctcggtttaatttcaaaattaaaaattgaacagcagctggagttgactcagatctcaagggaaaccattccaggaaactggtttttcacttctggaatcttcattagttgattcagcagcccagggccggtacccagagttagcgccaactcagctaaacccacagcyggcccggcggtgcaccagggtgctctgtttctaactggggctgcagaaaacccatcattcatcagagcccagggcaacagatggaagagagcagtcgcaggactatggcctgttcgagcaacaggcarggagccttcttttacacaaaagggaggctgggagagattggccgaccattgctgacagaggcagtaaggaagtagaatttcccaggttactgcaataaatccagcatggatgatattttatcagatgttccaacttgatttttgaaaaggtttctgttttcaagaatgattttatcttctctacttgattataaattagactagaaaacagacaaaatatctaacttttctctttacaaagagagcacctttcagccactttaatcatttacagtggaacaccacagttttggaaaggtcagtagcaccttagttcattgccaagaaggaaaagacaggaataagtgccaagctccaatttggatccagcagcgtcacgtggcaaggagttggaatggagtgggcatttgtgcaatatttcttgaagcattttctaatgcacctttcttctttaatgttgaaatggaactagtctctgcctgatgtttataattagcagtataagtgcagacaaaatcttgtctggctgccgtatatttcagaatgtggaatgtgttttacatttgcatggtggcgtctagcttttcaaatcacaccagatatggaactttctgcctcatggttattatctgcaatgctaggaatatgttttaaagtaattttttcaaatatctgggtaattaatctggagtttcttaattgcctttgtaatgggaaggagacccacctctgaggagcttggcctaagcctggctgcaggtcggcatattcttacaggtgctctcattcacagagggagggcattggtaggggatgtccaggccttctctttctgcattgctttgttataatccacaagttgcagaacaggtgttgctttgttagattttaccaggaagagttgaagatctcgaatccgctactccatatctaacaaggacccccgtaagtgacaaaggaccccagtaggtgacaaaggaggtctagttaccctgcctgatgagaagagttttaaaatgttgctatcacaggatacacattcagtttgagtcaaacagattattgttctagagtattttcatagaatagaaattcaaaggccaggtgtagtggctcatgcctataatcccagcacattgggaggccagggcaggaggatcccttgagcccaagagtttgagaccagcctgggcaatatagtgagatattgtctctaccaaaattcaaaaaaaattagccaggcgtggtggcgcacacctgtagtcctagctacttgggaggctgaggtgggaggattgcttgatctcaggaagttgaagctgcagtaagctctgatcatgccactgcattccaacctggacaacagagctatactctgtctcaaaaaaaaaaaaaaaaaaaagggaaaaaagaaagaaatgtgaaatccaagttgttaaataaacagtaaaaaaacaaaatttgctatatttctttggaggtttcttggagctcttccaaaacattttcttttgaggattctcctttgggtctttcaaacaccaagagcatattaaattccactctcctcctaccctaattgcaggacttaataaatcctttcttagcttcctccctgaggaaaagaacggggactcctttcccaggattcgtgcaaaaagagagagaaagagtgagaaaaagagaaagaaatggggcgctccttcttgcagtctaggaatgggcgtggcaaaggcaagggtggatgagtgcctcaaatttactgaaatttgactttctatttcacagtcagtgtgcacggctctcccactgtggtctttgactatttccactgctcccattttaaacaggacaattaggaactaacagaagtcccagaacttgataggagggacaggctgattttaaaaagcagtgcttggagaaaaccaaataaatgacttcaaaatggaagctctggatttatttgagtctttgttttcaaactatttccttgtgtgcatgcgtgtgtgtctctttcttaaaaaagatttccagacatggaaaatgaaaaaggttttgagtaggctaaatgaaaactaatttacagaattgcaaaatagcttgggaaatcatattcattggaatatgattgaatatgatttcaggttgaagggccatgtagggcaatctttctgatgaaaggtatccttttaaatttcaaagggatagaaactaaacggaaaaaggcacctcaaatcctttttagaatgaggcagagtaaacaaaaagatgaataatcctaaacagaaagatgagaatgaaaatgtgatgaatgtctcttattgaatctgtttcctttaggacacagaatctaggatgaaggaacagaccccttccagcccaaggatctcaagcagccaattctgagtctttttttcatatttgaaagaatgatagtagacagccgacttccattgacatagaatctgtggtgtgtcaccaccaaggaagtctattttttccccaaaaggcatggggagtttccttgagatctgggccaaatctggcacagcctctagggtttcccggggttcttcccatgagctttggaaatgctaacttgggttagggttctggttctatgttgtttttatctatgtagctttgaacaatcactttgccttgctggggtttcaatttctcagctataaaatggagggaaatcagccatcggatggttgggaggagggcgtgaaatcccacccacaagacagaagcccaggaaacgttaccagcactctcctctctccttcctccgggagggtggtgtcggggaatgagcgcggatggctgcctcattccctcttgttgaagagggcgggtggtcatctggkgagatggtgtttgacatcttttaataatctaaatgaaaaagttctccaaaatttgctgccagggaatttcgtttttttataaatggagactccaggacatgacaaacaatagaagagagttaattgcaaacgaaaatatcagcaaatattcaacagctgggctaggagcccacgagccacaagacctgcttcccgcatgatggcaggaaagtgtgtggggccaaaggcgtttttcccacctgggaattcagctcagtcaaaccatatgggttctgaatcatcagtggagcctggataacgcattgtcctacaggcattatctcccgtccttttcagagctggaagggctcctttccttctcttccctcccctcctcttccctcaatatctggatatattctggataaaataattcctgtgcacagtgtatttatcccattactttgtgttccaatgggaagtatctccactgagggggctactcctccaaagattcacatcttgaaaataaaaatctttacatatgattttcaatgaactaaaagttcattttactcagaatggttgaagtaagtgagtgatgtcttagacttcccggattttattttgtaactatttagattgtattgagcactctggaagatgagaaatgtaattttggaattgctccagagtgagcccactcaatgctttatatgtgacagaatcagtggattcaaaggctttcactgtgtgaggtatgggaatgattaagaaaaccattagcaaaacctgctcaaggcataattcacttgtgctctttgtcaatgctccctgcacaggtgtctgcagctcttcccatcccagactcaacagtgaggagacagctctcatcttatcatgtcctattttttccacctggattacaaagccgaatgctttacaaagagcctctataatactcttgtgttctcattcacaaacaaaaataccacttaaaatcatgcctcttgaacatggattaaacatttaaagtaatcgaactggatcttccagaagatttgcattaaaatttttaattgaagcagtgatgcttaaacttttggggggtgaggagtggcacaactgccttttagaatcacatacaaacatggacccttatctccagaaaaaccctcatccatagatgcaattttgcactcaactgtgggaggatcatagactctttgaatctgttgatcccgtattaaaacattgatctggaccagttacaataatacaggttgttttggaaagaacaggccattttcttagaaagaatctagcaggaagcttacctttgctaaaaaaaaattgacgctcaagcttgatagaacgaatcaagaatagcacatataaaatgtacttttatattattctgaagtgtatatcattatttaattgaggtcatacaaaaaattagatattgcaattgctttttttttttatttgaagaaacactcaggaatgggtctaacagactgtagggaagaaaggtagagcttggtggaaaagtctggaaggttcccagggttgcatgggcttgagggattcctagagagtgaaggggcaaagttggggctgtggcacggtgggggtagggtcaacctaagtggagggaggagaacaggcagtccagcctgtcgggggtccctgagccctgctgtgctgcgaccgggctaaagcttgggagcattatcaaaccacagcacaagcactggagactgctcttctacattgtgttaacatatatccatgtccaaaaggcagtgaccattgcaaggcaaaaaaaatcgggctgagcttttgcaatactgccgctatcaccactcattgctgtcactttgttgcagaaaaatatctgttctgttgataactggcctcctgagcatcattagaacagcattcctttctcactgttgatgcatttccaagagactgctgtattgacaggtggttctattttagctgctgagatcatggcttcaagttctcagaatctgaatcacagggtacatttgtttcatcacaggtggtactttttgttgactttctttggaaatccaaagccacatgggtcctggtgttcattcccttgtttgtggcttcatctgtctccatctcaccaatttttggcgggtcaggcctagggcccacactgtgttccgtcttcctcatagctgggccgcaagatttggactccagcttctccctctgggcctgacctcaggcaggaggaatttcacggcaaatccacgggactgagcttcaggtttcctttgcacccacttagctcctgtccttgactggcagcctcaatcactctctgtggctctccctgtacctttgctaagtggtccatctggacactagtctgctgctccattcatggcaaagttacatcactcatcagcyggacagactctcctctgctatcaatcttcaggtggcaaggctgagaacattagatcatcctcatccctgatttcattagctgtatggggaaaatggaattcctgtgctacacaacagacaaccatgaagacttgcagagcccatgggggcacctgtggagagaggaagattaagatagagatacaaaagctcaggccttgggtggagccgattccaaagctcagaggatactagtcaaggcagaagccatgtttgcaccaggtctgaatgttcatattagattctttcccactttcatgagactctgatcttctttgccaaaccctaacattttgcatgacatatactcttttcttatttctttccaaatcttatttagaagtaagggcaaacattgtgttatttgaatacagcggcatgtagacacactttaggatgtttagttgtactgttttttcctagtagctcttaaactctatcacacctcaaaaaagagatgctgcacttacatcattcctgttaaattgatggctacattttaggggtagttacccatgcttttaaaacctggcaaatgatatttcctgtcctcatttctattttaattgtggtaaaaaccatataacataaaacatactatcttgactatatttaagtgtacagtacagcagtgttaactatacgcaccttgtgctacaacaaatatctataactttttgatcttgcaaaacagaagctctatacctatgggacagtaactacaactgcctccctcctgacagcccatggccaacaccattctaggttctttttctaagactttgactactttaaataccttcacataaatggaattataaagtaatgcatttgtcttttagtgactggcttatttcacttagcataatatcctcaagattcatccatgttgtagtagataaaaggatttcattcttttataaagctgaataatattccttgtatgtggcatgtataagacttagtataatacagtaggccgtgcacagtggctcacgcctgtaatcccagcacttaggaaggctaaggtggaaggatctcttgagcccaggagttcaagaccagcctgggcaacatggcaaaaccctgtctctactaaaaatacaaagcttagctgggtggggtggtgtgtgcctgcagtcccatttactcaggaggctgagaaggaaggattgcttgggcctgggaggttgaggctgcagtgagctgtgatcgtgacactgcactccagtctgggtgacagagggagaccctgtctcaaaaaaaaaaaattacagtataagtggtgtaataacagtgcaaagtcctaggagaactgtaggaatagcagttaatgaatttaacaaatatttattatacacctacaatgatacagacaggcattttgccatactctgtgctcagagtgtggctgagcttcacagtcctggaagactctttgtttatgataaagcagccttggaaatctataatcaatttcataattgcaaaaaattccattgtgtgtgtatatatacatatatatacttaaccaaggaagaaaaaaacctgtgcactaaaaactataaaacactgttgaaatgaattaatttctttattcatctcatctattgatggacttttaagttgtttccatcttttggatattacaaataatgctgaaatgaacatgggtgtgcacatatatctttgagatcctgttttcacttcttttggatatacycaaaagtgggatagatgaattatatgataattctgttttcagttttttgaggaacattcatacgatggaggctagcctttccccactgtgtagctttgttgaagctcaaagatcatatacatgaggttttatttctgggctctctattctgttccattggttcatatgtctgtctttaagtcagcatcatattgatttcattacaccattttgtaatatgttttgaaattataagtgtgaggtctcaagctttgctattttccaccccttcattctgttaatgtggtgtatcacattgattggttttcatacgttgaaacatccttgcattctagaaataagttccacttggttagagtgtataatccttttaatgtgctgttgatttggtcagctagtattgtgttgagaatttttgcatcagtgttcatcagggatattggtctgtatttttcttttcaatattggccttataaaaatgagtttgggggtgttcctttgtctttaatttttttgagaaaagtttgagaaggattagtgttaattcttccttaagtgtttggaagaattttccaggagagacatctggtcctgggttttttgttttttttttatggaaggtttttgattaccgattcaaccccatactaattttaagtctgttcagaattttttttattgcttcatgattcagtcttggtggattgtatatttcaagcaaatatctattttttttctaggttatccagtttcttggtgtgctattttcctcacttcttacagatctcatgtagtcttgtcagtctttccaaagtcttgtataaacaatttcacgtgcctgatttgctctcatttccccttgctttcttcagggaattgccaaattattcctgatgcaggggatataaaaccaatctgtaagcatttggagttttagaattataagatgaaaaaagtcacatttcaaaatctgacatatacttgatacccagaaagatgtttttgattttcattcacactgatgctgaatgcctttacatgctgtaatctgtgaaacagacttctttttaaccttcaaaccctaacagtgaaatgatgatgaaaactcaatctccctagattatatgtatttcagtttcttaagtcaaatggaatttctaatttaactgtagtctacactatatcatttccaatatcaaataattcttcctgaaactcaatataagaaaaaatgacaatattaactagtgtcatgaaagttcatgctgataatgagattgagtctggtccttcccctgggcttctccggggaaatgtcagtcgtctacccattctaattctctcacttggtcacagggaggcagtgagctccaccatcaagggacatgggtcccacttacagttaatggagtccgagagagcagatatttgcaaacccagtgatctgggctcagtggaggcctgggcaggtggagatgcctttggttgctgcttcagaggagtaagagcttagcaaaattagacatggagaggaatagcccatgaaatgtgtttggggaattctgggttaaatcaagtacagcaggtttctttactttatttttcagaactgctatatattaaggtatattgtaactgttccagaaggaggcttggtattcagcactttccaaactgcgttgctcatggaatgcctgtttttccccttagaacatcgaatggaatgggtgttccatgaaatgtgctttgggaaatgctgatgaatgaaacgttgctggagaatggtagttagagttcacttaccatccattccgcgtcaggcatttaccaaacaggctaccacatgctcctcacagagggctggaagagaggcatggctatcattgttctgtgttatagaggaggaaatggaggctttgagcaagtataccacctgcctgaggtagggtatggtggatccaggatccagatttatctgattccaagcaccttgtctttccccaacatctctggctccttttctgattcctaaaaagcccaaattcaggctggtgaacttgattgaaaagttgctatggaatcgtggggttttcatggagaaataaaaatgttcttcttatcctctcatcttatgaaccctcagtgtggcaggtgctattgagcaccaaggtgtctgaatagttgtgcaccttggccacttattctctgcacccccattttttcctgtaagcatgaggatcagcatctacctctaaggataatgtaaagataaataacacacattatgaaaaattatgaaaaactgcaatgatcacatagtagatgctgaataacttttgataacatggcacccaaaacagcggtttaataacatcctagcctacctgtgtcgccaatggccttgttccccagtactgttacccaaacctctgaaaagggaacccctgaccagagagctcctaactggggaacccctggccagtctgggtaagaagagtcactgacatgcacatcattgcaaaatgaaaatgagcttctcgttcaaatgttttaagaattccaagatagcaacatcaaagcatcaaactgagcatggggcccttcagagcacagggtcctgtgggcagccccgtctgtggtctaagaaaaagttaaaggaaaccagaatcctgcattaaggagaggagaaaaaagatgctgtcctggcaaggggacttcagcctagacagaaagaccctagctctctggaggggtcttaagggagaccccagcccccaagctgatctcttagattggagattggagagtgaagaggctgtcacaagatcttgtggtaggaagaaaaggtgttggcaggggaaaggtctgatggcgcacgctactgagctgaagtgaatgtgaacttggctggtggggcatcatgtgtgcggcccccagaggcgcgtgggtatgggagactctgcatcagggcagttagcctccaggtctggcttcacagtcttactaattaaatcaccccaggctcattccactgtgagattggaggttggcatatggcagattttccttggaggaaaagtgctaaatattaatagagaatatggacaaggcttgacatggtcccagctgctgtggttgggttgcatttggtgtaatttgggcaaagcccgttctctccataaactgaaactttcctctgagsttcttttaaacatgacttacaaacttaagctgggtgtcaaaacctgatgccttgtgcctatgagtgcttttactcctgacccatttccattctgctctttgcttaggaatatgctatttccaaattgctgcgtacatcacttagggaggaaaagaaggtttaattgcatagctttttagctgtggccaaagtaatagtcactagattcaaaaattctcatttatatgtttaatcaaaactatctttcataatggataaatttttcattcattagtaatttgaaaaagaaagagaatattttcagattgtggagaaactactatgaatgcctattttctaaaaatgtaattgtgttctttgaactatgtttaagaatgtccagagaggagagtgagcagtgccattacaggtgacctatgttctgctaacaagaagaggtctgaggtccctttagacagagagctctgcctattcacttctcacttacctattctttaccttcctcccaccttcccaccttgcctcctcccttcctccctccctccttccctctctccctccctccctccctctctctctttctttctctctttctttctttccttctctctttctttctttccttctctcctctttgtttttcttctgcttctttctcttcttctccttccttccttccatccttccttccttccctccttccctccctctcgccttcctttctttcccttcctttccttccttcacttcttccttccttcccttctttcacttcttccttccttcccttcccttccttcacttcttccttccttcccttctttcacttcttccttccttcccttcccttaccttccttctcttctcccttcccttcccttctcttcccttcccttctccttccttccttccctccctccctccttccttccttttatatatgcatatatgtgcgcatgtatgtatctgtatagatttttatctatctatctatctatctatctatctatctatctatctatcatctatctaactgtctatcatccatccttttgctgctggttcaaagaatgaatcagatacaaagtcttcttggaagtctaaaaaggaygtagaaagcatgggattttgagagattttgcataatgagagtcaaaaactgatcattccctttgccctgttttctcttttaggttcatatttggtgcttagacaaattcaaaatgaggaaacatcggcacttgcccttagtggccrtcttttgcctctttctctcaggctttcctacaactcatgcccagcagcagcaagcaggtaagagccagaaacgtccttgattttgtaaaaaggaatatcattctttgattttagatcttagacatcaggcactgacatagagcttagatatgttcttaaggtagctaagccatttattataggatagtcagataggatagttytaggatttatagrccttttcagatactctttatccagtgagagatgacctatttttattaaaacttgggtttggtatcttggaattggcttgaaaatgatttgtttttacattggatgtgaacggaaagtttgtatctcaaatgttttaccacctgaagggactttccacatttctggcattggctggtctctgagcacataaagtagggagaagtcaatgattgagagtaaaaactattttccctgaaaaatacaaagatcaccctctctctctaactccagatgcaggaaggcatttttcatctaggatccttgaatctttaagatttctgtttcccaaaacgaattaaaagcatgggttctaattaactctattaaraatttgatttcagagttttagaaaagtgggaaatgcttcatgcattgcaagctggaaaggactcaggtgggtctccctctccttgacccagagagcttggcctctgagggattcttcctccaggccaggttgctcttagatggagggaagtctagtgtcacttcaatggaagaagaacgtgggttggggcatcaggtcagcctgaggtaagtagagtccagcagcaagcctggctcacagctgcagaagggcacctcctggggccactgacagcctgataccctgagctcccacccttgagggagaactgggttcatctggaaatgagatagataatgtttgacatctatggagacttttctggctctgaaaaatatgcagtaactaatagagtacagtttgttcatgctcaaaaaatctggaaaaaataagtcttttcccttctctacatttacacaagtcctcctcgcttaaagaacatgtatttattatatttatttttcacgcaaattacccaaagcattgggggttagtgaatggaaaatagcaatttttacttttccttttttgtcaaggcccggttttgtattccaaactaaagaatgaatttataaaatgatggttggttgtctgtgataagacttccttctggtttaatcaggtgggtcttggggctcaaactgccacagggaatcatacttgagttaaagacagcccaggaaattgtttccccaatctggagcatgctactggcccattcatgatggtctctgagtatggaacttgggctagtgactgggcaccagcagctattgagtgcatgggctcaggtccctggttcccaggtaagtgagtctaccttcctgtattatcagtgaggtgtgaagtgtttagtagmagtatagtgtaaaccaaatttgtttaggaaggctttgcaytgataggaagtaattgcttacatagtagaaaaatctaaaccaatgtctttttttaaagatgtcaaaaatggtgcggctgctgatataatatttctagtggattcctcttggaccattggagaggaacatttccaacttgttcgagagtttctatatgatgttgtaaaatccttagctgtgggagaaaatgatttccattttgctctggtccagttcaacggaaacccacataccgagttcctgttaaatacgtatcgtactaaacaagaagtcctttctcatatttccaacatgtcttatattgggggaaccaatcagactggaaaaggattagaatacataatgcaaagccacctcaccaaggctgctggaagccgggccggtgacggagtccctcaggttatcgtagtgttaactgatggacactcgaaggatggccttgctctgccctcagcggaacttaagtctgctgatgttaacgtgtttgcaattggagttgaggatgcagatgaaggagcgttaaaagaaatagcaagtgaaccgctcaatatgcatatgttcaacctagagaattttacctcacttcatgacatagtaggaaacttagtgtcctgtgtgcattcatccgtgagtccagaaagggctggggacacggaaacccttaaagacatcacaggtaatggcaaygccaccaagctacgccctgccctgctgttcttgggagatgagcttggcaactgctggccttaaagcaacagctaggatggcgggtgggccagggaagagatgagtgttcacaggtttaaaaacaaaggtttgatttggaatattcttccatagtcttctccccaagtagggcattcacctacatacaagaagagtctttttttaaacaactaatattttcagtctaaaaaaacccacattctaatattatgatcccacaaaatacctctgccttccttagaaaagaaagcctcagagtggtgaggtgtgcatctgatcaaactcctctatttggtgttgggatctgtttcctttaaggaaagctccctgttggagagtgcgtgaactgagacgggagygagggcatctgtttttgtgtccagtggactagcagagagcttctctcttctactttacggagttaatttaagagtgttggtagaatcggaattacaagaaacctcagctatgatccagtctagattgattttggaaaaaatttagtcctgaatggttagtgacagccggagctggaggctgtgcatttgggctgtgggtctggtcttcttatttcttctccatgcggtaatcatggctgtgcccacagagactcttctaattctaatggagttgatgagaaccactctggaagtattgagagcacacggacattgcatcgatgtgtcatgtgcagttgcatgtacagagctaattggccgacaggttatttaaccagttaagcctgttagctctccttccagggctaagtgcctaaatggccaatggggaaggaatttgacaagtacaatttcaaactctaccataccacagcaactgtaatgagtgcccagagcttactcatcagcgatgggcagagcagagggacctccccttgttagaaaatgagtccatgcagccatttgatagttggtagcagagaattctgggtggaatgagcaggaaatgagagaggaatccagggggagagttgagctccagaaaggagacacacatgttctctgagatggagggaaggcatgagaaaaggggctgtgtttccaagatattcaggtggataagaggcacattgagagagttcaagttgagttgacatccatcatctcaataaaggagggaagcagtggggcttgggggcttggagggattgaagttatttttgatcagctgctatagggatgtgaagaggggtcacaaaacattcaggaagcaactgctgatttgaagtggcatccagttgctatcagagattacaagtcagtgggtgtctccattagtgtggatccctgcctttctgcagatatctcaggcactcccaggatcaaaggagttcccagaactggaacttgcaaagagggaacaatagagaggacagaagaaaattttctcagtaaggaaatccagagtggtagctagtaaattcctgaaacagcctgccatggtgtcctagctgcatggggagctaatgagagctggaatgggccaggagacctctgaagagccagaggatgagaggccaggtctcggaaggagagtcctggagacagctgagtgtgcaagttggagacgctgctggtgtgtagacagggagacctctgagggccaatcgcggggctggaggagtttccaatggtgctcagtgtggtcctcagatgtgtaggaactatagagagccagccactgcagaaaccagagagggtggtgctcacaaaggttgtccatacagaccttaaagtctggagatgaccacagagtctgcagtgtgaacgcaggctgaacataatgtaactaaatcatgtaggaatgttggagactctcttctgtgtatttagtaggcatgaggaagtggataattctttgaatcaaaaaagaatgagtgggcaaccacatggcataggggaactgatcataggaagcaagatttatgaacagatttttctcctacacttttaaaaatggttaccaccaagatggccaytgggacaggaggtaggaggtgaggtgactgatggagagtcagtctcttgtgaatacacatggatggtggggcaggaaaaagagagttgaggcttggaggcacacatcactctacaggaccacatcggagggacagcagaagaattgcaagattgcaatcagaatgctggagcagttgcagagaagcagtaccagatgtcagtttttcataacaaggattcagaaagcaggagctgaagagagatgacccaacatcagcagaaaggaactagctgtcttgagcaggcagaacttgatgaagaagagggtttcagaactagccagctccagggtgtttcagaagtttgttcataaaatggttttcccagtggttactcctgatttcagctttaacggggctggcagtgctgatgcccttacctgtgggtctgcttctccataggaaagagtgagaggcagttcaaacactgcaaagtgttccctgcttccaaatgacaggcctcacccctggcattaccacacaggcatcagtcctgccaaatgacaggaaaagctgggtgtctccaagagcaccccaaaccaaacactcaggttaccaggaaatgacaagagggtatctacaatgaactgcactcctcgctacgatagtctcagtatcattaattccctgatccatcacatttcggaatatcgggataataacaaagacctaccaaaaaatagtgaaaggggctcacgcctataatcccagcactttgggaggctgagacgggaggatcatctgaggtcaggagtttgagaccagcctggtcaacatggtgaaaccccgtctctaccaaaaatacaaaaattagccaggtgtggtggtgggcgtctgtaatcccgggaggctgaggcaggagaatcgcttgaatccaggaggtggaggttgcagtgagccaaatttgtgacactgcactccagtctgggtgacaagagtgaaactctgtctaaaacaaacaaacaaacaaacaaacaaacaaacaaacaaacaaacagtgaaagggaccagtagagaaatggaacatcttttattgacgttttgttatactcacaaaaatagctgagtttgcctttatgtttaaccattatgtaatggacaaacaatgagattaccatagtgaatgctaaatgaaactaccaacatcgtgtgtttccacacagatgataaaacctttgtttttatgccaagaaagcatctctgtcttctagtgtccaagccactagcagcaccagggcagaaaattaatccattcatgtgtcttttctaattaacatcactctgcagttcctcctagtaccacgtcccgctgcatgttccacggcaaaaacataggataataatcttaggaagaacagtacatctctgcttatagttttttggaaagccagttagaagagcattatagagattgctaattagttagggctgcctcttcttactacctgtctgctgggtaacttccccatagagtgttcttgattataaaacacacatatgtgtaaaatatgaacgatcaccactgttgtcaatgaactctactcaaataatcaatctctaatggttgtgtttttaaaaatccctctgtcattctttaaaaaaatgaatatacctgagatataaaacctttattttaaaacaaaagctaaaggtgacagggaggattttggcatcagctttcttttctctgtaaaggatgaagatttttaaaatttgtaaaatatatatacaattttgtgttttacataggaaacaagaatgggaacttgtttttcttaatgaaaggaggcatcacatgagctaagaaaggcattgtgcccacaccagtgagctcgggaaaagagcttccagggatgtcaaaggaaactgtgaattttccttggacactgtaaaacttttctgtagaaaacaccacagaggatgtgatacataaagcatagaagcagaaaaccagacaattttaaagcttttaaattgtgcatagatctgattccttgtaacattaacattggtcattggtccgccttgctgtacacaagcacacatggcccctgtgtgcccttgaggcttcagctctcttgaataacaaagcatgcccttgtatgtcccattattgtgtgtgtaagaggataatgttgttattcagtgatgacaaattatccaacgtgtttctatgactggccactgtagatgttcagtcttttacaagagaatgttcaaggattttccctcagggtccatttatcttatttgcatgactataaatttcaacccaaaagtaagttacaaatggagaagaaatagtgttatcctgcgacttagggatcatttttaaaagcttgactgtattgatcatatttaatccttcttttaaacgtcttgatatgctgaggaagtggcaaatccttccgtgtcctttgaggtcattggtttaggcctgggaaatgttgaggaattttgtggaatttgtggagcctctgtattatgcaatgatgtaggccatttctatggccttctgtgtaattcacaccccctggcaccacactctcttgaagatccttcaggaatcttatattttggctgaacagtggcaaatgctttgggccctaatcaagggcctagtcttatataaaacttttgtgtggcaattactaaaaacacaagatcttaattactgtagcacaacaattatcctactcattgtatcttataagaaggattgtgatagcaatgttgccaggttaatatatttccctatgcaaagaattaatctgcaaatatattgttaggaactttcttgtatattaggaagggaagagggcagttccgaacctggcaatctctgtttcagttcacacaatgagaagagcttgggtaagaatgtaatttcactagagcagaactcttcaattttgtgagacaagctttggatccttttctacagtgagaacaaaaacaattttgttggcacaaggaaacattaattttaaatataaaatgttcactgtcattgaaaagatcagagatcagagtgaatggtcttacctataatattaccatcatttaaaaatgataccctgagtgtagttttctggaatcccagaatataaatagataagctcaagctcacatataatctcttcttgtccctaacacatactcaagttatcaaaaacatcgactagaataattgtgctcctccttgagtttaaatcagccaaatttaaacattcgaactgatgctgtgaaatctctggccctgacttttagatttctcgatccctattcctccctcagggctgctatataaccccgttctcagcatcaggttgggaattctctgtttgccattatgggggagagaagaggtcttggtcagctgtttttctgccctttgtataaccccaggctaattctaatcagggtttattcgatgctcatggtccttctaggtaactagtttaggatgtcataaaaacaaggttggataattatgtcatgaccggtttcatatcactctgcttaacattgttctgcattaagtgactgaatatagaggcaatgacaaaataaatgaacaaaacatcctgcccaatcccagacctgcatttgagttttatgcaactaaacatcatttgagaaaaaagaacaacaaaaatttcatcaaagtattttttacatgaaaactttaaatgtagtttgagttctgattcacgaagttgcatgtacaaggtcattttggtttttaaagaaaagagaagaaacaatagtttctgaaggcatccagcaacatactgggttgaggaatcaccaaatcgtgactctgttttgtagctgtggatttgtataaaaaattattctaatcatttgaggaggcaggagaaatgaccaaaaattagaaatcatctctaaagttttggtaacctactcattgattttccctggtaggtttggtagtggacaattcatgctactacttttccctccaaatttagtggaaatttctagaatatgtacccaagattgtcccctsagaaaagtgaatatgatgtttggaaatttaactatgaggatggcacaaatgaaaaattgctataaatgtcccttttttacaccatgatttctaagaggttgcctcttatccattcagaatgcagaactgaaagagaatttcacattccttcatcaacatgtgttttgtttgcccatatttcgtgtttcttattggtttccaaagaaacatgtcagaacactgaataatgcatgtggtcacttgttctaatgctttcacattttttgcatttctttcttttaaagcacaagactctgctgacattattttccttattgatggatcaaacaacaccggaagtgtcaatttcgcagtcattctcgacttccttgtaaatctccttgagaaactcccaattggaactcagcagatccgagtgggggtggtccagtttagcgatgagcccagaaccatgttytccttggacacctactccaccaaggcccaggttctgggtgcagtgaaagccctcgggtttgctggtggggagttggccaatatcggcctcgcccttgatttcgtggtggagaaccacttcacccgggcagggggcagccgcgtggaggaaggggttccccaggtgctggtcctcataagtgccgggccttctagtgacgagattcgctacggggtggtagcactgaagcaggctagcgtgttctcattcggccttggagcccaggccgcctccagggcagagcttcagcacatagctaccgatgacaacttggtgtttactgtcccggaattccgtagctttgggracctccaggagaaattactgccgtacattgttggcgtggcccaaaggcacattgtcttgaaaccgccaaccattgtcacacaaggtatgtatcctcttctcaccatctgtgtgggagtggggtgttgtgtgtgttggtttacatagacgtaaggtgggtaccagcatgattcgccacgggagaagctgtaagtacccacagtccagtccttccctgatgagctgggtcctggatgtcatgtttgtgatgtcatgtgtgcggaaaaactaaagaccaatgagtgagtgaaagctcttacgagagtatgagttgctgagaaagcgtgcttttaaggctaattcaacaaacctgttgctttgagattattaaacatcaccgtattaactacttataatccagtcttcctaaaaatgggcttgaggggctcattacagttctgagaaagttactccaggacyatggcattgagctctaaaagtcagtgttagaagtgtgctcatagacagagtatctttccaaaagcaaagatggagtgagggtgtctcctcaaagtcattttgtgctagggtgctgagagttatacttctgaaggtaagaaataacagtgtaatcacttgatgaaatatttatgaagttttttttttcttgtgcttgtgaagtgtaggagtaattctcctgagtggcaatattaggatacaagctcaaatggagggcctttggcaaaacagccaattggagtggtttaaaaaacaaaaaaaccaaccaagtcacataacaaatatgcacttaacaaacataggaggtatggtgggggcatcaggatgcatagcctcctctaccttttgaactgttttctgagacatcagtcacttttcagacctatcaatttcattacctaggtcaggccaataggatgccatttggtaaatcagggacacagtggcccccaacagtttccagaaacacccaactcacttccagtgttgcttacacactgggatgctctaatgagattagtccttgactataagaccttattcttcattttccttccagagtatgggctcaatgaaaattggtgaatggataccgaggctcctataagactctgattatcatctgcaaccaatcatctaaattttcttgggtgaaataacacattgttacaactcttatttgctaactttataaataaagtctgggtctacaagataaatattgtaataagatactgctttacccattgtatcaattacaattgatcaagggaggttttcctttgataaaggagtgaaaataatttaaaaataaccattttggagaatatgccattgtatgaaattaagagtagaagattttaaagtcttaattaaaaacatcactatctatttatttaaggagctgacctctacttaatagtgccttgctaatcattagttctagttgctgcattcatgtaaaggcaacacaccacatttccttacaagggttacaaaattcacactgagttagattgaacttgcctcaaatgattttaaaccacagcttttgttgtaataaaaattacaggtagaaagctcaggctatggcatctctacttaatctgtgcattggaactgtgaccaggtgatgtagcaagaaaagtatatgtgagtgttgccttctggagaaggctgtgtctggcatttatttaagtttgaaaggtcaattctgtgtggcttagcttttgctgcatacagttttccagcttttcctctcacttgatgggaccataaaattggcccaaatcctccagatgagctaatagagagactagaattttgaaaataatgttctgaatgcaaatggacattgagaagcaatggaaacagtgtrcaggactacatgcccggtgcctggagctgctcatgctcattccatcatggtgccgttttgtgactctggcaattaagaaaacaatcaagtgaaaatttatgacctgctgaggtttctctgagcttgcatactattggtgtgcatcccaaagtatagaagcccagagatttccctatgttttgcagacaccgacgatgcaacatggctgtagatgggaaagctggtctctggtcttgggtcttctgtggacctgccatgtgatcctgggcaggtcatgcaacctctctgggtttcgatttcttgaatttatgacaaaggagttgcaccagatgaagatatgtctgtaccaggagaagtttcaactttttaatgaaaatgggcagcacatgacccttgtttcagattttccctagccaagtagagtttcaaccccttgattacaaacatcatgtttaatatcaatgattaacttgtaaatattcaacaaatatccttgactatctggcatgtgccagacactatgccaagcactagagatatggtgctgtttaatgagacagatgtggctgctcgtctgttacaggataatggggaaagagacaataataatataaactagtgaccaggcaaaatattctgagcatgataagttgcattggggcattcaacagggctgtgataggaagactggggaagggaattttagatcaggtggatggaaggccctgagaaggtgtggaaccgaaggcagatgagcatgcggagagcagggggaagagtggtccaggcagaaggaagagcaggaggggtggccctgcaacaagaaggcacttagtcccttcccagaactgtcagaaggcagtgtagctggagcacactggacagggagcctgaggttcagactccctggatgcatggaagctggagaagcagctgctgtagggggatgagaagccacagggagtggagcctgtgggttgggagccaatggcagaggaaggtaggctgtgggttagtggtgggggcaggggctctcctctgagggcttctattttctcagagacagatgaggaggccttggaggcagtggcagagggctgagcagagagcacagccatgagacagtcattctggaggacaggacagccaacttcccaaggaggcatgggaggatggtgggcaggcacaggtctcctgatgggggtctggagttccgagcgtggcatgcaggtaccttgttgtgtggtcttctccaggaatgtccactgcttgggtgatgcatgaggaagactgtgggcctgatggaggctttcaggagagtctgatggaggtgcagggatgaggcatggaggaaaacagagagaggcgtgggaggagggctgaagagggttgtgccatgttggtgaggagtagcaggaccttcaagttcatctcccaacaaggcagtgaagtcaggccctgcagagccacattaaagagataagacagctgtgtttgggttgatatttatgtcaagtggaaggaaatgcgtatgcatccctgacgtggctcacagaagagtcagctgtgagaatcccaaggtttttatcactgggtcagaggagattcatggtgcagcccccagagaaatgaaatgattctgcaaagcctaggtgaattgcgtcagagtcatgaagcaaacataggaattcagttattcttccagttactcaatatttttcagtgtttactatatttggctaagcatggttctaggcatatcatctgtcatgagctcccatgacttgaataaaaatcaaacgtaaatgacctcttacctaatcaaaggggactctgggacagagcctctgggaaccagaggtgcatttcagggttcccagagctgaatccttgttgggtgcaaggagactaggccacttgtttcattagatctagaaggtattccttcccgctggctcatcgggagaacttttagtgatgcagtggtagggggagggaaaacgtgggagggtaggggatgatatttatcttctcccaccccaagagttgtgccattgctggtacttataaagaagaatataacaatctgggccacttggtataggagcaagtagcttctcaggtcattgttatatgagtatttgtctatttttctgtcatgtgtgatatacatagtaaatacatgagtggtagattcatggtatagcatatatggaatttatatgtgtctatatacgtgtatgtgtgtatctatatacatatatattctctctaatggtacaaaggtataagtcttctagagatctacacattagttttatctgcaaagatattttaaatcaaaatgaaggggtagcccagagagacagcatgttctaaattaaatgaaggaaggaaagcccagaatggatgttcataacaatgaccatgaaatattgagaaaaggttcaatgatgttctgcacacattgttacaccagtaggcaactgtgttattgtattaaggacgttggtgcataacatgttacccttctcttagaacatagaccttgtcttgatgctacaggtgakyacccagatgaggcactgctgtcttcatttggcatgtatcagcgattctcaccccaggcatcacgctcccagcttctggtccaaacaactagaaatgaactgcatttcaaaaatgtgttctaggctggatgtggtggctcacccttgtaatcccagcactgtgggaggctgaggcaggtggatcactcaaggtcaggagtttgagaccagcctgaccagcatggtgaaaccccatctctaccaaacaaaacaaaacaaaacaaaaattagccgggcgtggtcgtgcatacctgtaatcccaactactcaggaggctgaggtgggagaatcgcttgaacccaggaagcggaggttgcagtgagctgagatcatgccactgcactccagcctgggtgatagagtgagattctgtcctaaaataaaaataaaaataaaaatatgttctagaaggtagctctgattcttagaaagttcttccttaccttcatcccaaactttgtttcctttgtctgcttttacaaaatcaacttgccatgcaatctatctgatggaatacagtaacagaggactcttttgcaaaacagtccatctcaggtttaatcatttatgttcctctacttcttggaatctctgtcaggtttttgggttaggtgttgtggtcttaacagagttcatggttcttgcaatatgggcagggtgcctgcacatggatacagcagttcacagtcactgtgagacagttatcttattgagatgtttttgctttatggtttgcctttaagttatcactgtcatattacttaggatctttaaaaacaggttttttgttttttttttggagatgaaatctcactctatcacccaggctggagtgcagtggtgcaatcccggcttactggaacctcctccttccaggttcaagtgattctcatgcctcatcctcctgagtagctgggattacaggtgtctgcccccacgctcggctaatttttgtatttttagtagtgatggggtttccccttgttggccaggctggtcttgagctcctgaactcagatgatccacctgcctcagcctcccaaagtgctgggattacaggcgtgagccactgtgcctggccaaaacgcaggtctcttaagtgaaaaatgtttgcggcacttgctggctttgatgctgatttcctttttatacgttttatgttaagtaattctttcgtctgtcaaatgaagacagggaatatagaactgaagagaacagggatgtgcaggctctttcagcttttgcacttgacaatgagcattttgaaatgaagactgtgaggcaaagggttctctgagcagacatcagtggtttctttaattattcaagcaatgacttcactctggccaagttgtgtatttacggcagaagagaacttattgaattttcagtgacagcatacaaaacaggtggctactaaaactaaatttgtttttgtgcaactattttgtaaaaagtactgactgggcagggtggaaggtgagccagctttcctccagcaggtggggaggcaaccataacttatgtgttcattaggacaaattccctttggggtggccctgtggtcacgttggccacagtaaatgagggtgtcctttaaatggagttagctttgttgaaagtcattgttgattgtgcttggtaaggccattctaattgccttatratgttgccacctacagtcattgaagtcaacaagagagacatagtcttcctggtggatggctcatctgcactgggactggccaacttcaatgccatccgagacttcattgctaaagtcatccagaggctggaaatcggacaggatcttatccaggtggcagtggcccagtatgcagacactgtgaggcctgaattttatttcaatacccatccaacaaaaagggaagtcataaccgctgtgcggaaaatgaagcccctggacggctcggccctgtacacgggctctgctctagactttgttcgtaacaacctattcaygagttcagccggctaccgggctgccgaggggattcctaagcttttggtgctgatcacaggtggtaagtccctagatgaaatcagccagcctgcccaggagctgaagagaagcagcataatggcctttgccattgggaacaagggtgcygatcaggctgagctggaagagatckctttcgactcctccctggtgttcatcccagctgagttccgagccgccccattgcaaggcatgctgcctggcttgctggcacctctcasgaccctctctggaacccctgaaggtatggtggtgatggcttcagacacacaatggggtggtctccaggcagggcctttaagaacaaaacaaaatgaagtgtgtttgtgtttagctaagagacaacaaatgatgaaaacagcagcaacgaacatgatttattccaggtttccttttgcactgggttcaggattgtatggtttacaatgtcatgcaatgaaatttcatataagaaccatatgatttaaaccacaggaccatgggccaccacctgtctttgaagcttctggccgaggaggtcacatctcagttcttatcgcttgtcagatccctgtgttcttctgtttctactggtgatttctgtccagtctcctcctcatcaccaggatgtagctttcctttcctgagttgtccatctacttctaaacagccccagtctgagctgtttagggcacagtgtcctcagcttttaatccctctcttctctctcgttaagggattaccctcaatgggaaagcatattgaatggctaagtgtggagttcaaacctagtggttcttcaaatccctcatttaatatgattgccagtggagagttatttttaaagacattatacagatctatgagctaatgagttgaagaaatacaattcactgcccttaatgaagagaagatgagcatcacagaatgatgctttcccaccttgcagactcgatcactagaggattgcctgatgcaggcatgacccatgctgcctggatgcatgctttctcttcacactccctggtcttctatatccatctctttctctctcttttaaaatttttcttaaaacttttaatccacactttcatagccaaagttcaacttaggatacaattagttgtgaggtctaaattacagtagggcatcagggaagaaataaaaaataaaattttaaaggcacatggtaaatgtgttgggtcaaatacactattttgagaattatactttttattcttgatgtgtataagtttggccaagcctagcaactagtctccttctattttgctgtgtatttacggtcccatcatctcactttgggggaattcccctgttggatgattgcctagcaagactgtgacttcctaataggagaagagtcccagtggagaatgacaaacggggaagtctgaagaagacttcaatatgagaccagcctacttttgctattttttttagccttaaggaactcgttttctcaggttagtgagggctaactgcttctgagctatggatggaagaccctctgtttgtgggtagaggtgagccccagaggatccagccaggcaaacttaaacctggctgggatgagtgatatggactgatgcagcaccttcatagtattcatttttagggaaggagtgtttggtttcaaggattctgatcacttttgttgtctgtaaacattctaactttgatgttgtagctctctttgagccaacttggttttgtaaactcggctaccaatatgtctcacaaacaccagccaccaccagaggaaaatatgcagccatctgccatattttacaagatggacatgctttgccatgctgactttctctgtgttctaaatgttggcatgtgtgcacgtgttgtaggcacacatgataaaactctccgtggttgtgtatgtctcacttttttttctgtgcttcactgcagttcactcaaacaaaagrgatatcatctttcttttggatggatcagccaacgttggaaaaaccaatttcccttatgtgcrcgactttgtaatgaacctagttaacagccttgatattggaaatgacaatattcrtgttggtttagtgcaatttagtgacactcctgtaacggagttctctttaaacacataccagaccaagtcagatatccttggtcatctgaggcagctgcagctccagggaggttcgggcctgaacacaggctcagccctaagctatgtctatgccaaccacttcacggaagctggcggcagcaggatccgtgaacacgtgccgcagctcctgcttctgctcacagctgggcagtctgaggactcctatttgcaagctgccaacgccttgacacgcgcgggcatcctgactttttgtgtgggagctagccaggcgaataaggcagagcttgagcagattgcttttaacccaagcctggtgtatctcatggatgatttcagctccctgccagctttgcctcagcagctgattcagcccctaaccacatatgttagtggaggtgtggaggaagtaccactcgctcagccaggtaaacctcccctgttgccgggaactccctctccttcctcagacaccaccctggagggtagtttgccagtctgaactcaagagcactgtggactgtacaaagacaattggctcccttccattgaaatagtttgaatggggacttgagacactgtaccagcaaggctggactctgtctaaagggtgttcacgaaggaaagtctagaacatccagcttatgttctgtccattttgcctcaccctttattcagaaggattttttttcctctaatgactgtgaggattctggagttcgaatccagatttggggatcatggggtggagggagacagagagagatttttcttacatgaatatgccttgggattatttaaacgttgaaattgtatttttacatgatttttaaatgttcaacatctgctgtatctagaaaattatttgttataaaacaaacaaagggtgcatcttcatgcaatggtaaaatggtttctaggggaaggctaacttattattattattgcaaattattatggtggtaagatatggttgtatcagatctaccagtctgctaacatcacacagatgaatggcaagactaaaccaattgaaacctaatcaaaatagttctaagaactgttttaactgagaatgttatttacattacacattgcggtgccatagggcctgtcatctgtgtttcctattgtctcattacaacagattgggaagcattgacaaggagcctgacccacacagcagtaatgggcactattgtgggtcttggcccgtaacctcaaatttaatgatttgatcattcaattacagcagattcatggcaacccagttatctttgagtggttgacccatatcagccccccctttttttttctagagattgagatcaatttttttaagcaaaggtatattaagggccatgttttcaatacttttatttgtaacagtttgaaactgctgtctgttttcctggagcgattgccacctgatgtaagaacacaacccagtggggcttttccctggcttgctttattgaagaagcatgatgctagatgggataggctgttctagttactagctttgcaaatatgcactgatttgaaataggacattttcaagacaagtggtatgaatttgggttttctcttctcttgctggcacagtggtcatcagatgagtttcaccaactcctgttgtcaaatggtgctgggctgaagtcgctttggttcctgttatgctctcgtccctcattgtatcctaatctaccttcattgcagagagcaagcgagacattctgttcctctttgacggctcagccaatcttgtgggccagttccctgttgtccgtgactttctctacaagattatcgatgagctcaatgtgaagccagaggggacccgaattgcggtggctcagtacagcgatgatgtcaaggtggagtcccgttttgatgagcaccagagtaagcctgagatcctgaatcttgtgaagagaatgaagatcaagacgggcaaagccctcaacctgggctacgcgctggactatgcacagaggtacatttttgtgaagtctgctggcagccggatcgaggatggagtgcttcagttcctggtgctgctggtcgcaggaaggtcatctgaccgtgtggatgggccagcaagtaacctgaagcagagtggggttgtgcctttcatcttccaagccaagaacgcagaccctgctgagttagagcagatcgtgctgtctccagcgtttatcctggctgcagagtcgcttcccaagattggagatcttcatccacagatagtgaatctcttaaaatcagtgcacaayggagcaccagcaccaggtatggtagagaaatgctagttgctctgccactcagttctctaatgcatgagttgagggtaggctgctggccactggtccttagatagaagccctccttgagtttacaggaaaggtggaaaattaatcacctgctggtttcagcaggaacaatagaatatgagatgtccctccttactttgattctctagctgctctctcaggagaatgagggtgagtatttttaagggcattagattatttcatagtaagacatgttataaagatttagatatcagtggttaaaatccttttttaaaaacagtttttatggtatgcataataaaagccatatcatatggttacattgtacctaaaacagccttcatcttcatattcacccaatgcctttatattgttataattccttcattacattcattaaaaattaaaggagtagaagaggyagataactttccaccataaactctgcattaaaatcccccaactgctaattgacactgccatgacttttcatttaacccctttaatttagtgataaaaatgcagtgaagagagtaatttcccctgtatgccttttgatgaaaaatgaagactccagagcctctcctttgattactgggcccattggccgttggcttgggatggtaactccgacatctgggttcygtttcctcccattaacccacttgtgactygcagcaactcaattgaaacctcccatcgataaaatgctagtggttgtgcaggtgctgccatctcatgtctctcctcccatcccaagttttttcttgaatacatctttgaaagctaacaatactcttcaagcattgaaaagttccaaaataaaaggggtccctatattggtgtattagtttcccattgctgttataacaaagtaacacaaatttagtggccaaaaacaaaacaggcygggtgcggtggctcacacctgtaatcccagcactctgggaggccaaggcgggcccattgcctgaggtcaggagttggagaccagcctgaccaacatggtgaaaccctgtctctaccaaaaatacaaaaattagctgggtgtggtggcgggtgcctgtaatcccagctactctggaggctgaggcagaagaatcacttgaacccgggaggcggaggttgcagtgagctgagattgcgccactgcactctagcctgggcgacaagagcgaaattctgtccaccccccgacccctccactgcaaaacaaaaacaaaaacaaaaacaaaaatccttattatctgacagttttgaaggctggaaattggaaaccagtgtygctaagctaaaatcaaggtgtcaacaggctgtgttctttctgcaggttctaagggattcttcatctgctcaccttttccagcctccaggggctgcctgcattccttgcctcctggccccatcctccatcctcattgccagcagcttggcactttctctcctctctgacttctgtttccatccttacatcttctctctaactctgaccctcttaccccctcttataaggacacttgtgattgattacattgggcccacctggctaattccagggtaatccccccatccccaaatccttacctgaatcacatctgcaaagtccttttctcaagttcggggatttggacttggacatccctgtgatgctcttatgcagcccacctcgttgatatgaaattgctgctctgatgtcctgtgtgagttaccaggctgtcctcctcccagtttcaggtgaaaaggacgtggtgtttctgcttgatggctctgagggcgtcaggagcggyttccctctgttgaaagagtttgtccagagagtggtggaaagcctggatgtgggccaggaccgggtccgcgtggccgtggtgcagtacagcgaccggaccaggcccgagttctacctgaattcatacatgaacmagcaggacgtcgtcaacgctgtccgccagctgaccctgctgggagggccgacccccaacaccggggccgccctggagtttgtcctgaggaacatcctggtcagctctgcgggaagcaggataacagaaggtgtgccccagctgctgatcgtcctcacrgccgacaggtctggggatgatgtgcrgaacccctccgtggtcgtgaagaggggtggggctgtgcccattggcattggcatcgggaacgctgacatcacagagatgcagaccatctccttcatcccggactttgccgtggccattcccacctttcgccagctggggaccgtccaacaggtcatctctgagagggtgacccagctcacccgcgaggagctgagcaggctgcagccggtgttgcagcctctaccgagcccaggtacgcagggaactctttgcatcctcactcagtgtcattgtctggggctacttgtctggactgtgggccacaaggtgttctcaattttgcttttcctgccatgtgaagtgaaaactaaaattacaggaaaatttaggaacccacatgccctttttggcctcgatgggcagaaatggcagaggttcaaggggggagatgctaagattcatgttttggggcaaattaaattctccaaaagggacatatgtgcagcttggaattcaggactccttaactttgcatgaaagcttctgtctagatatccaaagggaggggccgtctaactgataacgcctgttgcgtatcagtcctgcgacccctggtaggtttggtcagcagccttctgtgaggcaggaaggagtctgaccagggacactctgcaagctgggacatagactctgaaatattggtatctccagagccaaggtgtgaagataattttgactttgcttggtgctgagaagtgtcttaactggcaggaaggccacctggctcttatgaccatagtttattctattttctttttcctgttccctctttctaggcctggtacaataaactaaaaaatggtgggagccctggtgctgagaaggaaggaggaaagatatatctacctctcaataaatgtcctccaagggccactctcccgggtcactcgggtggggggggttcacagtggcgaaggaggcagatgcggccttgctccctcatatgcactcacttgcctgctcttccaagaggagagaaaagaaggaaagttggggaggagcggaggaaggagtaaaagcaagtgaaaggaaatcactgcaggatacagtgggtgatgagggaggtgaggatgattatttgggtgcaactgagaggggcttggtttctcctcgctggtgcctggggaagagagcagtgtggcccaccaggtttctgtgggatgttcctgagcatttatgatcaggtaaatttgggcaacagtgggataaacaaagtgaaagaggctttctttcttcctaactaaggcgctttgtgtgtctccaacacaagaaaggaaatgcaacatttccaaaatgtatctgcctrcaggaggcctctgtgatgctgtgtcttggccccagattgccgaggatggactttgggaatattgtcacagtgcgggtgcagcttctgttgtcaggaacgtacatttccacaacgctgtggctctttgcccactcactctcctgcgctccagaacagcctccctctttcccccttctccccattcggaggcttctctcacacctctcctgacccacctgactctcagctggtaatcttgagtcctatttctccaagaaaatgcaagtaaacccaaagagagctgtccccggccacgtcatcccgtggttccttgggtggcctgtctccgcttcctcagctccctttcctctcacctgctcagtggcaccatctgcagttccctttcttgctcttgtgtcaccctttctccactgtgctggatggttccatccatgataaaatgcattgcttcttctctcttaaacaccctctctgatgcgccacttcccctgccagcagcacctgtctcctaaagacttatctatactctaaagttcctttcctcccatcctctctgagcccaccctactttgtcattcacccttgctcctcccccaagtgctccagttgaggtcactccatctgacaaggtccctgtctctggcgaagcccagtggctgaccctcgggtccctgagcagcacctgatgcagtgcaggtcacgtccttcccaagtaccatcctcgctggtgctgatgaggctcttctgattctgcctccgtcgggtttttcatcctttgctccccttctctttgatgtgtaaacactgaaatgcccaggactcccacttcttggacttttaacagtggtgattggtgttaggatcccctgcctgtgaatccatgacaaactgggcggtggctcatgaacgctaagaatttggtgacgatgaaggtgaagccatgctcacatttgtttcgcaggtgttggtggcaagagggacgtggtctttctcatcgatgggtcccaaagtgccgggcctgagttccagtacgttcgcaccctcatagagaggctggttgactacctggacgtgggctttgacaccacccgggtggctgtcatccagttcagcgatgaccccaaggtggagttcctgctgwacgcccattccagcaaggatgaagtgcagaacgcggtgcagcggctgaggcccaagggagggcggcagatcaacgtgggcaatgccctggagtacgtgtccaggaacatcttcaagaggcccctggggagccgcattgaagagggygtcccgcagttcctggtcctcatctcgtctggaaagtctgacgatgaggtggacgacccggcggtggagctcaagcagtttggcrtggcccctttcacgatygccaggaacgcagaccaggaggagctggtgaagatctcgctgagccccgaatatgtgttctcggtgagcaccttccgggagctgcccagcctggagcagaaactgctgacgcccatcacgaccctgacctcagagcagatccagaagctcttagccagcactcgctatccacctccaggtgagatgggggcgtcggaggttctccttggagcattttccatatgaaaaataacaggctcaaaggccatggtactcataataaattaaattaaaataaaggttgtatgcccttacctttatggtttttattttgagacagggtctggctctgtcgtccaggctggagtgcagtggcatgatcataactcattttaacctctgccttctgggatccagccaacctcccacttcagcctcctcagtagctaggactacaggttcataccaccacgcccggctaattttttgtattttttgtggagacggggtttcaccatgttggccaggctggtctcaagcccctgagctcaagtgatccacctgctgcggcctcccaaagtgctgggattacaggcctgagacaccgcgcccagcacctttatgttcttcatgcccaccagccagaccccaccaggacacacctgcgactgaacaagttgggtctattgctcatggcatccagggagaatgcataccgtggcaaagcatgagggcatctccataggagggtggccggaaggactggggggacttgagctagtggcaggtcattttgtggaaggcttaaagaaatggaactgtggcctggattggatgttgtcaagacgtggaggtgattctgtagctgtatcttaagtcttacctagaagcaggatggccttggtatagattggtagagaagagcagtcactcttattaaccaggacagggagtgtttttgtcctttttgtggtttgcaccatgtttttctttttgtctgtgttcagatagggttacaatgtggtctcattttcatcttgccccattgtgatcacagagtagccttgtctgttgtgggggtcctgtgagatcatgtgtgctcaacaggagarccccaaggccatgtgtgctggaccagctccccaatgcgggggctgattctctctttcttaaacagctccatcacaagagctgctcagcttccactatgctgcatttacaccgtaaattgcccaattgtgtatgaggcaaagggcaggttgaaatgtgtggagtagcaacatacaagtttaataaaatagcatctgaggagtacctaaaattctaactaataggaaaatgtggctcatctttctcaggatcttttgattaattttattgttaaaaatgcactaggctgggcgtggtggctcacgcctgtaatcccagcactttgggaggccgaggtgggctgatcatgaggccaggagttcgagaccagcctggtcaatatggtgaaaccccatctctactcaaaatacaaaaattagctgggtgtggtggcacacacctgtagtcccagctactcgggaggctgaggcagatgaatcacttgaacctgggaggcagaggttgcagtgagccgagattgcgccactgcactccagcctgggcgacagagcaagactccatctaaaaaaaaaaaaaaaaattaaaccagttatttaatagaattaaatatttttaaaaatgcgctaatgtaaagaaaatgagtcagggtgggtgggggaagctgggcatggcggctcatgcctataattctagcactttgggaggctgaggcaggaggatcacttgggcccaggagttcaagaccagcctgggcaacacagtgagaccctcatccaaaaaattaaaaaaaaaaattttaatgaaatttaaaaaataaaggcacaggcatggtggttcatgtctgtagttccagctacttggaggataaggagggaggattgcttgagcctgggaggtcaaggctgcagtgagctgtgactgtgcaactgcactccagcctgggagatagaaagagaccatgtctcagaaaaaaaaaaaagaaagaaaaggaaatagaggaataatagtgaaaaataaaaacttcatataaatgctagagatgtgtgagcaaaaaggaaatacgagggcacaaatgcctggggagcattaatgtgaccccttggatatggcactgtgttatacgtaccctgcccccatgggctgagattgcgcagcatgctgggatggtgttgggctcctcaggggtctcacttgctaagtgatggccttggacaaggcgagaacctttggcctcagctgtttctcttcttgtacaacaaagatatagatcccagtggccttggtctcttctggtagcaacagttcatgattctgtagattayggtagcccaagattgatttctaaatgctccttacattttagaaatcagtagtaacccagaccacaatgccaaaatttaaatagagtaaattcagaaagacacgttttggataacttcaaatatttcaaggagcagaaattgttttggtgtaaaaggtccaatttttaacggctaatttcaaaaagcccgagatacaaacaacacaggcatcttgggatataatcttaaggttgattaggattatggtgcaaggtgcacaccaaacctgggtgagggctacttacacactgaatgtttccctttttcttctttgatctgcagcagttgagagtgatgctgcagacatygtctttctgatcgacagctctgagggagttaggccagatggctttgcacatattcgagattttgttagcaggattgttcgaagactcaacatcggccccagtaaagtgagagttggggtcgtgcagttcagcaatgatgtcttcccagaattctatctgaaaacctacagatcccaggccccggtgctggacgccatacggcgcctgaggctcagagggggktccccactgaacactggcaaggctctcgaatttgtggcaagaaacctctttgttaagtctgcggggagtcgcatagaagacggggtgccccaacacctggtcctggtcctgggtggaaaatcccaggacgatgtgtccaggttcgcccaggtgatccgttcctcgggcattgtgagtttaggggtaggagaccrgaacatcgacagaacagagctgcagaccatcaccaatgaccccagactggtcttcacagtgcgagagttcagagagcttcccaacatagaagaaagaatcatgaactcgtttggaccctccgcagccactcctgcacctccaggggtggacacccctcctccttcacggccaggtatgcaccgtgtgacccatgactacagagtgtgacatcaacattttttttttagttaaaaaagtaatcagtagtcatttttaataattttcttctctctgggttgtttcttcagataatattagaaattaaatactggaaaagtagttccattgaaattgcagaaggaagcatattattgatcttccatcactcctgagactaatcatagccccattgaaaggttctgcagtgttgcactgagataattacaaactcattggctctcagaataggatggcatctttgaaatcagccagtccatgccccactgaatgtgactttgaagttggcccatgcctactggccagatgcccaatatagtccaggtcccctcattccttggcctggtgggaccatcagggagcaccttcctggaagacttgcagtcgtccacctcagcttctaccccgtgctcctggttctcgtctttggggctgcaaaagcaaagtggatctctccaccagcccatatttttctttgtccctcctccaagtaatcgccatgtagacatctgaagcaaaccattagggttggttcttcaaaggggagcagtatgcctgtttccctagctcactgctccctaccaggctgcctgtggcacatctcacatccctcacactgtctctcatcctttctcctctctattccagtctcagttgcttaattataatcaagaaattaccctccacaccactgatattcagccagctcctacaaagctctcagaccatcatccaaaggttaaggggcctcttcctattttccaatctgtttctcctagtccttccttgctttgcacctcacacacatctcttcacttccaggaactatttaaaattcttgaccacaaaggaaacttctagtggcatttcctaaaacacttgagatcacaaatgtcaaagccaggtccctattgaattcttgtcacaatgccattttgcacgggataactgaagttctctgtcactgagttttcacagagtgtgacatcaaataatttttctcctttcctttttgtttagaggatttatcattcatcttcttgtatttagcatgtttgggagctgcaaattcaggaactacaggctaaagaggcatggatttgagtgaaggtttcactgtgaataaattattaggaatgtcttatttcagttatttaattttaccttttgtgtatttatgttctgggtctggaaacctaatctctccttattttcactttaatcacttctagagaagaagaaagcagacattgtgttcctgttggatggttccatcaacttcaggagggacagtttccaggaagtgcttcgttttgtgtctgaaatagtggacacagtttatgaagatggcgactccatccaagtggggcttgtccagtacaactctgacyccactgacgaattcttcctgaaggacttctctaccaagagrcagattattgacgccatcaacaaagtggtctacaaagggggaagacacgccaacactaaggtgggccttgagcacctgcgggtaaaccactttgtgcctgaggcaggcagccgcctggaccagcgggtccctcagattgcctttgtgatcacgggaggaaagtcggtggaagatgcacaggatgtgagcctggccctcacccagaggggggtcaaagtgtttgctgttggagtgaggaatatcgactcggaggaggttggaaagatagcgtccaacagcrccacagcgttccgcgtgggcaacgtccaggagctgtccgaactgagcgagcaagttttggaaactttgcatgatgcgatgcatgaaaccctttgccctggtgtaactgatgctgccaaaggtaactcccattatgtgcatattttccatcctttcctgttgacatttgtgcctctttagctgtctggtccctggtgctgacctctggagtccttaggcatttggttgcttcatacatttacttatacccactgggactggtcctgacacccacctcaccactacctagggcgttcttccaagacaagagtagaagtctatcatattttgcttttataagatttacttttctcccctattccttaatccctcaaacaattcagatttattgattcctgtgtctaattatagatttattagatcaagtatttgagatcagaatatttgattttcaagtgcttttaatttaaagcacaaacttggggtgcatctaaacaccagtggtgtatcatcacaccaaagttaattaacaccaccaacaaagctgactttttaaaatagcttactatttggcacctaacagctaccctcatttctctctgtgagaggggtggatagaattkcttctcaaagctcacacacacaggatctcattttgcacttgagtgcgatgccctggtcctctgcctgggttgtccctactgctggtataagtagagttcgtctcctcagccccagctgagaactcatcacctgcatttctcctttccagcttgtaatctggatgtgattctggggtttgatggttctagagaccagaatgtttttgtggcccagaagggcttcgagtccaaggtggacgccatcttgaacagaatcagccagatgcacagggtcagctgcagcggtggccgctcgcccaccgtgcgtgtgtcagtggtggccaacacgccctcgggcccggtggaggcctttgactttgacgagtaccagccagagatgctcgagaagttccggaacatgcgcagccagcacccctacgtcctcacggaggacaccctgaaggtctacctgaacaagttcagacagtcctcgccggacagcgtgaaggtctgtggggccagttggttcaggtgctccctgggaaatttccaaatttttactggaaaggaggaagcccttcccccaagttaaatcctcttcatgtttcactggattgttagtgtctatatggaaaatcccttagttattaactgatctaatgtcatgtactgtcttcctcattttggtagtcttacgtaagctctaaaagaatcctggaaatcagtagtttaacttgaatgagttgaatttgtgattgatttatgtttaattatagtccagtcaggtacgttctccactttcatttctctgtgtgtatgtgtgcatgcatgcatgtgtgtatatacatgcatatatattgtgtagacacacacaccatgtgagtttgctagggatcatcatgaagtactacagcctggcgggcttttggaacagacatttattttctcacagtcttggaggcttgacatcctcgaggtgtcggcagggctgtttctcctgagtcttctctgcttggcttgtaggcaggggtcttctccctgtgtctccacatggctttctctctgtgcatgtctgtgtccaaatctcctcttctaaaaggacatcagtcatactagattaaggttcactctaaagatctcattaaccttaattacctctttaaagaccctatctccaaatacagtcccattcttacggtactggggtttaggacttaacatacaaattttgaggggacacaatttagcccataacacatgcacacatgcacacacgcacacacacccacagacatgcacccacatacatgcacgcacatgcacccatacacatgcacacacatacgcacccacacacatgtacacccacacacccacacatgcacacacaatgcacccatacacacacatatgtacccacacacatgcacacacatgcacgcacacatgcatgcacacatatgcatatgattcgcagaaactacatcttagaaatatgagaatgagataaaaattgtttttattgtcattgctgcttgtcttttttaaaataaattaagcactcaaatatactcctccattttaagtgcaatatcaaagtcttgtgaacatgggtaatcattcctcaacttgggccctcagtttccttaagtgtaaaatgaarggcttgagacagcgagtctctcagttttctatcagcagtctgcaacactcctttttagttttcctgggatttgacagctctcttatctgcaggtggtcattcattttactgatggagcagacggagatctggctgatttacacagagcatctgagaacctccgccaagaaggtaggtgccaaggctttctaaatatgasaagtaaaccctggtgaggcggggtgtactgctctgctggagagaaacctctctgctaatgcagcgccccaagggagcagcgttgtcttgggagactcttcctcccagcgttgtggcccttcatcacctgcttggagctgtgggatggagctaacaaaaattccttctgtacttagacagctttactgttgtgttgtggctgttcaggtggtagaatgttcagaaagcatgatgcttttgcaaaagatcatgacgtattgattcatttaacttcatcacataaactaggaattagttactaataaaaatacattgctctatttttggtttgcagttatcacagttcaacatttaataacactacacccaaataatacaaagaaaataatgtaagcaatgacgtaccaaacataaggtgacagccatgcctattatcagatgtgatctttgactattcacttgctttggcgtttggtagcactgactatcagaaagtggatgccattacagaagtgtaatttatcctaagaactttctatttattagcttacttttcccaagcaatggagatgaggctgctattatctgattttggaggtgttagtatttcaatacttcccacagcatactcgtgttacagagggcctgagtttgagaactcatgcatgaatacacttcatggatgccacttcctatatttttagtaataggtttagttattgacataccggaaacaattattcagcagagtccaaagtttgagtatttcaacaattcagagtagccagtaaacttgattaaatatatttaagttaaaagctaaattttacactgaagttttctttaaaaatgtagtcaggaaaaaaggacattgcattttccacatgcctaggtgagctgtattaaatgtgtctttctttgcaggagtccgtgccttgatcctggtgggccttgaacgagtggtcaacttggagcggctaatgcatctggagtttgggcgagggtttatgtatgacaggcccctgaggcttaacttgctggacttggattatgaactagcggagcagcttgtgagttttttttatgtctttatacacagaccagtgtagataccacaccttttggcatttcaagagaatgaagttaattatcagcaggtgaatggaggtggggggggggccttggtagatagttaaatttatttaattcacttgggaactgccttgttgccataacacatgtgaatctggaaatggagatagcaaatcgctggaaatccagcgagctggaaggggatcctgggcgcgctgaggttgtggccttagcattttctctgctcccttagcaacggcctcttttaacaccattgcagggatgcaaaccatcgagattgtccatcctccaattggaaactgtgtcaagagcatctgaaatcttgcatgataaaaacaacatgcaggaaaagaaaggctgtttctgggtggagaagtgctttaattgccctccctagtttccctctgtgtcaatgaagctccctctgaggcttcctcattctccccagggccagcctctctcagctggaggtgtgacctcctgggtttagactggggatggagcttttggaagatgtggggctgagctgcgaactcagagattctttgatggtagcaacagtggactgtggctatgagaatgggaggaatggaccttcctttcttccatacttctttgcagggttagaatcaggatttttttcctagtggaagtaggttgagttagctcacaaatctgggatatgggagaaagggaaagctcttggaagctcgttggaagaaagtgcatgtgcccaccattagtttagcagatggaaatgtatttgggcatgccctttcccacataaggtcaggggccagatgggatgagaatgtagagggtgtctgtgtgacctggagttgagaagcttttggctccgaggccaggaccacttgtgcctgctcccaccatggctgctctggaagcctctttctgggctggtaccatatcccatgactctcaccctggttccaaggaagggtggtcatggatatctgttctggaaccaccttcagtcttggccatctgccatttgcttggctttgcactttggaactggaacatatgtaagttatagttaagatctgatgatggaaacttctagaaataaggtccagcctgcagtgatattgtggataagatctattttactttggttgttctttactttcctattggtgacctcccatctgcaccccgaccgccaggagctgggccctcctgacttcgctggcaatttctatcatatcgtcagtcgtccagcaaatgtcacctggagggacttcatctcacaccgtgaaacccccacacatccgattttgacccttraagcgcatttatgattttctgctgggcatttcttgagatctgaacatttggtttctcttcctttcggtaggacaacattgccgagaaagcttgctgtggggttccctgcaartgctctgggcagaggggagaccgcgggcccatcggcagcatcgggccaaaggtayggtggctttacccttgcccacgcctgagatgaggtgtcagaagcccgacattactttggtggggtaatttctctaacagaagagtgtggagatgaaggaggagacgagagaccatttcttatgttagaaggaggagctctgaggggcagacctgcgtgctgttctgctggggcctgttccagtgaagatggttcaggcgggaccctccttttgcacaggataaggggatctgtgctttaacagcttggtccttcatttcataaaataatgttaaaggcagctggcgtccctgacagcagcctggctgcgaatggcagctggaactcatagcatttgctctgagtcagtaggaactaacaggctttcttggcagagcaggagccttagagatcctgatagagagaatcgtgacatggtgtactgaggggaaaagcagtaacagggaaagccatgctgagttttagtgctgctctgccaaatgaagggggaccacagggattcttactstagagcaaagaagaccacgggattaaacagaggacccrattactttgtttcagggtattcctggagaagacggctaccgaggctatcctggtgatgagggtggacccgtaagtaaaaattgttttagtccctaaaatttcaccccctccttgatccttacccattgggattgcattgtggatttcatcatttgttcagttgctgatggctttccctttgggagaaaaattaatttatacttttcttaacaactttgcctggatgtctaagtacgataattgaagtatgacaaatgtgggcatgaagggtgggatttgttcttactctgtttcagaaggagggattaattggtttctgagccagagggacaccgaatttgcacacccagtatctactagattaagacatgcaagtagagatgggagtgagctgaggggcagggacacagcaggagacctcaccagggctttaggggttaccccgttaagggtagtccctggaggggatgttgctggatcagatcatcagtatccgagggtcttggggatggacagaccccagtagcagggtccatgggagcaatgcccaagacagacacctgtctggggagctttgggaccctagatcaaggtccagccctgggataggggacagaggggctcacgaggaacagtgtggtcaccagggcccagccggcagggctcggctagagaactgggaatcaagcatcacttggaggagctgtcagccyggtgggtcttcccgggattcagcacccacagagacacagtgctgggggccacccacccttgccccacagggcagtgctgtctgcgctgctaccctcccagatctcattcccttcagggaaactgcaggttccaggccaggcctcatgcaggggcccaagaggctccctggctcacgtagcctcgatcgrcgttccccatggtgaaatctgctttctgctgcatgctgttcacagtaccctttacgctgctgcaagcccggcagagaaagggtgatgaagggctccagcttgcaaaatgcctttgtctctcacaayagggtgagcgtggtccgcctggtgtgaayggcactcaaggtttccagggctgcccgggccagagaggagtaaaggtgaggcgtgggtgatggggttgctagcgtggggaggggtcaggtgactygcagtttctccagatgctgccagggagggaggcgctggtccaggcttcttgacctcagcattcagcagcccgtgacctctcattggaaggcagttctgagcagggtgggttcaggagcaggggctgcagctggtggggagcctgagaatggagaaatagtttcctgtggaaacatgaagaagccaggaaaccctcacaaggagagaacatgggccagggcggagggkaggctggtgcccacggccccggccctggaccgtgggagcagtcagggaagggagtggagtgagaggacagcaggtgggttgaaggctggtgaacttgcttctctgtttgctgaagtttgaaggcaggtgctgaagggaagggctgcaaagttacaaagtcagctccttgccctgggttttggggtccacccccgccggcccagggagccaagaccacccaagcattcagttctagttttagttttaaaacatcgcacgtggtggtgagagaggaatccaaaggggtaggactctaatattacattttcagacactgcaacattcaaatggggtggagtgggggaacagcccttggcctcttctgcccgagggaccagccctgcaggaaaagctaatgcttcccctatcgccttgccttctagggctctcggggattcccaggagagaaggtatgcaagcttggttttgttttacaaatggaaaactctcccagtatttctcatttcttcctttgccagaatagctttctatacttacctgtccgccttattccctcttagggcgaagtaggagaaattggactggatggtctggatggtgaagatgtaagtgattttactctaagtccaaactgcttttggttctgaagattccagaaactaacaactcagtctgtgatagaaattgcagcaggtgtgacctttaatccttgtctttggcagggagacaaaggattrcctggttcttctggagagaaagggaatcctggaagaagggtaggtgtatttccacggtggtgctattatggaaagaatatcaacatttcatttagggaatagttattttctttcctcatatacatcaagcccgcttcctccaggcagccttccctgacctcccctgtgagtgcacccattacatcccctctcagctctgacacattacagtacattttcttgtttcgagatcacatcccatagggcagggactgagtttgttttgttataaataaatctccagtgcctggcacaaagtgggtccccaataaatattcatggatttactaaacgaatgaaaaatatgtggaagtgaatttgccttcatggtgaatgagtaaattgtaaacattgttctagttaagatttatgagttgaagaatgtgatttttagggtgagataaaaatggaaacatctagtttttagcatccacttgtgctttttctttagggtgataaaggacctcgaggagagaaaggagaaagaggagatgttgggattcgaggggacccggtaaagatttctttattgacgatttcagacctgagcctggggaagagggttgttgggaaagggggatgaaaggaagaattctacttttgaaattgctttaaaacaygttgataaaatatgtgctttgtctttttcttgcagtttgggggtttggggagatgtgttggttctcttgctaaccagataatcatttgcaagtcctgttatacaaatatctgagaagtttccaaaaatgtggtatcagggcacttcaaatttgcttttggaaaagagaagagtttgcagcttttctcattttgtgtctctgtaaaacgtttaagcaaatgagcagtacaagctagcctcttcttccagtccatcctgcctctgtggccaaggataagcaggagtgagcctggggcatcctcctccctggggaagaacgattgcacctgtttggggctaagagtgctttgctgatcccgtgattgggtttcgtaagacctgcatggatgttacctggatgggttgtggccgaagggcttgtccctygaagccttgcatgcaggtccttgctaatatttccctgaccatccagtccagtggcagctgctttccttccatatgtggctcatttccctttcccatgttgctttcagggtaacccaggacaagacagccaggagagaggacccaaaggagaaaccggtgacctcggccccatggtaaggtgctgcacattcctagactctccctgtactgagggcaagagaaaggacacacttctcggctcatcagcagccacagaggccaaagaygtggcctttaacactgcaacgtagcctaagattagcagcagagtccccgtgaaggaagtctccgtggggaaccagagtgacccttgccaagtggggcttctcagcagaatctgtgcctsttagatatttacggaaggtgcttgttaagccaaaggcttgtagaggtgggagtgtactgaagtccggtgcatcctgcaaagtgtgcaactgtcctgcagacgggctcttcctctgtgaatcgaccccttkccctgcaatgtcttgtgcagcatttcagagctagacattcttctctgcagatgagaatctcatgctaattttccccacaccagggtgtcccagggagagatggagtacctggaggacctggagaaactgggaagaatgtgagtgccattagggctttggggggctctgtgacaattcttagtgccataagatctgcccaacatgacctggtgcatggttagtccacagctctgcagtgagtgaatgtaaaaggatttctgaaacggttgttactccaatctattttcattcttataatttccctggtgcttcatctcttctctctccccaattcttgctctccccaaaaacatactgaacagatacttttaaaaataatatctttgctactttcaaatatcgggccaggtttgatccaactaaatatttaagaaacccaaatggaaatcctaatactgggggagggagggaataaggggcaagagggctgagggagttgtggatttgttgtttttgtaattatctgtgggtttttggggggatgctgtaagtgaaataaaaaaactagatttcttctttttctggcatattgcatcttgcaatttcaagacatttcagaaatgtctgtagcagaatagctccttgtatgcctaatcctcagtcttgttgaataaatgctaaagtcaaagtgatgtgaatgatctttctgaagccaaccaaaagcttccaaggtcctcgggcacagacagcatctgccttgtagctgggagaagaccagtggtgtagaagtttgtaacctctcagaggaaattcaggatgctggtgggtgcctaggggaggtctctgctcagaaatgaacagagcacaaaggctgcaagctggggctgggtgctgggaactgggccctcagccacgccctgaggggcagtggctcgttcggcccggcacttgggccagtagagttcgctggggtgaggggctttcaaaaggagcgactcaccaaaatcaaattgatggactatgggcatcattttgctttgaaaattcagaagaaaatagaaatttkgaaaatatcattttaaaatgtttgagcactatttatttatttatttttaataaattgtaaagacctggatcaactgcttggaagtgagcattatttttgaataatgctatataatgaaaaagaagctatataatgaaaaagaagaaatactcatcaaatgttacaatgggctattacaactcagcgtgtgagcagagccaaaacttggtttcatgaaatgacttaaaattgagtagttcatacaattaatttcaattctacacacaaggtagaaactggatttgaattcggtttcagtcacgggctcttgaggactcagttcttccttttgtggtctaatggcctgctatcccttcccttaggaccacagtgccaggctcaggccaagctgaaatgtgtccctcccactgggcttcagcatgcctacatcccctttctagagtctccgcaggcggcctctggcctgagcaatgtatcactgagtgctgctggactctcatggaactctagcatgtctcttttgggaggggccaggccagattgttggtttgtagaggagaacagtgtccccttgtctcaaattttccatggaaggtggccaagatcttccgctgaagcaggtggcattacagcgaataatggcaaactggtcaccgcagatcactgggctggtccattggaagtggagagtgaggttcctaggttgatgtagcagatgactgagccccacaacagagctagtcggtcacagcctctgcaacaccaaccctaactttgcaaagaccgcctgggacattcataaagtcccaccccaaacctttctactgctgaggaaacaattttgaggtggaaattaatggattacttgtgaagtaagcccacatgtttgaactaaaggtcacctctggagcatccaggaagatgttgccaagtcgtgagccctacctaagtacacgagacgtttaggtgcacatgtgtgtgcttcagatattttacttaaccgagtgtgtgttgtgtttggccgggatcacttggagaacctgggactcccttccattataattaatrtatttcatgacttctcagtacagttgggaaggtggaagaaaaatagacaggttgacattcccttttcacattcctcatttgaaactggctgggatcgtgcagccaaaaggagtcattattttgcttggcaggtctgcagtaattctcaaaacttccattgggtgattaacaggagcagcaaggaagcaaaacttcacccggatgagggtggaggaagggtgtctgtgtgtgcgagtttccccagggctgatgaggtgtggtttctggttcttggcacgatgtgggtgcttgggaagattcccctgagtaaccgcagaataagagggtgaagtctgaaagagctctaggccccatgcccagcgtcccatgctccccctcacagtttgtgggactttttcttccacagggtggctttggccgaaggggaccccccggagctaaggtgagcctcatgcagtgccccctggagactctcttcaaacagcccagatgccgcccagcccaggagtgaaaaacactctctcctgtgaacccaaagcttcggagacagataccaatcaatttagaaagttgatttcgccaaggttaaagacatgcccgtgacacagcctcagaaggccctgatgacacctgcccaaggtgttcggggcacagcttggttttacacattttagggagacatgagacatcaatcaatatgtgtgagatgtacattggttcggtccagaaaggtgggacaactcgaggcaggggaggaggcttccaggtcataggtagataagagacaaaaggttgcattcttttgagtctctgattagcctttcactgaatacacagtttaccagaacagtcacctatgccttagttaggcttagtgaaaaacagggcgaaggaagcaattggatatgcctttgtctcccatgagcagagggatgactttcagttctgtctgtcctttgtccacaaggaatttccctgtgggcagaatgtgagggaggtatkcagcttaaaaaaaaaaaaatctggccaggacggtggctgatgcctgtaatcccagcactctgggaggctgagacaggcggatcacctgaggttgggagttcgagactagcctgaccaatatggagaaaccccgtctctactaaaaatacaaaatagccaggcgtggtggtgcatgcttgtaagcttgtaatcccagctactcaggagcctgaggcaagagaatcacttgaacccgggaggcagaggttgcagtgagccaagatcatgccattgcactccagcctgggcaactagagtgaaactccatctcaaaaaaaaaaaaaaaaattctttgtagctatcttatttragaatagaatgggaggcagctctgtctgatgcagttcccagcttgacttttccctttggcttagcgattttggggttctgagatttatttttctttcatcctccttgggctgttctggctcccgaggctctgtcagccgtctccttaaacagcctcttctgcagagtctagagaaaatggtgcccagyggggacttggggtccaagtgcaggaaacatgactgaggcagtagtgtcccgggcgggcgcctcttccagaacgtgctcacctatctggccatcagcaacccgcaacttcccggtgtctcggtcctctgctttaggtctaaatgatccctgtttcacaaagctgtccgaggagaggtgaggcaagagtgagraacaattgtagaagtgcagggagacagctggctcctgtgctcagtgtctcacctggggttaccgctttgatcatctgttacctctggaagagctgagttttccctggttgctttccaagtccctggcccagaaatgactgtagagcaaagagctgacattgacaggaaccatcctgactcctccctgcatcttctcttatttcaaagggcaacaagggcggtcctggccagcygggctttgagggagagcaggggaccagaggtgcacaggtgagtgcttccgtgtgtgactgtgtgccctctgatatytcacaaatcatttaaaaaatgattgggtggcatttatatccggaaagttaaccattttaaagtgaacaatccagtggcatttggtacttccacaatgctgtgcaatcatcacctctatctaggttcaaaacacagtctcgaaggagacctgtacccattagcagtcactccccatcaccctccaccccgagtccctggcagccactaatctctctctctttatggatttgcccactatggatattttgtataaatggaatcatttactaggcagctttgtgtgtgtggcttgacggagcatcatgttcttgagcttcatccacattgcagcatgtagaagcacttcattcctttacatggtggaaggatactctgttgtgtggctacagcacactttgtttatccactcattggttgatggagatttaggttgttgccatcttctggcaattgtgaatgatgcttctgtgaagattctcctacacgtttttgtctgaatgcttgttgcttgtatacattttaagctcacttgcctattcacgatctggattgaggcagctgctactgcagctaagacaggataattgtgggttttggtggccrtttttggccagcagaagtgaggttccaggccctgtgggatgggcagatgccatgcagaggcttctcatggaaagtcacctcattagcactcacgatggtcttttccttcctcagggcccagctggtcctgctggtcctccagggctgataggagaacaaggcatttctggacctcgggtaagcctgtcctaataccagccccctctctagctgaacagagggcacattkycaagcaggctgagagagtttctcggatgatgctattgtagacagacctccctttagctctcctctttggcaacaaaaaccccagatttaacctcaggccttgcagtgactggctacttcaccccaagaaagtaagagtttccttttttggtgctccatgggcctctaagtctcaattctgctccttccaagtgtccctgggtggaaatcaggggatatgcctcaggatggaatcctggaaaatctaaatctaccaaaatgcttagattctgcaaggtgtttcacctttggtccctggagatagccccttgtgcttatgtattttgtatagtgagtgcctcaagttcacccatgagttcagcacagaagatggcccttaaacttgctgtgactgcagatgttatcttgcaatgcagctatcagcaatgatgagcagagacacactgtcattgctgggctaggatcaggtgtcacggaattacrtattcgggtttccctcatgkctgagatgatattgagggaggcatcctatcatttattaccaaaaaatgactaataaactggtaacgagctcaatatgttgctacataaatgtacaaaaatattttatggtggaagcaggcaagaacttgcttagaaagtccttctctagcttgaaagctgayaaatacatatctttagacgtttttaaaaaacatttacttaacttgtaattaatcaacaatttaagatggtatagatgcaaagctattcaaatagttatccagtagctccagaaacatttattaatttgcactttttcaccatctcttttatgttatttgtgggttgsgtagactgtaccacattttaagagttaatttcatccatcagtttattcattcacctaacaggctttaacatgcccatatgtaccaggtgctcactgtgagggtgtgaaaagggaggcagaataaagtcacataaaatctgggagcttgccgtcctgtcaggaacctaggatatgtacattaataactgcaacatgcattaatttgtgaaaactggcactgagaggtaatactcatgttttaaatttgtgcatgccatttctgtgcatgtttatatttgagtccgtagccccgtgctcagagctgagtgcttgggatttgcaggtgggacaggttccatgcccctggcgggctctgacttccatgcaggggagagtcaggtttcagagaccaatttgcctggacggttggccacttcactgacacattcctcccctcctgctccagggaagcggaggtgccgctggtgctcctggagaacgaggcagaaccggtccactgggaagaaaggtttgtctttagaaaggtagagctttcctgaggacagggaccagccaggcacacatgcccctctccctctttggtcagtctgtctgtccctcctcttyagtactactggttcccactccagcctcccctgttgatcgcggcttggccagtggaatcattgtcccccaacaatccccaccataattcccaccaccatccctgccaccaaccatctctgctcagagggctggctttctcctggccacagccctccatcagctgccaggttttctgctcctctcttgcttggcttgtgccaatagtgcagcaccctctgagccatcagagcagccgggcagtgcttggtacagtttcagtataatatggaacgagcagtctttaaacaygggcagtgcacgcacagtggctcagctaatcacatttagatcatccaagagccccgaccctgactgtcctggataacagcaagtctgctgtatgaaggctgcctgagaacctcctttctatcagctttgagataaattacaatttgtcataaccagtccgaaaagactgcatgttctctgtaaaagaaatgagttcctgtgaatccacgatggtctctgcctggagagtgttttggggttttatgctgggctcaatgcccaccgccttccrtgccttcttctcccagttgttactctctcttctcatcagcccgtcccccatgccacgctggtgaaaaggacaaacaaaaccctcctggattcttttccaggagtttgcacatgaatgttgcaatttagaaaatcattccaccgaaatctcaaagrtgaagtcagcatgttgcagcacccttacctagagcaaaagcatggcttggcatcacactgtaagccagccccaggccacagggtctcagccatgtttctcatgtctagggtgagcccggagagccaggaccaaaaggaggaatcggsaaccggggccctcgtggggagacggtaaggtcacagcgcgcttggggtcaggctgtcgctgactctttgctggaaggtgcaggaagccaggagagggttccaaataaagatgagccttgcttcttgtattattggggatacggctggaaatactgaaacttgctcatctgcggcaaattaatttaacaagttttattttattggcaggggtagagaggtggggcgggccgtggggagagacattttttcccctgtgtttttcctgatacaagagaatgtagaggctaatgaagcttaaactaccttcatcttaggtcccgcaaatgctttgcaagcataactagatgaagcttttctgcaaagaagtaaatgtcatttgggttaaaatggaattggatttgattaggtctcagtccagatggaaacaatttcttttgaatgagacatcttaggaatagaaattattacctcagtaactcgttttttaaatgctatttaaaaatgccccaaaaactcaccaacaataattttgtaatgtacatttctacgttacaaaagaataaagaaatctacggtccattgtgactttttccaaaaggagtcatggcacctaacactgtataaaaggaccaggttgatctgactgttttaattccaagcatcaaaatatttttctgtctttcatttttgtcttttcaactaactgaagtttaaaaacgaatctgtttgtattacttttaatctcagaagcacagggaaaaaatcagacttcaaaccattgaaggaaatctcttcctgattctgtttctagtaatttgggtcaacagatctctagttgttgatatctgttgaaaactgtaaattaactaagtggcaattcctacatatgttagagatagtaatgtacaattcacacamgttcttctgattcttctgattcataattaatgacgtccagttctgaatgctcctcatgagagagcaacaggaacagatctgagcatgctggggggaggtgttggaaaggagggggtctaggggtgatgacttggaaggaagggaagggatatggggagggggaatatgacctgggcctgagagatggagttcagtgttttggttttgaagtagaatcaaagacttacggatgcatagaatcaaagtaaccatcaagattcctgtcaattctaagattcttggggttgacgagtctttgattctacatccaaacagaatctttaccaaaagcaaccagcagttctttctatgttagtccgccrgtgccattttgctacgggagtcctttgagcccaccgcctacagaaatggtcttgttcacacttggaagataggacaggagcaggaagtgtgcctactcctgtaccttagtctgcaaacatttcaggagctcaaggatccacttctcaggggcagcggcagggcagagacggtggttatggygtgccaggcatggcgacctacagtcacatctctttcccactcttagggagatgacgggagagacggagttggcagtgaaggacgcagaggcaaaaaagtacgtatctgctgaggattatccaagygtccttgctgccagsaggctccaaggacaacttctgatgtgttgtgttttaaaagaattatttctttaaaaattgtctttgtatttgagtgagtgttttcktttgatgactcagcagacatttctttctttcaaggtcaatttattttasatgaatttaaattagaaccaagtattaaataatctatttttcctttatagggagaaagaggattycctggatacccaggaccaaaggtaaataatccctggtcggtgaagcatcatcatgattttgggatggctctggtatgtccatggactgagaatcagaatatcttggcattagtcttgggtcagccactcagttaactgggctaccctgagaaagacccttccttccctaaaatactctctcatctgtyaagtggaggtcataatacgtacttgtcctggtgtttatgagatttaaataaaatatgctgcaatcaaagtactctgtaagctgtgaaatgctataacctacatgatagtatcattactgattaattaaattaagaccatctgcaaataccacaaatatagtagtaacccactggaaaagtgaatcaaaactaaccacttggctgcccgggaaaagtgtgacccacacgtctcctggatgtcttaccccacggrccckcagtgagatcttctgttccaaagcttactgtgccacttctcggctttcttcccagggtaacccaggtgarcctgggctaaatggaacaacaggacccaaaggcatcagaggccgaagggtaagtttgcgtgggccttggctgcaggtgaggaatgagaacgtatgtctcaatgtgattaactgctgaggctttgacaattatccttcacttgcaccctggccagggatagcacagggtggaaggaagggaatcctgagccccagaccaatgtcctcagggtgccaccatggctgtggtccatggctctcctcctgtaggtgtattcctcttcctccaactcacctccagggtcgccagcccagctcactccaggcacagcacccacctgcagtctcraatctcattatgggtgactgggaagtctgtgcagtcactttgggccatgcccacccagacggccaggcaatgggagtgaatgaggcatggcaactgcttctgaagcctctaggcttgcaagcgagccaggccaaggccatgggctcctcagactactggtgctgagattcctcttccttaagctacttttagccctgatagctcttttctttttattctttgtgtgtgtgtgtgtgtgacaaggtctcactctgttgccaaggtctcagtctgtcatctgggcggagtgcagtggtgccatcttggctcactgcaacctccatctcctgggatcaagcgatcctcccacctcagcctcccaaagtgctgggattacatgcatgagacaccacacctggccagattattcttcaatggatgtttactcaccctcttaaaatggcagagtcttcaattagcaaattgtggcctagatctgtgtaaatgttgctaacagttattttcagcctgaaatgtagtttaaaaagaaacataattatcttattaatttgatcagtgaagacagtcaaactagatcatttaatatcccaaagagctttaaaacattggatgattatctacactgaacgcattagctaattcactgtctgttacctattctcctgggagtccttagtaatcatattagtggttcttgggaaagcacctgtcttaccttagcctggcagagaacacaatatacaacacctctatagttggtgggggactcccattggctttgttgaggttgcttgtccctaaacttgaatttaagagacattttagctcccttaaagtgagagatttttcgtggtgatggagtcccttgggttagatcacttttacygtaccttccaactataggagccttaaattctccactttctgacacagttgaacaatgtttgttctgctccctctagggaaattcgggacctccagggatagttggacagaagggagaccctggctacccaggmccagctgtaagtatttatccagttctgacccrgccacctggggctgggtgctttacacgtggtccctgaaaacttcccaccatctgctttgctcacaagaaaatgtgctctctttgtatttgcttggttgtcaaaccgcctctctgacatcatgatgcagcaaagagattttgaattttagagtaacaagaaactttaaaaaaataggtttcatgggatatcctgtcatctagggagtattgtaatttgcctttatagtttcctggcataggtgcatttgaggtttgtgtagaggagaaaccaaagaggggaaatctaaataccttttgcttgcatcttgtagaagcagtgtaattatgccaggccttggtttgacaatgcttcctgtggtctatgaaatccccaagggagctcctgatttgtggttaaatcccactagtcatgctgccaccaggagccaggagggcatcctcccacagcccttccaaacctctttattgctaatacctttgttttcttatttgaatttctccatatattgtccctcaatattgaaattggtgagtttcaaaaaataatggaaaagataattcaggagttggaaaatcattcctagaaggaaaggttcagggcttagtttggttgaattagggaaaagaaagctggtcaggtgggtctgattgctgtctttaagtaggtgaagtgttggggggagcacattaagccagttcctgcagaagaccaagcaggcagaaatagcctcctggaaagacaactaatggcccatgagatgcctgctgggctgtcagggtggtgaggtttaggcatgggacactgagggaagccacgagtcagtccctagagctcctcggggtggaattcagctgggatgctttagacacggagggagccagggcagctcaatgatctctcactgccccttcggcaggggacagcgtatcaagcgtgtgaaagggagctcttttctcaagagaagcagaatctagacccaggttcactcgtgggctttacatggattggtggtgagcttcctggtttcagaacatgagactatttcaaaggccaaatgacctcccagggaaacacatttgctccagaatcttctcttttttgctttgcaagggataagatcaggtttagagggagaggctgtaaacaatcaaggttatccaggggcccctttgtcttgctctgtgtattyctgggggccaaagcctgtttattcgaattccccatctgctgtgcctctcacctttcgttccttggttttacagggtcccaagggcaacaggggcgactccatcgatgtaagttgcatgtgtccagaatgactcattaacctcatgagcctttgatttgctctctttacatattcttttattttcttttaaagcaatgtgccctcatccaaagcatcaaagataaatgccgtaagtacatgattttctgttgtctcacaatgcatatttttacattcgaaattctcacatggtagagtagtctctcaccctttcttctctttgcttcttttctagcttgctgttacggtaagttgattttggtgactttctcctaaggaaaggaagcctcccttttgtagtaagtacartttrtctttaaccctccaccctctactttccacagggcccctggagtgccccgtcttcccaacagaactagcctttgctttagacacctctgagggagtcaaccaagacactttcggccggatgcgagatgtggtcttgagtattgtgaatgacctgaccattgctgagagcaactgcccacggggggcccgggtggctgtggtcacctacaacaacgaggtgaccacggagatccggtttgctgactccaagaggaagtcggtcctcctggacaagattaagaaccttcaggtggctctgacatccaaacagcagagtctggagactgccatgtcgtttgtggccaggaacacatttaagcgtgtgagraayggattcctaatgaggaaagtggctgttttcttcagcaacacacccacaagagcatccccacagctcagagaggctgtgctcaarctctcagatgcggggatcacccccttgttccttacaaggcaggaagaccggcagctcatcaacgctttgcaggtctgtgctctgtgcgtgctsttggcatctccctttcttctggggctctgagaaggttctcagacacgtccatgctcctttgtggcttcatgtcvcatagctcctaaaaygtccccaatgaggccatctgcctgagaacttctcttgtgaggtctccaggacaacctcgtggctccagcactacagggacgcctacatgcttgtagcactgcccccaggtccctcctcacatgttgacagctcttgccggttagtgatgctagtgttggtgacactctctatctactaacaaggtggtgtgacttgtttgctttattcatgaggacctggacgtttgcatccttcctgtctcctcccaagatggccccctgtgcacactctgagctgtgtcttactgtgtactgggcatttgcttcccataactggctggtgaggtttgtatcatcagtctcacctcatggataggaagatcctgctgttagtgaggtgctcgtgagaggctaggaccctagtccattagactctgaaacccatgtgctgatgatacccattccagtctccactctgtcccaatcggccctgaaggtgaatatccagggtggccctggaggcctgtagtctctcagtgaggtccccaaaactatgccgactcagcacccccaatytacaccacaccactgtgcaaagctttyttcagtgaggccccaagggtcagcccatggagaggccaagtgtcgcttgtaattctattaaataactggtttaawtgtggggttttttttttttttttttttttttgagacagagtcttgctctgtcacccaggctggagtgcaatggcgtgatctcggctcactgcaacctccaccttccagttttaagtgattctcctgcttcagcctcctgagtagctgggattacaggcactygccaccatgcctggctaatttttgtatttttctttcttttttttttttttagtagagacgggggtttcaccatattggtcagactggtctcgaactcctgaccacgtgatctgcctgcctcggcctcccaaagtgctggggttacaggcgtaagccaccgcacccagacaactagtttaattcttacatcaattaatatttattcagtgcagttctggcgatactgttcaagacagatgggtgatgggtaggaaggagtccacccgggagtcaggaggccttggcctggttccacactccccccacccatttaaagtaatgtgcacgccacttagcgtccctgcgtctcagatttttcacctgtaaattgagactggggcaggatgattgctaatgtcttyccttccacattggatattctatgcttttaccacagcctgtgtcggcgaaagacattgggtcatcactgccattcctcagggcttgttctgccgaacacaggatgatttgtgcatagagcgctgggcttgggaattcagtgttgaagttgggctaccggccatgtgctcttgatggggggattcattcacataagtctgtccttgtgtgggctgagggacccagaaccacgtgagtttcttagcatggtttcaacgagatcaaaaaattgttcattcattaattatttgctcattcattcattcaaactagctatttgttaaatgaataattactaatcgtgtgccaggtacggcgatagacaggactctttgcmcccactgggagtgattttgttacttgctttaaccacacctgagagggtggggaagggatggagctcccatattgttgctaaaaataacgataagattaagttcctactatttgccagaggatacaccagttactaacatttattatctaatttaaccctccaaatgacaccattaggaaggtattaccccccattttacagctgaaaaaaactgaaacccatttgaacgggatatgaactccagctcaccctagtagaataaaacctatgtctttctattatactcagagcctaaccccacccccaaatgagaagatattcccaatactgccctattgggaagttaatctattttattgatgtagctttgatttactcctctgccatattttcagatattactgatcatgtaygcccctaccaaaattgttcttttgtttaaaccagatcaataacacagcagtggggcatgcgcttgtcctgcctgcagggagagacctcacagacttcctggagaatgtcctcacgtgtcatgtttgcttgggtaagctgtttctctaacaggaagatctgctcagctgcaattgcaaaacataatatccatgggagagtgagagaataatgatgatctgtaaaaagagcttgagttyaattgattcacaaagcctcgtatttaccagagtaaatactactgcagcagtttctatattaaaaatggacctcccaaaacagagcttctctttgatggcggataattcattttataggtaacaaaggaggaggcagtttctgcttaagttttgacattagaatctagaatgaaaacattggcactagtgactttctagaacatatttcttcaaagagtggcagagaagtaatataatttttcatttcttttaaaaatgccagcacatggtatgctacaaagattttaggttagtgatttgtttcatctactaagtattaggtgatagaaactgaaatctggccataatcaaatcaaggcaagatataaattggttttggttgtgatgttttttttttttttttttttttttttttagacagagtcttgctcttgttgcccaggctggagtgcagtggcacaatcttggctcactgcaacctctgcttcctgggttcaagcgattctcctgcctcagcctccagagtagcctagattacaggcatgcgccatcaggcccagctaatttttgtatttttagtagagacagggtttcaccatgttggccaggatgatctcgatctcttgacctcgtgatccacctgcctcggcctcccaaagtgctgggattacaggcgtgagccaccgcttccggcccgcttttgatcttatgtgatcattttaatcgcccaagtctcccagcagattgatgagctgtgtatcctgctgtgggtgtcacagaacaaataggctgccatgcttctttctagacatctgcaacatcgacccatcctgtggatttggcagttggaggccttccttcagggacaggagagcggcagggagygatgtggacatcgacatggctttcatcttagacagcgctgagaccaccaccctgttccagttcaatgagatgaagaagtacatagcrtacctggtcagacaactggacatgagcccagatcccaaggcctcccagcacttcgccagagtggcagttgtgcagcacgcgccctctgagtccgtggacaatgccagcatgccacctgtgaaggtggaattctccctgactgactatggctccaaggagaagctggtggacttcctcagcaggggaatgacacagttgcagggaaccagggccttrggcagtgccattgaatacaccatagagaatgtctttgaaagtgccccaaacccacgggacctgaaaattgtggtcctgatgctgacgggcgaggtgccggagcagcagctggaggaggcccagagagtcatcctgcaggccaaatgcaagggctacttcttcgtggtcctgggcattggcaggaaggtgaacatcaaggargtatacaccttcgccagtgagccaaacgacgtcttcttcaaattagtggacaagtccaccgagctcamcgaggagcctttgatgcgcttcgggaggctgttgccrtccttcgtcagcagtaagtcctgcgtggcacagcatgtgccctggcctggctttatgctcgggccaggagaagtgtaggaacagtcatggaaaagacaaccgatgtgttgacaggaactgtttcattcattgaacagacatatattgacacctgccatatgccacaaatgcttttaggagccagagtaagcagggaacatgcagacagtatccttgttctcattgattcctttattccaccacatttgaccaagcgccacctagtcataaggcactcttggtgtccttaacagtttacaaatgggtgggcaaatggatcaaatgcacatttattacgcatgacataataggctggcatgtcgcgagagaagtgatttctgttaggggcaccggggaaagcttctagaaagagttgctttgatcggggcttagccaccagccccgtgcttggataccactgggtctttgctcatggggctccccctccctggaatgctctccaccgcacttcagcagcaaacccatattcatcttcaaagttcaattccaatggcttctgctcgccgtggaagctgctgctcccaaggcctgctcatggttaatccggacaccctatttagggcatctattacctggcctgttgatcatttatttgtgggtctgtggtcccctagactgctctttgaggaggtgcagcctattatagtttccagagcctgtgtacagtgtgcagcccagggtcagtacaggcaaggcttggaacagatgagggggatttataaagtataaataaacatgtatatgctaaatgtttattatttaaggcaatgttgaggtctatgaaaacagtattcacatttgtgaaggtctggcccccaaaagattcaaagaaaaatgtgaagcaaaggtaatcccccaggttcacccacaggtcactgttcctgtcttccaaagattaaaaacaaaagctttgttcaacaaagcattgagaaaatctgaaaagcagttgcattataatctgatgtccaagagtctagaacttgttgaactctccacttgatttttcttctatccctgtcttctctctcatgttggataaatatatctttaacttaatcacccaaatattgccaaatagaacatattggcttaccatgttttatggatccaatgccatcatactttatgtttaaaatcactggacatagtttgtctgatatagttaattcaacaataattatgggctaaataaatgttatgtgattcatttaacttgttgacagattaattttaattttcatgttattagcatgcggttcaattgttttctttgttttttttctttaggtgaaaatgctttttacttgtccccasatatcaggaaacagtgtgattggttccaaggggaccaacccacaaagaaccttgtgaagtttggtcacaaacaagtgtaagtgattataattattgtcttaaaaattgtagcgctgcagggaatgcacaggtcctccaaccacctcctgactttatgggatgaggaccttgaaatccagaaaatgtgacttcccaaaggtaatgtgggtcatgcttctcaaataatctgttttatcagttagcttttgccatgtaacaagctacccaaaacttagtggcttaaaacaacaaccacctatttattttcttacttaatttatttagagacagagtcttgctgtgttgcccaggctggactgcagttgtgcaatcttggctcactgtaacctctgcctcctggattcaagcaattctcatgcttcagcctcccgagtagctgggactacaggtgcatgcagccatgcctggctaatttttgtatttttttttcagtagagatggggtttcgccatgttgtccagccttgtctagaactcctgaactcaaatgatctgcctgcctcagcctcccaaagtgctgggattataagcatgagccactgggcctggccaacaaccacttatttaatttgcaattctgtgggttagcaatttttgtttgggctcaactgggtggttcttctgttttctccttggatcccttatgtttgtggtcagctgcttgtcagctatagagctgctggtctagagtggtctcagatgggctggctcatctctgctccatgtggtctctcattctcagcaggctagcttgggtttgttcaccaggtgacctggcagggttccctgagagaagacaagtgtgcaaggcctcttgtgacctaggttagaactggcacactgttacttctgccacgttctattgaccaaagcatgtccaaaggctaacctagatttaagaatggaaaactaggcttgatggaaggacttgccacattacattgaaagggcatgggcagagagaaggtagataattgagaccatagttccaaacaatttaccgtatctggtgtgaaatgattacgtaaaagaaggattggatacatcaaaaaatagactccatgtcttcttaaaattattaatgctgtgataacatgtaatgatggtaataataggaagtcatgtgcatgttctatgaagactgacgggaggggtgggagtgggcaggactgtggcacccatgccgatgctgctgcctggcccatgtgccrtgtttcatgccctgctccatctcgggtgccaaccctaggagcaaagagggcagtgggggcatgtaacagagggctagctggggtgatgtggctgcaagaactgagcccctgcagcgtgtcagcaatgtgtgctccttaagagaatgtcacagtgtgtcatgctttggagggaagtgcagattctgcagattctgaacttcgtacacagatgagatgtgaacgcaaatgatccttgaaaaatgactatctggcytacgactagctgactctcaagatggggaaagagagcccatctcttcctactgcagacccttctgtctatcaccacttaagtccttcagctctttcttttgacctcagaaggagtggctttaaatctcagcatagcaagaatgaatatcattgctaaggccactaggacccttatcgtggcactggatgcttcatttagctttgtagcctccatttttctaggctctaatgattcgtattttttctctgaaaccttccctgaaattggctcaacctttttatctttaggaaaacagaatgaatgaagtaacctagtatttgaagtcttatgatattaacttgaaaatatattaatacttcctaggacaagtagcaagatatgactataaaataatatattttcttctaagatcaagaaagctatgaagtgtgggtccttgttgttatgtctgtttgattaggctgctattctctctagatattggtaatagatcaagaaattgtaaaaaaaaatacacatacacaaaaattaagagaaataaaaaatatatatactcccagtaataagccctgggagcaaaatagtacatgctaactttataattttccagctcaacatagcatttgattgagtggatattttcttataatgtaagtagctaactactgatttcatttaatttttggtgtatgttttggttggttaattgctataatgagaacattgttggatattattcattattgtctcttattttctctctgcctttattttagaaattgaaagatgtttttgtagaacaatataagcttcatttttaatggttctatttttcaatatgctgttccatatctttttttagggaggcacagatccttaaaagaaggaatttaatatatgcactgctatacataatctataaaaactattgcatgcattttgctaaaacaaatttaatgtagctcatggggttatgtctttatttattttagatagcaggtaaaagtagaggtaatatttaatttgtcttaacagaaatgttccgaataacgttacttcaagtcctacatccaacccagtgacgacaacgaagccggtgactacgacgaagccggtgaccaccacaacaaagcctgtaaccaccacaacaaagcctgtgactattataaatcagccatctgtgaagccagccgctgcaaagccggcccctgcgaaacctgtggctgccaagcctgtggccacaaagayggccactgttagacccccagtggyggtgaagccagcaacrgnagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccrtgggtaagaaagcccttgctagggctgccatcttgtgacatcctcatttcctgctccagggtgtgttcctyaaagcctgcatgtaacacactcagaatacagtccttgatctgggcttgtacacctggatgatgtattttaagaggtgttggttagggattccagcctcccactccccatcctgtgccctcaatcctgtcttgcggtagggatgggaagctstcattctctctggaatgtcagtgggggcacagytcacctcacctgaaaattgagttgtcttaaactaaagggaaaagtttccgtgttgaaataaggttttagctcctatttagggagtgagagagacagaaagaaaaacgctgcagttggttcttaggcagcaaggcagatgtttctgggctggtgtatggagccggactcgcctaccttagaacatgccttgaaaaggtctgggggagccctttgcaactgcaaactttgtctctgcctcatacccacagaaaaggggccctaagctgtgtgctgtggcaatactgggtgttcagtccagcagcttgaaaagtcagagcctggaccatcagtcattccccaaggctcaaatctatgctcatgctgaccatgagaaaaatattgaaagcaatggcaaaaaccacaatgactctgcaccaacttaatatatttcagactgaattagatacaaaaggtagatggctttaatgagaccaagagtatgttattttatcattttcctaaagaagatactggaagacactaccgaatgtcacaagctgtaaaggaaggctcatgataaaatggaaattatcttcatttgatgaacagtatgagagagaaagcagaattcctttaaaagaatttcatgtcataccctaaaattttatgacttaatatattttaaattatggggctcattttgtagcaaacacaacttaggattagtatgctgcatttccaaagtatcttcttaacaggcgagatttttaatagaaaaaaaagttgatgaataatgagatttttcattactgtgaatttcacatttcatgtatgctgatagattataagagcaatgttttttaggggcttgaacaagaaattagttccccrcctcagctaaatttcaagtcaatttgtctgttaacacatccctttcagatttcctctctcgctcatgcactacagtcatggaggattttattttttatcttcacgctctgatctatctttcagttaagatgtcccgtgaagtccaggtgtttgagataacagagaacagcgccaaactccactgggagaggsctgagccccccggtccttatttttatgacctcaccgtcacctcagcccatgatcagtccctggttctgaagcagaacctcacggtcacrgaccgygtcattggaggcctgctcgctgggcagacataccatgtggctgtggtctgctacctgaggtctcaggtcagagccayctaccayggaagtttcagtacaagtaagtacatgatcagtacaagtcggtacctgatttctatgtagagtatcaaayaggacacaaaggagacacttacttattgaatctattctgaaataaccacaaattcraaaaacaacaacagcarcaacaacaaaacaactcagcctgggtgctttggtggcagcctaagcttataaaacacagaatggaaatgggattccatgtgggatgcagtcctgccctctgggtcctgggctactttttggaggaagccagatccacgtcgcctgagcacagccctttccaacattgcacccgggaaagatggccacgtctcccggtgagggctcctggttgcccaccaccccgtccaggtttccatgttcaggaaaacaccagccagtcactggctccttagggagtaatggaggtgtccctgaagtctcaccgccccgggggtggaggatgtcgatagctgagtctccctgccctgatctcaccatagttgggctctgcccttggctggctgttgtccccaggggcccccccatttcactgaggcctgcacttgagtgctgtcacagcttttcttaattattcatggtcccctctctcatctttctaaattcttctgggttcccccctcccattcttcttgacccccactgctccaggaatgtgaagggaaggctcctcttttcttcaggccaatgctattcagatcaaggaaccagcttgaggaaagggaattcccaccagtgccatggattaggcccatagagatatgagtccaaagacccagtcaaccctagggctctattttcctggacagcagcagaagaggctgtctgggaagtgagaggatttgttcagaagttcagggatcccctcccgtcgcttattagctcatggatccaacttgyagcccacagcataagtcgtggatgtagaggtgtcttggatctgtgtctttcaatcaccactccccaacataagacattaatcacagcaggcaaccttatatcagtcactaaggattcccaagccctcctgtttctgatttacctacgagttgcatatatttttcttttatagagaaatctcagcccccacctccacagccagcaaggtcagcttctagttcaaccatcaatctaatggtgagcacagaaccattggctctcactgaaacaggtgagttgtgaaactattaggtccattaatggcactaagaaaatacccatcttgattccaatttaacttcctgggttctaagtcttagcccaggcatgacttctatgggggaaaaggtccacgtcagctctgtgcagcccaacatcatcttattctgcataatcccaggtgtaaatggagtcttactttacctgtgatcagactcagtgaaaatttgatgggaggtgcttttggggctatcactagaattcacgtatccattagacatttctcctgtgcctcatactgggactcgagttgatttgtggtctgtgatgctgtgaagattggcgtttcatttactcagtgatttaatctaataaaaaaactgcttagaagaacacaagacaaatttggctggaatccatgaaatgcatgggtttggatctgacccatggggtgttctggtccggacatcctaagcacacaccccagcttagtgtgtgagtctgtgatactgtctctcatgtgcttgaaccccagagtgtgtgcatagtctatgctaagttagtgactggttaggtgtaattcaggaactgacagctgttacttgcttttgttcttgggcagtgaaactctgagagacctggaatctctcattcagcagaatgtggacttggcttgttcatcggtgagaaactgattattaaaatagttgataggctttgcttaagagtgttcagcaaagaatgatggtactaacataaaaaatggaaatgccatgggaatttagatataatactgttttatacacctgaagcaaaagctttctgctaactaggggacaattcattattttttggtgtatcgtctactgtcaggaggaggaaagcatttctcttcacaatgctcatttctgtaattgattttaaaggtgtttgttgagtgagcctgttaggcgaccccaccatggtgcttgagctcaaagagaagccacaaagaacacagtagattttccccaaaggtgtgggtcaggacagattcaactctaacttcaaagttgctgaaatctgtgtatgtcatttctcactcattggttaacttctccctgaatacagtgtgggaaatagaaaaattttagccaatttagtgcttcattgagagaaaaagacttggagtaaactagagatcagagatcaataatgagtaaactagacagcaagatttggggatgtttttgattctcttatgtgtggtccaaaagggacaagattgtataaacagtgcctagttcatataaacaacaatgtctttcagcaagggtctggctgggctgttttgtttttcttttcacatatatatatatatatatatatatatatatatatatatatatatatatatatatatatgtagagagagagagagagatggggggagagagttgtgaggttcagaattaagaaggtgcttttgatccagacctttaacactgagatcgcctgtctacctgtgataaagagaaaagagcttttgaaattggggcttgtgtttctttcaaggctgcaagtagttgatacagatgaatctaaataaaacctttctccttcatactaattggggcataaccctcagacccaggatgtgaatgtcctctcaccatttcatgtgtgtgtgtctgtgtatgtatgtgtgtacacatgcatatgtgtgttttccttcccagggtgaagacataaattaccttttttttttaaaaaaaaagaacaaggccctgcataattgatctctgatctcttaaacttaatgacttcatagtaacaaacaagcacttaacctgccttggcctgatgaatatatgttggtgtacacacagttatggcatttttgagagctctttttgaattactaggttggtgcgaaagcaattgcagttttgccactgacagtaatggcaacaactggaattactttcgcaccgacctaataaatgggacatttacttaaaaatgtctaaaattcaaaatggataaccagaattaggagaggaatccttatcctccccacccctaccaacctctctccctcccctcctcaccttctcctataattgtcattttaactatttcccctggggtggggggaaaattttttaatggtttttatatatttggatataggaaaaggagtgacaatgaaccactctttattaaataactaaaaaaagataataactgcatgcttactcagtagttgcatgtatattttgcatccaaattccaatgaccacgatatgcattatttctccaaatatacattttctagaccattcaggcaaaatgaagttttaaaaatatattttttatatttacatgtgtccattttcattcctcttactttctgcagcatccattaattagaaacatgtttacagagatgggtccctttcttagtattaaatagtagatgctactgtttgcttttttacttctgtgaataaaagatgctgtcttaagaatctgtatttttcatagtttatcatgttagattctgggaacctggtgacctgtgtttgaatctgtgaaggaatttgtaggtagaaacactctgaaatgaaaaggttcctagtcctgggcacctaaggcaggggaagaggagaggaccagtgttaccattggttttcrtttgcatatgttaatgtttgcccattttgacagtcacattgaatagatgcttgtttatcaggaatgtgagtcaggcatgtaatgcgagggcagtctggttggggcattttttgtcctccataagatctggccctgtttggtatgtggcagggagactctcgcctttgagatgaaggttgattctgttaacaggccttgattccattaatatacctagggcatcgttagcaaccactcaggattccagctttacaatattacatgatttgattttcagtggttaatatttgtattttttwaaataaaaccaaatgaacccccacaaaaacatctcactccactttttgctttgctcggcatctaaaagaattatgctccagccacttttctgtcacacatctgctgcctgtaaatggcagtgagcagcagtggatctttcattcgttaccgtggscycctgaaagcatgggtgtgctgggcctttctgccacctgctttgtcgctgctgattttgacagtgctacgtagttgctaattttggtttcaggcttttgttaccacctccctcttctcccttctcatttttagctaaggaagctttggatagatattttctatgcatattactattaaagctaagactgtctagaatttctaaacaacaacaacaacaacaaaaatctaacttaaaatttactttttgcagtattrcaaaatgaatcctaaattattggcttaatcacctgtgttaaagaagtttcaatgcagaaactagacaaaacaactaacaaaatcatcatgtcctttattatttattcttgaaattagcaatctgtagaactgatcacattttgtccgagtagacatgactgggccaattgtatagccctgaaggaaccatcattttgtgtttactaacgttttacttattgattctaagatgcacaattttcttctcatggggacacttctgaaactgaaatgtgacttagaattgacaatatatcatggtttattggtagcattttgtgttacttagtggaacataaaataatggtgcatcataaaattaagagctcttatattggatacaatacagtatttggttggccatgttccatgtgaatatatatcatcaattagcataaaatggtatatttgggggaaatacctgactttatgttaataataatttaaagaacaaactaatcccacagctgaagtaagttaaatagctacagggatttaggaaatggtcctctccaggctgtctgttgttcatcgctgtgtgaggatgttttctggttagttgtcatgtgtgggttatgatgagcccaaaggagtgttttttatcttgaagtcttaaaaaatagaagtctgttggtcaagatctgaaagagtaaaatttaaccacagctacattttaaaataaagttaaaaattggccgggtgtgatggctcatgcctataatccctgcactttgggaggctgaggcaggaggatcacttgaggtcaggagttcaagaccagcctggccaacatggtgaaaccctgtctctactaaaaatgcaaaaattagccaagcatgatggctcatgcctgtaatccagctactgaggaggctgaggcaggagaatcacttgaacctgggaggcagaggttgcagtgagctgagatcataccacttcattccagcctgggcaacagagtgagactcagtctctaaataagtaaataaattaagtaagttaaaaatttggtaagtttccttggtaccctttgaactgaccaatgctcaaaatgtagacggcggaaagtgttttcattcaggcaaatcatacctgcatccaaggtatggaagtactttatactgtaacaacaatgccgagtgagaaggtgattgaattttcttgttttggggaccattaaactgatgaggaacatgttgatgattgcagcataaacacctctcagtctgtcttccttcagtttgctcaaggaagtacttacatcgtgatttggaaatcaatatgtttgggaaatgtcaaagctgatgcctttaaaaatgcattgaaacactatgggaatatcaaactatgaaaaagacaagattttccaatcaatatgttttccactttgaagaatacatatattttttgctgattataaagttaacagatatgcattgtcaagcattcaggaggtacagagaaatatattacacgattctcattgtgacagcattgctggcttttgatgaaaaccaatagtgacccgatgcatagccttcctatttttttctatgaatattattgcttgtgggaaggtgcatgcatcgcacatgcacatccactcctgcacatcattattacaaaaatggactgtggggcttagggtgccttgcgccccagtgtttttgaatggttgtttttaggatgttctaggtaggcacctgtggcttctgggaacaggtgggattcccagaacagggttttaacctaacattgtgcttgcctccgtttcctctcttctatttggttactttcctgaagcccagtgaccaatagtaaggaagtttcagcagacagtggtctgagtcaggcagcctttcccctctctgttttccaagcaaacttagttacattggtattctaggttaggaagccggggaaggttgtggataattttcagtccccattgtcttttaggctcccactaggttctcaataataaagaagagcaaattaaggaagactcagccatgcgctcctctcacataaagagaaggctctagcttcctacaggttatacctggggggcagactgatttcagagggaaaagatgaacaactattgcatccaaagacgtgtcgttctagggaaaagtccaggttaagttcaacgagggccagccatctcccttggtactccaggacatttaaatacttttttttttttttgctttaaaacagttgctttaacatatgcactcatagctgagtagagtccagccaaaacgacatgtctcagaagtcaagattatgtggagtttgcattagaagccttcttaagaacataaaatcctccgttttcatgcttcagaagtagagaagtacaggtttttgtctttgaatagtgccgggttctcacctcactaatatatttctcttggttttccaaatatcttcttgtccacagtaacagtgtccttattttccactagtaaatcttacagggtctcagtagtgactctcactgaaataagggcagaaaacaccagtgccgtggtgtggaactggagggctagggtggagggccaaggaagctggagaagccaatcagacggggagtggagtgtgctgctgtgaggccactcatgggctgggtgtccgtggctctgggcagacctctcgtgactggttcagcagagcccaggggactgggaattgaacagctaaacacagatggtcaggactgaagtgcacttgaaacaaataaaatagagcaaatagggtccattggccaacgctctgggaaggaaggaagaatagggagatcatttgacgccggcctcacgctaacagggaagccaccagtaaatgaggaataaattttgatggttaaattaccttgccttgtcagttctctccaggaccttccttgacagccaggcattttccttcagttattggcatatttgagagaaagaaggttgtttttgtaaattgtcttcattttattctgacttcctggagtcttcaaaggctctcgtggggaccactggctttctgggccctgagagcgtctgcaactaggaggtgttgtaactgtggagccaccagccaccagcctggaatttgggtgacagcagcaaccaggaaatgttttagaccaattctgagcctcagtcctgtgcacctttgagtctggtccatcgtgggtgatccaagctatgattatccactgaagacttaggttttccttgtcctttttggtatctatctgaagcacagatgctcaccacctccgcagctgtgagcagcctgcctcgctggggacaaaggagatggagaagcatctctttgtaggggagagctggataattccagcctgttagctactcacaggaacatgcagaattattggctccagggagttttggagaaagaaggtttacgttttcaaacttacagataacagttgacatcaatgcttctctttcccagaacaatctggagtttgccagaaaactctgtaaacaggagtcgtgctgtgtgtgaactgtaaactcttctctccaggcgtcgaggggacctttgctttactttgcagctgggctacatcagacgtgtgcattggaaacataaacttccttaactgggaaaagaatgcttctctgtcttcaaaatagttctgctatgtgacatttttgccatcatgaattttacatcagtgctagctctttgttttacgtgtttcatttggcaggtcacaaaggctcttggctaccacacatacgtgcatacacacacacacacacacacacacacactcataaaggattttcttttctgctttacctttaattttcagtctacttggcttgtaatgaaaggtagagccttatttttgaactatatcccaacagaatcgaatttccattttgccaagaattataaaaccctgaggttttaaaattcagtttcttttctggggatttaacatggaaggacttggagggcaaatggcccagtgattggaaaggggaaaaacaattcatttcatttaaaattattcaataaccattgccagcatttgggattctgagtgctgtttatgaagccctttcattgatataatttcatctatctctcacaaggctgtaagcaattcctatgtccatatggcagtgaggaaatggagatttgagcaggttaagggagttttcacctggaagctcttcttttttttccttctgccacagtagggtcatcagactgtcagccccagcactgggagccgagtaacacgcatgttctcattaatatccttttctcatgtttttattaaagatatatgcaagttgccgaaagacgaaggaacttgcagggatttcatattaaaatggtactatgatccaaacaccaaaagctgygcaagattctggtatggaggttgtggtggaaacgaaaacaaatttggatcacagaaagaatgtgaaaaggtttgcgctcctggtaagtgattcttccttgtgtttatggcttctgcaaataagagattcaggtcaataagtcaccttgaaaaatattagaagtgcaatgattatgatacatgtgaaaaagaagataaagtgtatcctcagataaggaagacgttcaaatacaacccatgaaatgtctttttgaattcctattttgggtttctaaaaacatattgtcccttgtcattcttcagaaatgttactaagttgctgttatttgtaaaatattgcaccaaaaatgattcctgggaagataatataatgaacaactacagataacgccaaagataaacaacccccacaaatttatcttttaaatagttttgcttcctataaataacaatgttgtcactggggccatccagtatctccattatattgtgcagttcaactggtaataaaataaacactttgaacagagcctggggtcagtgccagaatggggagagttcagttcgtataaaggcctggtagatggtgcagggcaaaagaatgggatcagatttcccagacatccctgggccccggggccccaggccaagaacgtcacagagggcctttgatggtactgagtagaaaagtgggacaggtgatggaaaccagaggctgcgggactgtgtcatgataatgacagtgcccttttgggtcagtaatgtggcttttcctctcttctctcggctcctcacctcacccyacccaccccctctctcgacgctcagtgctcgccaaacccggagtcatcagtgtgatgggaacctaagcgtggstggccaacatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccaggcagttctctcgaatactttgaatgttgtgtaacagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttwaaaaagttgtaatagagaatatttttggcattcctctaatgttgtgtgttttttttttktgtgtgctggagggaggggatttaattttaattttaaaatgtttaggaaatttatacaaagaaactttttaataaagtatattgaaagtttcctgggtgtgacgttcttggcagtcttgtttccatagcagcgattgtcagaatcacccctaggctggggaaactgggtttggttctggccccatggagctgtgcaacagcctttcgtttccagtggaggaggcaaaagagctttatcagccagtgtgcaaagagaccggctggagacaagcatcccccgctttgtggattcagccccacatgctccagtgctccatggccgagcggaaggtgttcctgctgttgggtcccggcagtgtttctgattttcagagtcaggctggcttctatcttttcctctgactcttggttggccctcagagcctcagcctcctcctgtcttcctctccacagtgatcctttcccagggggttgatttgcttcctctcacaatggctgagagattcagtgttgccccacgacccccaaccccttttctggagtctcaaagcacaaggtctttcatttttttgtttttcttaaagactgtttttttctctcttcagaaataatacaagaaaccaacaaatacatattcaggtggcacttgagttccacttacaaaggaaacaacttattggataaaatacatatgtcctgacaagtgctgagggtagaattacaggaatcttgggtgtcagcagaaatgttttatgtaaaatcgggatgaatttgccagttggtctattgggaaaggagagaggagtgtggccctcttcagaagcgccacttagtccccacaaggtcgccatgacctcctccccagtcctcttctatctcggcagctaccatggggtgctcaggtcagtgtgctctgagctgtgacccttggtgaccaaccctgggatcygccaggcacccaacaccagcctcttgcaggaacttgcggagcagagagctgtgggcccagctcccatagcggtgggctgagtgctccacttcccaagggatccctgcccccgccacccccattgacttgatctgctatggacctaaaatgagcatcacaatctggttttactttttgggttcctccggaagcagcccttaggactaaggatatgggtgtgagtagtttatttgggaggtgaaggaagtcactgagtggctgagaagtggggagtgagacaagcaaagggagagcactgttaagaggtgtatagtcagcgtccactgtgggtgcccagagcccaatccctcggggaaaccctgggaggtgcacctgtggcactgcacctcgtaggccagcagagggctgaaggagtttgggtagtcatacacctgtttccacgggtcactgaggcattcatgctctggtcctcttggcttgcaggcacactggcaaaggggccttctgtagtgtaagaaaatgttcttggcaaagacctgcagatactcccatgtggaacttgggggagtagtcaggcccaaggtacaggagtaggacaccaatatttgtaacatacctagatggtctgctcaaggtgtgttacaatagactggggcagggcccatcactaggagactcacttccaagggctccagaaccctctctccctttccacctcctgttgccagcatgcccatccctgccattcttggttcactctatctatgcattgcttctctgtgtgtgtcccttggctgctcaaggttgctgggacaatcacacccaccatctcacctgactcaggagaagcaggaagtgatgtaagtccaggtgagtggctggttaagctgtgtgtgctgctaacttagggtaaggcaaggtgctcaggtggtggatgggcagtttctcccatttattcccacagagcaaataaaacaaaatcctttgttacattgtctgtcctaacttagggttcagcaaaacatgatctgagctgcaggattcctgaccccttgacagctcgtggatttctcttcccaagacattcttctgccagactatgccaaggactctgtgtcctttcttgaaccctgacatgtccctgaccctcatatccactcagctctctctggggaagcctccagcctggcccgtggaaggtggcctgccaataaagaaaacctgttttggattttgtgactaagaaataaacttctattgaagtaagagactgaggtcttgggctgttctagcagctggtgtgaccgtaacgaacacagcgcacctttatccagaagcctttgtgggtcaggtgctgtactaggtgtttcacacacatcttaggtggtgccgttcagtagcggtcattgttccagttttaaagatgatgaaacagagggtcagagtggtccttttcacccagctatgttctaatggaggatctgggcaagttatggtgacccagaagccctctcagagttccaaggttggctcctgtgggacgctcactgccattctctagatgtttctggctctttctctggaagtcagatctaagccatgtgtcttttcccagaacaaagcatgccctccacatgaccctccccaagaccttccgtcactctttctcagacagcaagtctctatccttctccttcctttcattgtagtcttttccatctcttctcattatcctgagctgctctggcttaggaaagaacttggagaagctgggggctctggcacgcattgagggcttgcgcagaaggtggcctgggctgagtatggcctgcctgggctccaaggccgagtcacgaggacgtctatttgtgctcaactgtgagcacatctcaatcctttcaacagcagctttgctggatttttaaatacaagtgctttatactttcattccctcaacgattttctgcataattaaaaagaaatcacagcacttatgaatgggtgccaggctttttgtagaaagccaatgttttgaaccctcaagaaccattttaaatttctttccccatggtggttcatttttaggagatggttcgtattttcctgccaaatttccattgttgtcagatttccagctggacctagctgctcttcatgagccaggctctcagggttccacctatctgggtgtggcttccggagaagttggggactgctgacactgccaggccagggggcccagtccagaggctgccctctgccatacccctcctcggtttagtttgggtctgagctttgccgctgcctgtgcctccccttccctgggagatgaatactgatggtgagctgctgtaagagccatgggattcctggggtcttcctgctttcttggaatcatgctctccagctttgggccacccctcagcattcctgagatcccatgcagagccagttcagaaatccttttccgtggtattccctagtcttccacccaactttatggtgggtataaatctgctaaagaccaaaacaccaaagaagtagtattttggaatctagtagtcaaagcttgaaggcatttggtcatgagtgatgggaaaaggccagtgattcaagggcctctgtgcatgatggtgacaccacccaagtatcgctcaacctggaaaactgatattgttttcctgcctatgtcagatgtctctgtgaaaaccatgctgctgttgcaaaaagtcatctaagagaaggcatttgggcatctgcaaagggagctagctatgcatgtttgatttcaagagactagtaaattcccagcatttacatgaattttataagagatgttagaaacagaaatagcacaataaaaagaaattgtcagaacttgtatatctgggaaagaatatttgttttgaaagaccccatttaaaacagttacatttgataggagttgtagttgaagaagctgactggtcattcataaaccagtcttatgttgagttccccgaaagcagatcctgaccaagttttggctgcagtcatttgtttcggaaggtgtgtgggaagcacaaatgaggccactgagaagcaagacaaagaagttggcaagtcaagggatggtgcattaactaaaagcatgttacccttgagagcaactggggctcagtctccctggaaacccactgagaaagtggggagaatgctacgaggaacagaaagctggacgtttatggactgaccctcatctctctttggttggaggttgtagtagtcaccattatctagagggacaggactaataggatagacatatatatgaaagggagtttattaaggagtattgacttacacgatcacaagatgaagtcccacaataggccgtctgcaagctgaggagcaaggaagccagtctgagtcccaaaacctcaaaagtggggaagctggcagtgcagccttcagtgtgtgaccgaaggcccgagagcccctggcaaaccattggtgtaagtccaagagtccaaaagccgacgaacttggagtctgatgtatcagggcaggaagcatccagcacgggagaaagacgaaggcgggaagactcagccagtctagtccttccacgtttttctgcctgcttttttctggctgcactggcatcagattagatagtgcccaaacagactgaggtgggtctgcctctcccagtccactgactcaaatgttaatctcccttggcaacaccctcacagacacacccaggaacaatactttgtatccttcaatccggtcaagttgacactcacaggggttgacctgggggcgttacacgccagcattttgaggctgccctgcacacactgttgctagaaaagtaaagcagagaagaagagggatgygggccactgaggtggagtgctgtcagcacacctggaagcagccagcacagctgcaggggagcacagaggcgggccgaggagcaaggtataaacagcatcagcaatcagccagtttgaacatgaacctatagaaattgaagtgtctttaacatgaagttgattagagagggttgcctagatgaggatgataatagagacatattgtccactcctgattactctgatggaaagaaatgaggtgatttatggattaagcacagcttctgagctcttaaactgtagcccacggtatgcccagccctctaccagatgggggtcagcaaacttctggtaaaggaccccaccagcgtccagtggttttggggctccagcaagagccatcgagcctgtgctgtgtctgtgaatttcagtggtggctcgggctgcccaactcccttgttcctttccatttgtggaactgaacctgatttgctagccttcccattgttgctataaactactcaatatttttccaataattcaattttcttcatatgttaaccagagtaagtttctgtcccttgctgcctagagcctggacaggtacacagtctttcattcaatcacttattcaacaaacatttgctgagcacctaacatgtgtcaggtattagacaaggcactggggatgcaggggtggggtggacagcacacatgtcttcctcttgtgttccttacacggcaagggaagtaggtggcaaacacacaaaaccctcggtaaataaggacgtgtgagctgcagtggaggctgtctgatgaggtactgcatgtttaaggcaagcctttctgaagagttgatttatgagctaaaaaaaaaaaaaaaaaaaaaaacccaagagaggccagcacggtggttcacgtctgtaatcccagcaccaagggagaccgaggcaggtggatcacttaggagttcaggaccagcctagccaacatggtgaaacctctctactaaaaatacaacaacaacaacaaaattagctgggcatggtggcacatgcttgtaatcctagctagtagggaggctgaggcaggagaattgcttgaacctgggagacagaggttgcagtgagccgagatcgcaccactgcactccagcctggtaacagaacaagactctgtctcaagaaacaaaaaacaaacaacaaaaaatcccaagacagccacctttgggaagacctgaaggaagattccagatccagagagggcctggatctgagatcctgggtagagaaatgactgtgacatgtttgagaaacagcaagatggccagtgtggctggagtcaaacaaataagcggataaatttttggagttgaagtctgagagagaatggccaagtcaggccccaaaactctttcataactaacgagttgtggattgtactttaatgtgatggaaagccattgggagctttaagccgggcagtcctgggtgtgacatgtgattctttgaggaggcggggtagtcaatcaaaaattctgccatgcgtattagaacttaggatgctattgaactttgaagcggtgatatgaggaagacagttgaagttcagaggagagggtggggctaaggatatacattcagcagtttggaaatataccatattcgaagcctagatttatggtgcgatttcattgcttgagagtatagatgaagagggacagggagtcaggagaggcctgtctgtgccctggcggttagaggttgagcagagaagacaggcttggtgaaagaggctgaggaggagtgtttgtagaaataagaagagaatcagtagagacaggtgtcatgcaaggacagcgttggcagaagctgtgtcaaaatgaacagagcagtcacctgtgctgaatgctgctcatggtttagaaaacagagagcaggaaggagagagtattcttggggctgtggtatgtagt

SEQ ID NO: 10689 - DNA, 44978 bp, Homo sapiens
  misc_feature (1)...(44978): n = A,T,C or G, or insertion/deletion polymorphism (see Tables 1-2)
ttcagtttcgattcgataaaatttgactaactaaacttaagataagcatagttacgcattagagtattaactctcaaacttttaaaaaagaattcttcctttgcttgttaattttctttctttcttttttttttttttgagatagggtcttgctgtcgtccaggccgaagtgcagtgacgtcatcatagttcactgcagcctctacctccccggctcaagtaatcctcctgcctcagccttctgagtatctgggactacaggcatgagccaccatgcccagccttttcttttcttttctttcttttctttctctctctgtctctctttctttcttttttcctccctttcttctttttttttgatggagtcttgcactatcgccaggctggaatgcagtggtgcgatcttggctcactgcaacctccgcctccgggttcaagcaattctcctgcctcagcctcctgagtagctgagactacaggtgtgtgccaccacgccagctaatttttttatttttctagagacggggttttaccatgttggccaggatggtcttgatctcctgacctcattctccacctgcctaggcctcccgaagtgctgggattacaggcatgagccaccgtacctggccctttctttctttttatcaagacaacaacatgtctttatagtgctcccaaggctaaagtataccttacgtctatgtaaacactcaacctgagctttgcaatggcccatgttggcagtagtgcaaacaaaaacaattatgaaacccattttcctttgacaaagagaaataagtggcaagaattggttctttctcttagtatgggtctctgaaaagaaccagatcagtcaaaaggggaatatttttctgaagggataggtttggcctagtggcttctacctcttttagatgactgctgtttctcgttttaatgttaaatagacactaataggagaaatcacattaattcagtcaacaaacatttactgagcacttcctgtagtcaggccctctgttaacttctgggaatacaatgacaactctgacaatcccaacccaaggagccaacaagtccgggaatagagacagacaagaaaacagacaattacaactctaccgttagaataaaggtacattgagaacttgcaacaaatattcctcatcccttatcttaattattcataacatgtttaccaccaataagaatagcaataacaataaatgcccaactcagacagcaatgtccatttaccctgtgtttacacagcataatacaagcaagctgtggacagagattctcttgtttagtcctcacaactctgcaaggtgggttttattactctccatttctagataaaggatctcacctaatattacatgggccagtggtcttccagttggggtatgcacaaccctaggggtaggagaggaccctgcctggggtcttcaggtggggaccatcaacctccatttgtactcttttctgaacattggtctgagacagaaagtccctgcaattaaggcattaagctggctctttttctatttctcatttcataattgcccttctcctgctttaccaaaatctttcaccccccatcatatatatatatccccatacatattctatatatacataccctacatatgcatgcacacacatcatatatatgtatgcatatatgatatatacatatatgctatgtaaacatatatagtgtgtatatacatgtgtgtatgtgtatatgtgtgtatatgtgtatatatacacgtgtgtgtgtacatatatacatcatatatgtgtgtctatatatgtatatatgggtgtgtctatatatgtgtatatgtacgcaaatacgtatatgtgatgtatatatataagatgtgtgtgtgtatatatatgtgtttgcatgtgtgtgtgtatatatatatagtatatacatattttttgagacagcatctcactctgtcgcccaggctgaagttcggtggctgatgacagctcactgcagcctcccggctcaagtgattcttccacctcagcttcctgaatggctgggactagaggcgtgtgtcaccacacccagttagttattttatttttcgtagagatggtggtctcactgtattgcccaggctggtctcgaactcctgggctcaagcgcttttccacctcggcttcccaaattgctgggattacaggtgtgagccactgcaccggcccatcctttattttaatattatgcagtgccctgagacatataaaaaacccaccttcccaagtaaaggaaattcaagctgatgcctgcagagccttctttaacaaaggctctgaaataccctctctcattaaaatgatactttccaataaaattttgtttaacaatgatttacaaaatgataaaatttatttattttgattgtgtatggatcatggtaacaataaaaagacttgtaaaaataactaaattgaaagaatcttgaacatttagagccttaagactgtaggaattgaagaccacagaattattaatttatattaatatttttgttgcagagacataatgaatgatcaacgaaaggcttttaagcgttaaaaatatattacactagataaaattatttgcgggaatgggatggaaatacattttcaagagagaaaggagcaatgtaaaatgaagatgtaaaatccttctgctggttgtccttggggttttcttttaaagaaaagcttggcagtgtttttctttttttccattggatgatggtgaatatcaaatcactttggtgctaatatttcatttaatacattaattttaaaattttctgtagaggtgggatctcactatgttgtccaggctggtttcaaactcctggcctcaagcaatctccctgcctcagcctcccacagtgctgggattacaggtgtgagccactgcatccggccccatttaatacatttaaaagagtggtgtaacaatttttatttaaaatgtcatatttacaatattctagaatgtatatcttttcaactcattaaacctaaacatccttgtaaaaagtgtgaaaagttatatagtttttcaaaattcgattagcagttacataagcataaatgtttaaagtatgtatggtacagccaggcttcagttccctgtcttaaacacaaagatccatatcaattccagatactgcaatggtttgctgtttttcctgcttcccccatctccaaataaactaaagcatcaacatgcctcacctcacataaccctaagttttcagcagttggcagttacacctggaaaccatttttctaaaataaacaacaactgtttgcttacggatcaaaatgcaaaggaccataacatttagcctcaccttcctactacagatcgagtttaaaagtgccatggtatagctaaattatgaagaaagatatgaatataactgcaaaagtggaaggagatttgggataattcttgcccattttgttaggccaaatgcatctttgtgcaaattagaaaaaggtggtcttcatcccttcactcctatccttttgggggtggaggggcagtggctaaagtacagactaggtttcagctaccacatcctccttcagttagctgccctcggcgtgacagaaacatgtgcaaacagccctgtgcctttgtcttatgttccagccagccaagaaaaatagttgtaaaagagcagctgctgtttggggtaatgaccttggaccctccccaatttgttccaagcctgtttttgtattcatttttcccacatttatgttcctggatggaagcttccatatctgctcttggccctatttgaaattccccagatttccttcctggctcctggcctttggtttttcatgtggctcctgatcccacacgctccctgaatttggattctcctgtcatttcaggtgcgaggtttcccactacagcctcttgggcctcacctccaatacctctttcccatcagaacagcccggaccttcccctatggtagagcagagacagaatttaaatgaattctcaagaagtgcttggactcatatctagcaaaattacatggcatttaacctttgacacaaaaaatgcagcttctaggaatctatctaaagatacactgtggcaaatatacaaaaagaagcattatttatcaagcactatttcctaataaaataattcttaggtcaggcgcaatggctcaggcctgtaatcccagcaccctgggaggctgaggaaggcagatggcttgagctctggagttcaggaccagcgtgggtaacatgacaaaaccccatctctaacaaaaatacaaaaattagccgggcatggtggcatgcacctgtagtcccagctactcgagaggctgaggtgggaggatcgcttgagcctgggaggcacaggttgcagtgagccaagatcgcaccactgcactccagcctgggtgacagagtgagaccctgtcaaagaaagagagagagagagagaaaggaaagaaaggaagaaaggaagaaagagaaagagaaagaaagagaaaaagaaagaaagaaggaaagaaagaaagaaaaaagaaagaaaaagaaagagaaaggagaaaaagaattcttactaataaatgcaggagaaatgatagaattgaaatatcaccattttcaattcctaatgaaataacgtatctaggcaatgaccatcaatagctagatgctaaaatcatctgatcaaacactgatgggaacttcgtaacagatggatcaggctaacaacatctgaaaccactaactggttttgatgtcataaaaagaaaaacaaccagatattttctgtctcctgatgagttgcaattggagctacatatcacctgtaaagtcttctggccaaaaaattaagcccagccggaccttattaaacctttaaatctaacaattagttttgaagcttttacagattaaatgaagtctgagatttgcttcaaaatgaaccagtggtggggaggaagtgggtgaggtgtaggtgaaacaagattggccasgtcgataattgctggagctgggcgatgaaagcacaggtatttatcacaccatctctctacttttgtgtgtttttttgtttgtttttggttttggttttaaggagcagagagtctaataggcaagaaagaaaagagaaggctgaaggaagacgctcccccgtacagagacagagggagggggctccaaagccgaaagaggaggtcctcttgtgtatgttttaaaatactcccagataaaatatttttggaagagtacttggttggattcaacagcttttttttaatttaaaaaaatcacctcaatttttttgcttgctctaacgtgccatagaaattcctgaggttttacttgttgctttacaatgaactgtgtaaacacaagctggaagagatcagctatgcgctggaagggttggttaaatattgagactgccttgctgagggaagccttttaatgaatctcagtaattttgcaagagaaaagataacaatgaacactacattaaacatcattcttttgcactttgctaaatatgtgtatgtaaattactgtctgactgttactggatatatacagcatatacatatgcactttttttactgttttttttttttttttttttttttttttttacagagcttgctctgtcacctaggctggagggcagtggcgcagtctcagctcactgcaatctccgcctcccaggttcaagcgattctcctgtctcagcctccaaagtagctgggactacaggcgcctgccaccgctcctggctaatttttgtatttttagtagagacagggtttcactatgttgtccaggctggtctcgaactcctgacctcgtgatccatctgcctcggcctcccaaagtgctgggattacaggcataagccaccgcgcccggcccatgtatactatttatacatttttagtatcattttgyctttacattttacataatttcagatacattttcctcatatcaaataattcagcattttttagtactaacatcatagtctgtaagccattcaaaaaatgtatttcacaaaataggctatctcatcctttgagctattgagatgaattaatttatactcctcctaagatccctctcgtcactaagattcttttattttatgacaaaaccatagttctagaagcttgtttctcccacctgaaaagactggatttgggacatgatcctgtagaacttcggaggtaagcctggtgaatcagatcatagggggtctggagggtgaaaaaaaagagtttggtgctcatggatggggctagtattggggtgtaggggagattaggtcaaagcaagaggattcaaaggagaaatgaattcctttagattggggaagataatcggaagaggtagaagacaccgtccatgacacttcctggggaagcagatgtatgtataaggatgtgagtattgtggttttgtaaagaatgcattcctgaagatgttgcataatttaaaacctacatattttgattaattttctcatgagaatagcagggtatgtgttctcggcgctcacaaatgtataatccattgtggcaaatttttgctttcacatatttttttttatcattattgtcacaggttctgtgacggagttctggtttctaaattcacagcataccaaggcagttctttaaagttcttgatactcttttatcatatctaacttgtattccaaaattattgagttggagcacattttcccagcacttagcaccgctatttcatggatggttggagagggggtccaaaaattttacaatcatgttaacaaaagtaacacagcaacaaaacaataagcaaaatcactgccagagtattccttagcttgaaacaatacggttcacgtcgatagaatatggcatctatttctgtttaatcagttaaccctgctaagtagcaagagcttacaattcatgtctaaaatcatgatttttttactagttttttaaaaaatgtgggctctatatatataatttaacattttgcttgtaagacttaattttgcctgggtatggtggctcatgcctgtaatcctagcacttcaggaggttgaggcaggaggactgcttgagcccaggagttcaagaccagcctgggcaacacagtgggaccccatcactaccaaaaaaaaaaaaaattagtcaggcatggtggtgtgcacttgtagtcccagctacttgggaggctgaggtgggaggatcacttgagcccaggaggtcactgctgcagtgagccattattgtaccacaacactccagcctgggtaatagagtgagactctgtctcaaaaaaaaaaaaagactatttctaaatgtgtggctatattataccatataaatgtggcttcttgggcaaggaaagaggacaatatagatgaaaaagaaattgatcctaccagaagtgatccttttatctgcataactctcaggcagttgtggcaaataattgscartatctattgttctgaaactggttttcgcaacttttattgggaacaccatcccctctcctgcatgatcagtttctcctctccacggatcattcacatgagtaaagtcagtagcgtgctggtaaatgtttaagatcttgttctttgggggaaaaagttcctaagttctagcagttgccctggataacttcaaggtatcaacatggaagttatgtacaaaaatggctgtcacaagccagtatgagctaacaccaacatactacccagtgttcttcaaacttcagctcacagcccattagtggggcttgcaaacattttagtggactataagcagcatttttttaaaatgaaaaagtagattgttttacacataacaggagtattgttttgtacaatttttttttttttttttttttttttttagacacagtttcactctgttgcccaggctggagtacagtggtacaatctcagctcactgcaacctcggccttctgggttcaagcgattctcatgcctcagcctcccgagtagctgaaattacaggcatgcgccacaaggcccagctaattattgtatttttagtagaaacagggtttcaccatattggccaggctggtctcaaactcctgacctcaagtgatccacctgcctcggcttcccaaagtgctsggattacaggagtgagccaacgtgcctggtcaaaatttttgttttcgtaattttaagtatgtgtgtagtaagtctcaatggaaatgtaattcttatggcaggtcacttgaaaaaaaagaagtctaaaagtcaccaatgtagtatcttctctttaaaaaaaaaaaaaaacaacaggagaaaacctgaatctgccctttgctccactccttcctcagctataatgctgcttctccattcctcctcacagcaaacctttctgaaatctttatagtcatggtttccaccagttcttcacctcccatttctcaacacacttcagagtcagagtcagcaatgacatccatgttcctaagcccattgcttacttccgtcctccttggcctctcagcacacttggcacacaggctgtttctctttctttggcatctgtgacaccactctcagcaaattcccctggttgtcccttctcagtctcatttattggcgttgtcttatctccccagggctgtccgaggtgattttctcccactrctctcctaggtggtgccatccaatctcatgatgtcatatcattcttccctcatgcttcagccatactggttggtggcctttgtttcctgaacacatttaatgcattctcaagaccctcagggactttgcagcagctgctcgctaaggctggaatgctcttccccaccatcttcatatggctgtttcctttctttcactcaccagcagcttaaactttgactcctctgagagactttccttgtcacccaactaaggttgccactcaggtgctcccaatttaatcttctctaaaacacatcactgtatgtgtcctcaactagagtataagcttcctcgaaacaagaacaatcaaaactccttgccctcatggagtttatagtcttatgatgggtgaagtaacataaaataaaaaggcaccttatatagtatattagcatgacaaatgttagccagaaataaagcaaggaagagttgctagggagtgtgtatgagtgtgttttgggagagtgtttgcaattttaaatattggtggtcaggaagggccccactgagaactgacatttgagtagacttgaaaagggaaaaggaaatattgagtaaagattttaggatgggagtgtgacaggcctgctaggagaatagcaaagtcgctgtggctgctgcagaaaaagtgagaaggaaagtagtaggagatgaaatcacagtgtgtgaggattcgggcagatcaggaagtgctcgtgtaagaactggatctttactcaaagaatgagcaaaaattagtagacggttggccggatgcagtggctcacacctgcaatcccaggttacaggaggccgaggcgggcggatcacttgaggtcaggagttcaagactagcctgggcaacatggtgaaacctcatctctactaaaaatacaaaacttagctgggcatggtggcgcgcacctgtagtcccagctactcaggaggctgaggcacatgaatcacttgaacacggtaggcagaggctgcagtgagctgagaatgtaacactgtactccactccaacctgggcaacagagtgagactgcctcaaaaaaaaaaaaaagtaggttttagtaagggattaacatgatctgaattatgttttgtcatgacttctctggctgttgtgttgagactacattgcagaggggcaagggcaaatatagggagaccgattaggatactgcagtaataatgtaagagatgtgggactctatctagaagggcccatgaggtcctttgcatgctagtattctttactgctgtgcctggccatgataggcattcagtgaatatttgcttatttaaaataacacactgggctaattgaacaacagtgccaaatgagggagatatttctaggaataagttcttaggatttatgaacattttaatccagattttctttgttaactctgctctctggccctttcactcagccccgtttgcacctaaatatgacttacaaaagaaacacagcatttatgtgtacttatttcaacttaytttagctttgtaaagaagtacaaggttgactcagggcccagcttggtgtctcatgcctgtaatttcagcattgtgggaggccaaggcaggaagatattgtgagcccaggagtttgagaccagccngggcaacacagtggaccctgtctctacaaaaaaaaawttttaaattagctgggcatagtggtgtgcgtctatagtcccagctactcctggggctgaggtgggaggatcacttgagggaaaccctgtctcaaagtggcggggctggggggagactcaggcagaattgtgaagatattcaattgctcctgactttatcaataatctaacatttcaacctaacattgatatctattttatgcaaagcattacactatgcactggagactgtataagacaagttccttttctcaaactacagtcgagttggatagataaaacacacaacacataccaaaagacarctataaatccaaggcagtgtatgtcaagggtaaattcacctattcagattggatcttgagaagtgcatcagrcttggaaaatgggtaaggaggagagaaaagcaacagtgaatcagaacatgagttcccagttatgggacttgtaatgaattcctcaattaaaacaaaaaataatgaaaacaaaagccagggaggagaaagcccacgttaatgacactaaaatatatctttccaaacaaatgtggataaaagccaagtagagaagatgagaactttgaggtccctaacacaaaataaacagtaagcagccagccattccaagtggctgacatgactttgtttaactttatttgtatttctggctggtgtgtttacagccaataggtcaaactatcagtcagtgtagggccctgagaagtcgggtatttaagagcatctaataggcacagaattgtgctccatactgcttaaactgttccctaagtgtccaatttggagaaaacacccacacgcaggataaccggcgagtgacgcggagtggctgcgagtccaagttatcactaacggatggggagcttgggctgggcacagtccagcgtactgaacccttcccccaccgtttcacctgcatacagaggtgtgtactgtcaaaaagcagcgcctccaagtctcttctggcactgtctggacttggatccgaggcagacgaggaagctgagaaaaccctggcgttgaccccgtggacctgggcgccccgggaaggccrgcgcttggtccaggcaggcggggcctgtgcggtgaccaccctggtcctgaaaagtcccagccccgagcgccctccctcctagacctggaggcctggaacagccaggtggacgtcggcccacctttcttttctttccttcccattttcctaccacctcccaccccactccgccttccgggcaaaggcagccagatccacccaggacacattctttgtccttatccctctgtgctcgtcccacagcaagccagtcgcggtccaaggctccagaggctgtgcaggaggccgagctgggtggcgatcagcggcgggtccctgtccaaaanccagcagagccgccagggacgccccagacacagaaggcggggcgcggggagggtggggagaccacagcagtgaggcgcgcgagcygggaagtgaacgaggactgactcctgtcgcttcccgtagccgcccacggacgccagagccgggaaccctgacggcacttagctgctgacaaacaacctgctccgtggagcgcctgaaacaccagtctttgggtgagtcgcgcgacccccggcctcgggtggcggggcagtcgctagaggcgtggctgctctgagggtctcgccagtggaggatggcattcggatgtcacggctcctaaatcaccatttgatgggtgggacagtgtccagtccaccccgacccgccggtcctcaccgcggcagagccggggctgggtggcggggacgctgcctctgcaggcgaggcrctccggggcataagggattatcaggagtcgcggcctttcttggacatccctggctggggtcaggctgtttgccctggggtgtctcctcgctgcaaacccaccccacctgggctgctttctcacctgttccctcctagcctgaggccgagcgccacctccaagtggaggaatctggggaagtttccttcccggaatttgtagtgacygtggagtgacctccattgcgttccctgcctctaacacgctctttaggatgccgagtcatttgactgcagtgttaaacattgcaaagcgcaagtcatgtgacttcctttgaccgtacgtgaaacttaagtgatggctgcttgtgatgcatacgaagtgttcatgctggcgggacctgtccctggggatacttcgggggttgcgtgatttaatgcaagcagatggcttaaattgggtcactggcttgttattatacatgtgtatggcaactcggcatccattctttttgctcttgttcttacttcctgaattgagtcacggagccagagttttgaggttttgactaacgaattaagttaatgacatggggctatatttaggtggtaaaccaagaggnatacagttttttttcttaataaagaaaaagtgatagatttgatcggtgtgtattgttggtgtgcagtataatgacagaattgctggaagtaaaatacaggaagctctggtttcatttcccctttagttctgcttaaagtcgagtttttcctggagctattaaatgtagtgtagtgtccatgagtgcttttatcttaaaaaatgtggctgatgctttccaacactcccctgccctgtgattattatttttttaagcaacagagaaaaccgtatcttaatagtattaaaagtattggatttttccctactttgatttgtttaaattggaggaggaagagcaattctttctattcacaataataatagctaacatagcgcttactctttcgctgttttattaactcaatcctcagaacaaaccaatgatgtgaatactgtaattctcattttatggaaatgaaaatytaaatgaatacctctgrtaattgtacgggactgtttgattagtatttaccattaattaattaaattttttttttttttgagatggagtctcgttctgttgcccaggctggagtgcagtggcacaatctcggctcacttcaacctccgtctcccaggttcaagcaattstcctgtctcagcctcctgagtagctgggactacaggtgcatgccactacgtctggctaatttttgtatttttagtagggatgggatttcaccatattgstcaggctggtctcnaactcctgaacctcaggtgatccacccgccttggcctcccaaagtgctgggattacaggtgtgrgccaccatgcctggcctattttagtatttttaataataaattccatgttagaaattttctactgatgtattttttaagtcaatatttcctacactcacaatccaaaattatttagtatatgagcacactggtaagaatgggaggcagatcgttgattgtaataatattctattatttggtaaatatcagtaacataatayataatttaaattttaaaataggatatgaagaaaaatgctacatgcttacttttcttttcctctatttttactttacacagggccagtgcctcagtttcaatccaggtaacctttaaatgaaacttgcctaaaatcttaggtcatacacagaagakactccaatcgacaagaagctggaaaagaatgatgttgtccttaaacaacctacagaatatcatctataacccggtaactgatttctataagataactttttacctatgccaggacagatccaatagaatattaattatccattgggagacagggcaagaataaaagccagtgaacatatttaaagcacctactatgtaatagagatggtggtgggtgctgattacraaacagctcttgtcctctagtggaggaagaagtcacaatgataatatgacgtgatgaaacagtgttatgaacagggaacgtctgggtagagtggagggaatgccaacttttggtgatgggaggaggctcagctaatcataaattgtagtttttaaaggaaaatggatttcttactctacaagtttttcattttcttttttaattagagctgtccatgagaagttaatgtctcgatctttccctcagcctttcaaatactgcttggcccttgagcagggaaaatgtcaaaagccaatggggagatggagagtgtgaagtagtaagggtctcgtgcagttcaggcaggtcctagaatccctgaatgactgtaattgctggaaattgccctgtaatcctgagcagtaaagagcttgttttagttttatgtggtggtgagaatctttaggaatgtctagtttccacgtatctgaagctgaatcctgaatcgaggtctgaaaaaggacagccacttttttagtaaaccgcctagaagattcttgggcaaaaggaagggtgagaatccttaaaatgaggccctaaaccagttttgttagtgtgtgtgggttcaagtttttgtcatttactttatagctgtatttcctttttccctaagttttaatgtcattgtgtaagaatgaggtatcgctgctgtatcaagcaaagtcagttttaggagaaatagcctttcagtggtagtaagtttaaaaaagatgacttcctgaagcggaagcttgtgagacatttaagatgactttgcgcatgttagagttaaaaacatcccaaggttgtaaactgatttcctgcaaagatcttaacaacaacaacaacaacaaactaggctgcctgccacgggtgtctgaagtatcatcttggctcaagctgggagaatggataaaggttacactgttcatttctgcccttcacacagaaaagaagataattttataggtaaaattcgtgcatatcttgattctagcatactgctgattcctgtagtttctggggtcagtactctcaactattgaggtggaacaaaaataagtagacttcatttcttgaggaaggggatctggagaagtagttctgcgctagagcagaaaatgccttcagtcttgtggcatgggctggatgctgttctgaggataatgcatttccaagggagatatttttggcaaatagcttttttttctttcttttcaaaattctctgttttattatcagttctcacaaaagagtcggaaaggttagaggtagactgaactgaatggcaaaaacattttgcgctctctttacgtttcactgctgtaaaatatttatagtataaagggcctgtattgcactgaatttctctcatttgtagctagttgccctttcaatgttccaaaaaaaaaggctgtaaataacttattttatttattcaattaattttttttttttaattttttgagatatagtttccctctggtcacccaggctggagtgaaatgatgcaatctcggcttactgcaatttctgcctcccgggttcaagcaattctagtgcctcagcctcctgagtagctgggactgcaggcacgtgctaccatgcccggctaatttttgtgtttttagtagatatggggtttcacagtgttggccagcctagtctcaaactcctgacctcaggtgatgtgcccaccttgacctccaaaagtgctgggattacaggcgtgaggcaccatgcctggccaacttagttatttaaagataatcaattagtatattttataagctagacttaggaaaackgttttcagctgggcatggtggctcacacctgtaatcccagcactttgggaggccgaggcaggtggatcacgaggtcaggagttcaagaccagcctggccaagatggcgaaactccgtctctacttaaaaatacaaaaattagccaggcgtgatggcagcctcctgtaatcccagctactcgggaggctgaggcaagagaatcacttgaacctgggaggcggaggttgcagtgagccgagatggtgccactgcactccagcctgggtgacagagcgagactccatctcaaaaaaaaaaamcccccccacacacaaaacctgttttcttgaatcatggttgttttgttactgataggttcaataagtaaatatatttattgtctgttgtattctttattaggcattataaacacaccgccactttttaatttttatttcattaatgtttccaattttttttttttttttttttaagacagaggctcgctctgtcayccaggctggagtggagtggtgcagtcttaccccactgcaacctccacctcctgggctcagccttgtaaatagctgggactacaggcatgcaccaccatgcctggctaatttttgtattttttttggtaaagacagagttttgccatgtttctcagtctggtcaagcactcctcccgcctcggcctcccaaagtgttgggattacaggcatgagccaccatgcctggcctatttctaatattttggtccacattggtgttagaccaactgtccacattaagttttcttggaaaagatgaagtaaatattgcaactggcctatgtatttttttccctatttagtatatttctttgactagttcaactgatagaattccaagacttaaaaaagtcaggctctaaggctgggtccagaggctcatgcctgtaattccagcactgtgggaggccaaggctagtggatcacttgagcccaggagttcaagaccagcttgagcaacatagtgagaccttgtctctctataaaaatacaaaaattaactggggattgtggcgcatgtctgtagtcccagctatgaggaagagtgaggtgggaggattgcttgagcccaggaggttgaggctgcagtgagctgtgagtttgacactgtgcttcattctgggtgacagagcaagaaccatgttcaaaaataaaaataaaaagtcagagtccgggtgctgcggctcatgcctgtaatcccagcactttgggaagccgaggcgagaggatcacttgaggtcaggagttcgagaccagcctgactaacacagtgaaaccccgtctctactaaaaatacaaaaattagccgggcatggtggcggtggcctgtaatcccagctacatgggaggttgaggcaggagaatcacttgaacccgggaggtggaggttgtaatgagccaagattgcacaactgcactgcatcctgggcgacagagtgatacttcatctcaaaaaaaaaaaaagaaaaaaaaagttaggcttccttttctgtttttttttttttttctttcttctctttttttttttttttttaagagatggaggcttgctctattgcccatgctggagtgcagtggtgcaatctcggctcactgccacctttgcctcctgggttctagcaattctcctgcctcagcctcccgagtagctgggactacaggcgcacaccgccacgccccgctaattgttcttttgtattttagtagagacggggtttcaccatgttggccagcctggtctcgaactcctgagctcaggcaatccgcccgcctcggcctcccaaagtgctaggattataggcgtgaaccaccgtggctggccacttacttttctttctattgaatttgaatgaataatttggaagacagtatctttacttcataccaggaatgctgccagtgaaatttcttgtttggcagttcattatctacctatatatttaattttgctattgtttatagagttcttaagatatgattaaatgctagctggttaagaaatcatttagaaatgaaacagaattggttgttactccaagttaataagttgcttgtcaacataaatcctacctggtacccagttttcttaggaaccttgcttccatgtttatccttttctgcttagtattctaagtactccttttttaccttacaatttagtcttaaaacacaacacagtcaagtctttcttttgtaacctgtgagrtaccttctagcctttgtgctgtttttcttctntttttgctgcctgccttcctgactgagagtggatttcctcactaaggctctgccctctgatttttcactctcttttcttttttggttttactagtgaaattttgtctttaatgtctctttcttttatgtctttaccgatcactcataratttttttttccatatgtatccagttccaacctttcacctaatgtgaacccccaactctcagttgctcagccagcccttcaagactaggagttcaaaaccaaacttgcatcttccttcccaaaccagctttcctcttgcagttttctgcagcaggatccttctgctgtttaacttttgcctcctcccttgtttcctagcacccaatagttggaagatagtctgtcttcaaaattttaaactacatttatgtccaaaccagtggcttttccttttaaaaaaatttaaagataatatgtgcaaatcatttttttaaaattcaaacagtatttaagagtttcagtgaaacatgmattttccttctaccctggtacttagttttactccccaagggcaatcactttttactggtttttaraaatatatccttcctgagatacttatgaatatccaaaagtgtgtgtgttgtgtatatcaccttttatatatcctgtctctttacgtgcatgcattttaccgtataaactgttttctaccctgctttttctatttgacctattttggaaatgtcattttatttagaacttcctcatttattttaacagctgcataattagcagtaaaacttatgtaagcagtcccttgtgaagggctgtgtctttttgcgattatatcyggtgctatagtgtacatccttgtgtgtgcatcttggtgtgcctgtgctacgtatttctgtaggataaatctgtaaaagtggaatcactaggtcagagggtatgrtccattttctttacttatttattttatttatttattcatttatttttgagacagagtcttgctctgtcgcccaggctggagtgcagtggcatgatcttggcttactgcaagctccgcctcccgggttcacaccattctcctgcctcagcctccggagtagctgggactacaggcgcccgccacccacgcctggctaatttttttgtatttttagtagagacggggtttcaccatgttagccaggatggtctcgatctcctgacctygtgatccacccatctcagcctcccaaagtgctgggattacaggngtgagccaccgcgcccggccccattttattayctttatttgcttggatccttcttagcttcttcaatgttaaagatattgacagttttcctcttactgaaatttataaatccattgactcccttgatattattgccctggcctgactgattcttctctctcctttctcttctcaccccatgttgaggtccccaaggtcacacccagttttgatgactcaccagcatagagttgtacttgtgcctatgatttattgcggtgaaaggatatagagcaaaattgcaaacggaaaggcacctggggtgaattccaggggaaatccagtgcaagttccaaggtcgcctcccagtggagtcacataggatgtgcttacatcctccagcaaggagttgtgacaacacttgtgaaatgtggactgccagggaagctcatcagagcctcagtgcctagggtttttactggaggctggtcacataagcaccctcacacatatcaaaaaattctggtcccccagaaggaaagcaggtgtttagcataaccatattatttgcatgaacagttcaggtacaggaaatccccgttaccagttaggttggtgggtgcccttcycaaatcccaagttcccagacaccagccaggggcctgcctcgtaaggaggcctttccaggacagcagtcaggcctgccaatgttaattcttttctgcatacctcctaattttagaaaccaccgagcctttgctgcctgacctgtcctgcttttcgatttctttatctactttgatatctttacaaatgatctttaccctgacttttaaatgtgtgctctggccattcacctagcgtgtggttctgagtctccaagtcttagcagatttgctctcagatgctctgccaacgcttcacaccaagtattacaaactaaactcgtcatcttcctcctgaaacctgtctcccaggccaggcgcggtggctcacacctgtaatcccagtactttgggaggccgaggtgggtggatcacctgaggtcaggagttcgagaccagcctggccaacttggtaaaaccccatctctacgaaaaatacaaaaaaattagccaggcgtggtggcaggcacctgtaatcccagctattcaggaggctgaggcaggagaatcgcttgaacccgggaggcggagattgcagtaagccgagatcacgccattgcactccagcctgggcaacaaaagtgaaactccatctcaagaaaaacaaaaaacaaaaaacctgttttctccccagctttgtcatgtatttagtggccttatgtagacagtttcctttgaaacatctcttggacttctctgctcttccagggccattgccacygacctggaatgtgtccttatcgtttcacgccaggcttatggcagcagtcagtcacccagatgacctcctgacctctggcttatttcacccccactggactgttgttcctaaacacttctttcgtatgtcactctaaaatctgaccctggctgtacctttctttaactactccctgactgcgtgctgagagaagatgggtcttgtcttttcctgcctctctgcttttgtaaactgccatttctacctgaagtggcaactgaaatcatatcttcttcataaactgtctttggctacctcagttagaattccttatcccattttcctgaagcatttctttgactcttctttactgctcccccacccttttttttttttctttgagactgaattttgcttgttgcccaggctggagtgcaatkgcccgatctcggctcattgcaacctccgcctcctgggttcaagtgattctcctgcctcagcctcctgagtagctgggattacagtcatgtgccaccatgcccrgctaattttgtatttttagtagagayggggtttctccacgttggtcaggctggtcttcaactcccaacctcaagtgatctgcccaccttcgcctcccaaaatgctgggattacaggtgttagccactgcgccygacccccattttttttttttaaagatgttgaattggtcagggtttgtagttacaagcaacagaagccaactctttaagcagaaaaggaatttgctaaatgatagtgcagagttctcagaatctctagcaggatgaagaaccaggcttggagaataggtagccacagatacacaagcatactgtaggacggttcccatgaagaggcatctgttgtcaccactggacacagatggtactgtgtctctgctactctaccaatgccactgctgtctctgaccccagatgtagctccctctgaccctggatgcagctccctctgaccctcgatatagctgcccctgaccccggatgtagctgcctttgaccccagatgtagctttctccaaacccagatatagcggctgcccccttgccagagtgaatactgcgtcattgtggcttcttcttgtcactggttcttacttaaaagctgagctggaagttctaatgggcagttttgtcacctgctcttaccttgttgcagtctagatgaggtctaatgttcataagctaggggattttcagatatggaaagggataccaattttcarcagccacatagagtatcacattttcactcyatgtttcctgggtgtctgttatgtttcctgggtgtctgactcttaggcttctttcaagctgcagtctgcctaatagagagccttgcatttaatcatcaaaaaggcaaagcaatatnaatcagcaagggtgttttggsaaataacagcaaacctgactgtggcgtaagcttgtggtattgtctccagtgtgatcagatctgtattttaattttttaaatgtaaattaataatgatctgtgaatcaccaaagtagcttggagtagcctagaaaacaatgtatgtcctccgttttcacagaagccacatagtcgtgggttaaatgagtcagcggcagggcactgtgtctcatagttaaaaaaaaaaaaaagtattactgaagyaatgcaggatcttttctgaagtagaaggcatgatgaacccagaaaactaaagcagcaagtggccaccgttcttagcatagttgtttctcaaactggaacaacctataaacagttgtgaacaaggtattagaagtgatgggggccgggtgcggtagcttctcccaaagctcattacctcccaaagcaaccccagtactttgggaggatcactttgagcccaggagttccagaccagcccggccaacatggcaaaaccccatctctctaaaastacaaaaaattagctgggcatggtggcacatgcctgtagtcccagctacttggatggctgaggcaggagaatcgcttgaacccgggaggcagaggttgcagtgagctgagatcacgccactgcactctagcctgggggacagagtgagactctgtctcaaaaaaaaaaaaaaaaaaaaaaaagtgatgggaatagattgttttgtctcaaaaagctctttccaacactaaaatgaaacatataattaaaaatatttttctggctataraaatatcgatgcttattatagacatctgcaaagtatgaaaatatatgaagaaaaaaattaaaatsccatcatcccccatgaaaactattgttatcatttttgtctgatttctttagtgtttctctttttctttttttaatttttaatttttttgagtatgtagtakgtatatctatttatggggtatatggcatattttgatacaggatacagtgtgtattagcaaggttttctttttaatgtttatatttatttagttgagatcatactatatatggctctatagattactttctcacttatattactaacwtgtgttattaaatattctgcataaagataattttaagatgaaatttgatgttataaaaacttctcattttattaagagattaacgctatgaaacctgctgctatatattcttggaaccagctgtgacccaaaagatcaatgtagggatgtaggtccttccccattctctacacacaaaatcagatactctgatgtgcagctgtagccccagtctacactgtctgttgtattttttgttttctggtgtcaygtgcctcccaccctgctcctagcaattgccatgacaacaaatagataattggcttccgtaatttctcatcttattgcctaaggcaacagagagcttgtgggctcagcttgcggttcagcagctgctttgttgcctctcctctgtatgtgtgaggcctgccagagcccactttccagacaggtgagagttcattcattcaccatgcagttaccgatcgtctcttgacctgtgtcctggggaggtaaaggtgaygagccagttctgccccatgcagctcacagtctaggcaaagctacatgcaaacaaacagaatccaaagtgctatcatgaaccctctgagaggggctgactcagcagcccagggagcttgaagaaggctccacagaggaggctgtgcctsaaggcgatttcggtttaggagccaccaatttataaccacttttstgtggcccgtcttattttatttcttatttcttgacaatcagaagtaccttgggtaggttttaccatgcacatcgtaatttgagtgagcttagtgtgaggcttaacggtgtgtgggctgtacatcctggtcagatgctcnagatggaggcagatggttgtgatgcaggagaggcagccacatagcacaggtccccagccagtggactgggaagacagtgtagtcatctctggggaaggggaatgacaagatctggcagtgtggcaggtcccasaaaaaaagggctgggttctgggcagtgagggtgcaggttgagacctgaatactgggtggagccagctgtcagagtccacgcctgcagactggactggtccacggcaggtggatgccatgtcttgaagacccacaggcacccactcatcctcatgatcatgcagttctctggtttctaacagtgcagtctgggttgcagtctgggagtccagcagagaagagcaggccctggaatcccaggtgtgggggcgtggcttaacgtggagtttccttcagaggcagtgagtgcttgtcattgtctccgtcagcattggctttgggcctagtgtggcctcgaaccttctgttgggatcagcagtggaacagtaggaaaaggaatgagtagacatggcattgcaacaagtctttttttttttttctgttagaattatcatattaagcagaagttttgcttcacaaactctcagccaaatacaaaatactatgaatagtatttaccttgtgtctctttccaaagaactcatagtggtttgcagctattgcagatatcctggccatgaggtatgcagttcctttttttttttttgagacggagccttgctctgtcgcccaggctggagcatagtggcgcgatctcggctcactgcaagctccgcctcccgggttcgtgccattctcctgcctcagcctcccgagtagctgggactacaggcgcccaccaccacacccggctaatttttgtatttttagtagagacggggtttcaccgtgttagccaggatggtctcgatctcctgacctcgtgatcctcctgcctcggcctcccaaagtgctgggattacaggcgtgagccaccgcgcccggccgcagttcctttttntagctgtttgaataggaaagatgacttggaaaatgctggattctgagatttatgtgcagccttaaaaagtgtagtttttctctatcaataatgagtgtgggttgtaattgcttagtaagtaattttgtttatgtaaacrtacatttgttaaattttttttcttaggtaatcccgtwtgttggcaccattccygatcagctggatcctggaactttgattgtgataygtgggcatgttcctagtgacgcagacaggtaaaatcactgtgctaaaggaaggagcatgaataggctgtctttttgtgattgtggaatgataacagagtaaggcgggagagaccatttgatactttgaggcccaattagctttcatcagcagccctggccaaggtgctgaggagattggaatgaatgactaaataaaggttattgggatttatttcattgctgtaagtctgatttcagtataaaaaattagaactatcagctggatgtggtgacttaaacatacttttccagcactttgggaggccaaggcaggaggattgtttgaggccaggagtttgagaccagcctgggcaacatagtgagaccccccatctgtaaaaaaaaaaaaaatttaaaaattaactggcttggtggtgtgcgcctgtagttgtagctactcagggggctgaggtaggaggattccttgagcccaggagtttgaggttgcagtgagctgtgatcgagccactgcactatagcctgggtgacaaaaaaaaaaaagaaaaagaaaaagaattaggtatgtcattaaagaaaggaattgtggtcagatgacagggacagtctagttttagtctgacattcccacagcattacagatctagttcagatggttttactgaatacctgctttggatacaagctgtggtatcattagtgttgggctcagctctgtgtacctaacacctgaagagcagtggtttaagatgtgaaaattaagtctcaaggagacagcccaggccttttcagttaactccttcaagtcgttagagaagtagactccttcgagctcaccactctgttatcttgagggtgaggtaaggtcccctttcccgttttccttggcagccagatttccagccctcacttctgtgctttgggtagctggatgggtgcatgtggtgtttgcggggaaacagagctggacaaaaggcaagtgcttgctgacttctaaggcagtttccagtagccttccctgagcacttcacttccatcttaccagcagagctttagctgcacaggcaggcctagctgcgagggaggctgggaaaggtaggtttttattctgggcagattcagacccagttcaaactcaggggctattttactgaggaagacagaaaagattagacagtcagctctttaggcctcatagtgaatgaatgaggagggattggtcagtcccttgtcactgggcctggagtgtagtgcctgctggkcctttactggtggctttcctttctgagcactcatgrggcccctgtgtcttccctcatatagattccaggtggatctgcagaatggcagcagyrtgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctgaaggacaaattccaggtaggttttggagagggacaggttgagtcctcattagtgagcaggagtgcacaggggkgcytttcacatttgtgagcccagccttrtatttcctacacctgagatatagtttgtttggctttgtagtytttctccataaaaggaccaggaaggcacctaaatgtgaggtatggcaccactactctccagccagttgttgccatgcagaaatatggtccactgtgaccagatctttttattagatcctatttctcctagcagggctgagttccgaattgacacagtattatgttcatgatgggagggtaagttataatataaccgccaccacccgaagagctaacaagggcaatcccagcgaagaaatcagaagggttttgtaaattcaagtcttgccacaagacagttccgtaggatcatgagattttagacccagaggagatcctagaaatccttgatgtcagttccatctctggcttcatggagtgtcttgtacctagcgtgtatgtgtacggttgaatttggtcccagaagcttacacctgctggccctctggcctgtggagcttgcccacagtagaggtatgtaccaacgcgagagaagactcgaatgcctctggcgcagatcctttctgatcttcgggatactgctcctgcccgaaagtctttctgaatctcccaaactccattcacctctcccttctctggccttttgagcccgtgtctgtatcattctttttcacagtttttaacagttgtgctttggctttaygtgtttattttgcctccacaatgggatttwaagctccytgagtcagagactatattgtatgctgctcgcgttttctgcctataacctaacgtggtacctggcatttgagagggagggaggaggagcctcgtagcgtgccgaggacctgcagaagctactttctcgtcatcttactgtagtctgttgaggtagagactgttcctacttcagaataagaaaaccgaattcaaatatgttgggtaacttgtccatattaatttatttagcaaatacaacagattttgagtgtctgccacatgggtggtctccagggacagtgttgtggggagctcgcaggcagatctttaacctgggttcacaatctccagggcacctgtgcctgggcttccaggcgaccttcgaacccagatgtctcacatgtatgcagaggcgcacacaagcacacgcacatatacttatgactgcctgtttgtctggggagagacagttcctggtgcttaatcaaatcaggaactcaaaagaagttyggaagcactgctrgtgttttgggtgctttcggttaccatttggtcaygtgtgtggagacctgtgggaacaggtataaaaytggacgcaaggaaacatttaaatttggataataagttaatttattaactgtttttttttggtggcggggggggctctgtcttctgtatctctctaggtggctgtaaatggaaaacatactctgctctatggccacaggatcggcccagagaaaatagacactctgggcatttatggcaaagtgaatattcactcaattggttttagcttcagctcggtgagtgaccttccacagcttggggtcttttatgaggatggtttctgatgagatggtagaaaaaatcttcaaataacacttctattgacataaaaaggacgtatctccctgactgtagtattaattttttggaagtgaactgttcacactagcagaaggctgtttatcagccagggcttcattgtctgtaggatctcaaacctagtgtggttttaataaaacacacacagtttttagctgggtagcagctatttcctttgcatgggcataaaatggagtatttctgtaagacaggttcctaggctgggagtgcctgagtcaaagagcacagtcatgtgttgcataaggacagttcagtcaaagatgaaccacatatacaaccgtggtcccataagattgtcatatactgtatttttaccataccttttctatgtttaggtaagtttatatgcacaaatacttaccatcctgctctggttgcctacagtatttggtacagtgcctgctgtacagattcactggccaggagctataggccacaccctacagcctaggtgtgtagttggcagtaccatctaaggttgttaagtaatattctgtgatgtttgcacgatgacaaaagtcatgtaaggacacatttctcagaacatacccccttcgttaagcaacacatgactgtctttgcattgaaaattttgatagatactaactcgcccttcacaagggtaaaaacagtttgcactctcaacagccatgctcccaccttcttgctgacattacatcttattctctgtaatgtttgccaatctgatggggggcggaaaggaccacagtgtcaagtgtatttttggatcatagttttcaagcatatttttagtaccatttataatttttttatatgtcaatataaaatatttagaaaatattttctactggatgttacaaattaatctttattatcttttctcaggacttacaaagtacccaagcatctagtctggaactgacagagataagtagagaaaatgtaaatattaaatcttttaatgagccactggtttaaaaatgttgttttagctgccatgttaatgaaatggcaagaaggctgggtttttgaaaattatgcttttagaacgcaagtaatcacttgaaaattgagatacatacttgtggtgccaggcacgcagtaagtttttgctgatgattcacctgtcagtttctgtaactgccactcactgttcttatgtaaaaagcactctctcactcttaactgctgaatagtactgttctggggtatttccaaatattgaacatcagccagtgcactggcaaatgaacttccatgtgtatcttcaacccctgggagaataactgcaatttaaaaatgcgctgttattaatggagaaagtgaggtcttaccgactggcacgttcacacctcacagacagaacagaatcttagcattctgggggcaccctggaaaggacaactaagacacgtttgaagttcatgtagtgctgggtgaaggtggtggctcaggcctgtagtcccagcgctttggctgaggtggggggattgcttgagcctaggagtttgagatcagcctgggccacatagggagaaccccatctctacaaaaaattaaaaaattatctgggcatggtggcgcatggctgtgatcccagctttgggtggctgaagtaggcggatgacttgagcccaggaggttgaggctgcagtgagccatgattgagccactgcatcccagtgtggatgacagagtaagaccctgtctcttaaaaaaatttcatatagttctatgaaaaattattaatttatggtggaggataaaggactcagatgaacagggatatcagactctcttctcaacccgtgtagcccttcacaacaccataccattccgtcataaagcaccagctgcctggaggtcacaccagagtggagcaggaacatcccaggctccggccaggctcagctcagcacaaccaagacttcagattataaactataattcttccccttctaacattgttgtgttttgtttcttttccaataggttccaaagtctggcacgccccagcttgtgagtatttttgcctgggttatttcatgtggaatattttataaagttgcatagaaaatgaacagtttaaaccgtggagggcagcttcattcattccattccttactgtagaactgtttccctacagcctagtaatagaggaggagrcatttctaaaatcgcacccagaactgtctacaccaagagcaaakattcgactgtcaatcacacttwgacttgcaccaaaataccacctatgaactatgtgtcaaaggtttgaagagcmccaaattttcttaactctrtataaaaattaagttgtaatgagctgttacgagtaacctgtatccacaatagangcccaaagcagccccctctgcatttgtgtgccgtccctggayggattcgagagtcaaccaggcctgcctctgagccattcctgtgtatttcctcagcacctccctgcttggctgcttccccttcaggcagaacacagtactgcctcagaccccaggcacagggggccttcctggcgtgtttcactcatacagagggcatcgggtcccaccctgtcactcatttcatcgtctaaaatgtaatcatgwgtgtttgcttcgagccagggacagtgctgctgcaggggacccagctgggaccaaggcagactgtctctcccctcstgggatttacagggtcatggctctgaaacattcngkagtgttctttggacacgagttttccctggagatcgctttctgcaggcctcttggtcctgactgtgscttcttttcagagsctgccattcgctgcaaggttgaacacccccatgggccctggacgaactgtcgtcgttaaaggagaagtgaatgcaaatgccaaaaggtcagtatccttcggtaccagtcacagtgcagatacttccgtgcctgttaccgccttcnacccgtgaacggtcctgtgagctggaagwagggctagygtcagaatcttcatttccaaagtgagatgattcaagcaggaggwggttagattgtgaacagccagtgggcagcagagccgactaaggccgtgttctgacctcggctttttctggccagacaagagagtagcatttttgtccacgaggcctatccttgccttgtagaactccagagcagccccgtaagatcaggcaacatcttttcttttttttttttgagatggagcctcactgtgtcacccaggctggagtgcagtgtcacaatcccagcacaccacaacctccgcttcctgggtgttcaagccattctcctacctcagcctctggagtagctgggattacaggcgcaccaccacgcccagctactttttgaatttttgtatttttagtagagacaggggttcaccatgttggccaggctggtctggaactcctgacctcaagtgatccgcccacttcgccctcccagtgctgggattacaggtgtgagtcrccacgcccagcccaggcaacattttttagggcccctcttgtcatgtgatttagaaaatttctgctttaacaactttttccacagacgtccagccttctgaaagcttgaaattagagctatttcctagaaagtggcatactttcaagaaggaaggaacacgggtagatgatgaaaagagaatacctgcttgagaggatcccaggctcctgcagcctgaagtagtcattcagtttagcgttaaaccttccatttctgtccaaccacatctcagcctcaaygctgattttaaagggttttttttttcgtatttttattttgcaagtaacgaattagtggaatgctgactgggtttaaaatttcaacttcacctgcattcccatgtccatgtggatacgtgtgtttcatagagttagaatcatagttcaagtctggtcactaacattgctgaaattgccactactctgtcctacttggttaattaaggtttttttttttcttyctttctcaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgaggtgaggttmcagtttttgaaaatgggacagcaataagaatcctgggagcaggggtgggataagtggtccatttaaatcaagtcctaactcagtatgtggargytgtgtatgttttttgtttacttggagattgtaatttgcccctttttataacgtgggcaatcagtataaatggcaaagccagtagagtgtcaaattatgcacattggaattgacatttgtcatcatattaaaattcctgtgtagccccatattgataggaatttaaccaggaagcttgtctcaggactggagtcacacatttaatcatataagcagacttgaggacgtggagaccctaaaactgcttgcttgcactggccatcatctcccatcagggtagacggtttcaggtggcagtcctttctcctaaggagttagtcttgtttgtatgtattcaaggaaaaatacatcagtcccttggaactaaaaggcatgcagtcctgagtccccagataggtgaatattgtaacacatacctttcccgaaatatgtttctgggatgctgagcagagaatagtctccttgtgatgcggatgccgggtgtttggccagcctcaatcaccagctcaggtgccactgcctcacacagtcacttagggtcattggtttaggttatcattctacagcattttaaactgacacattgtctggaccatgtgggttcttgaggactcatcaaaacycgttactaaaagcatgaatatcaggcgraatagatagcaatgtgacattcrtatttatccctaagttccagtctaatgcagtgccctggtatgtggagtgtagacagatgtgggctaatcatggaaggttccctgaagttgtggatattggtttggaattcagaaagctgggaaggatgtggaaggctgaaggttggcttttctagatttagggcatgatttgaacaagtccttagaggtgggaagggcagcacagggttgttrgcttggcaagagtcaaggygcaaagggtgacttggggttcactggagggaaacagagrtgagtgctctagaaggaagttgagccttgtggtgggtgacaggaaaccaatgatgtaacttgtttttgacctatctgggccccaagtttggatctgctatattaatataaaaaaggataataatgatacattcaaataatgctgaaaaatactaagatgaaaatacctccaacttcrtaattcaaaccataccattaggattaggtgaaccacattccaggcntttttttgcagagacagtgaaarggatggctggctgaaggaatgaatagatgaatgttatatgcttttgaacaatcgtcttttccatttaattttctaattcaggagcagtaattatccttgtgttgatcactgctgacgattttctatactgataggtcctttccgggggcttccatctcttgccttttaaatatgcttgcattgagattatctcaggtctttccattatgccattactttcattttaaatcttcttgctctttcaaatacactttagttgtatctacagtmttttaaaaacaatctcattcagtgttgtaatttcatctgtgggctcttcctctggatgaaatccgtgttccagctgttcggcagcatcagatggttgtgagggattctgttgttctgttttcttctaggcaaaggatgtgccttcttttcatttgcagtagtctgctcacccggaagcatgtcatttctttgccacttgcttgtaattcnctggctttgcacttgctctgatacagtacaggtaactaattgactccctctgctgccaacttggttttccttctgagctatagcatcaggctgtgtgttttgtgttttcttgagattttgttaartatatctggggtcccttctacctggttggaactgggattcccaccattcttgtggggatagaatctcaggttacacctatttccccaatcctctgtagccacagaagcttcatcttggccagctgttatcagagtgcaggacttgggctgaaatttcctccccttcctgattttccttgacagtcctttccactgctccthtcaaaagaatgraaaccctcaacttgctgctttgcagattcaggttttgtgcttcwttctggcctctcgggktggggccgggtkagcagcaaggctgagctgcccctctttcttctgaagccttcatgggggcgaggagcacagggagagctcagtgcagggcctcccagtggccttctcagagtgggtggaaacccagcctggcactggcagcgtggcaccagaagtatgaagtgtaggtgtaaaggtgatgtaaaaggctagtaggttttttggtttttcrttgtttgagttttgggcatagatgactgtgaagggcgaacactgccgatggatcdatgaatttgtagtatgtgcaccacttccracttacgggatacccagctttgacggctttggacaaacacactgaggccaagatgtgctgagcttatcaggatcaggatcaccaagcagctgtaaaaaccctagcaagtgccttaagctgctgaaatttcatattaattgtctggtttgttcatggtcctagagtttgaggcagaaaagtcagtcaggatccaagtcccttggttccaggctacagctggaaacagcatctcggtgaactaaagcaaccatattaggagtgagttttcctgctttaggagagtccccagcatcggcgaggaggggcagcactctggctttccaggagcaaggggcaggatgcggccgagggagaggggctgtgttgaggaaaggagggccgcaggccctggggatggtgtgaggctccaaacatgtccgagtcacttccctgggtgggatgaggcagacagtgccaccaccagggacactttagttagattagggtcttggaagtcagaaggaagtcagcagcagcaggctggaacttttctatgtatwatcaaatggtttactctgacaccgttagcatgtaacaaacacaaaattttaaactaaggggaaccactaatggcatgtwtcctttcctttcagatgataatttaytgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccattagrtcctgctgggtgttctcagtccttgccatgamgtatggtggtgtctagcactgaatggggaaactgggggcagcaacacttatagccagttaaagccactctgccctctctcctactttggctgactcttcaagaatgccattcaacaagtatttatggagtacctactataatacagtagctaacatgtattgagcacagattttttttggtaaaactgtgaygagctaggatatatacttggtgaaacaaaccagtatgttccctgttctcttgagcttcgactcttctgtgcnctantgctgcgcactgctttttctacaggcattacatcaactcctaaggggtcctctgggattagttawgcagntattaaatcacccgaagacactaanttacagaagacacaactccttccccagtgatcactgtcataaccagtgctctaccgtatcccatcactgaggactgatgttgactgacatcattttctttatcgtaataaacatgtggctctattagctgcaagctttaccaagtaattggcatgacatctgagcacagaaattaaggcaaaaaaccaaagcaaaacaaatacatggtgctgaaattaacttgatgccaagcccaaggcagctgatttctgtgtatttgaacttagggcaaatcagagtctacacagacgcctacagaaagtttcaggaagaggcaagatgcattcaatttgaaagatatttatgggcaacaaagtaaggtcaggattagacttcaggcattcataaggcaggcactatcagaaagtgtacgccaactaagggacccacaaagcaggcagaggtaatgcagaaatctgttttgttcccatgaaatcaccaatcaaggcctccgttcttctaaagattagtccatcatcattagcaactgagatcaaagcactcttccactttacgtgattaaaatcaaacctgtatcagcaagttaaatggttccatttctgtgatttttctattatttgaggggagttggcagaagttccatgtatatgggatctttacaggtcagatcttgttacaggaaatttcaaaggtttgggagtggggagggaaaaaagctcagtcagtgaggatcattttatcacattagactggggcagaactctgccaggatttaggaatattttcagaacagattttagatattatttctatccatatattgaaaagaataccattgtcaatcttatttttttaaaagtactcagtgtagaaatygctagcccttaattcttttccagcttttcatattaatgtatgcagagtctcaccaagctcaaagacactggttgggggtggagggtgccacagggaaagctgtagaaggcaagaagactcgagaatcccccagagttatttttctccataaagaccatcagagtgcttaactgagctgttggagactgtgaggcatttaggaaaaaaatagcccactcacatcattccttgtaagtcttaagttcattttcattttacgtggaggaaaaaaatttaaaaagctattagtatttattaatgaattttactgagacatttcttagaaatatgcacttctatactagcaagctctgtctctaaaatgcaagttggccttttgcttgccacatttctgcattaaacttctatattagcttcaaaggcttttaawctcaatgcgaacattctacgggatgttcttagatgcctttaaaaagggggcagatctaattttatttgaaccctcactttccaacttcaccatgacccagtactagagattagggcacttcaaagcattgaaaaaaatctactgatacttactttcttagacaagtagttcttagttaaccaccaatggaactgggttcattctgaatcctggaggagcttcctcgtgccacccagtgtttctgggccctctgtgtgagcagccaggtntgagctgttttagaagcagcgtgttgccttcatctctcccgtttcccaaaagaacaaaggataaaggtgacagtcacactcctgggttaaaaaaagcattcmagaaccacttctctttatgggcacaacaaagaaacgaaggctgaagttcgcctacccaaaatgaaaagtaggctttacagtcaaaagtacttctgttgattgctaaataacttcattttcttgaaatagagcaactttgagtgaaatctgcaacatggataccatgtatntaagatactgctgtacagaagagttaaggcttacagtgcaaatgaggcgtcagctttgggtgctaaaattaacaagtctaatattattaccatcaatcaggaagagaataataaatgtttaaacaaacacagcagtctgtataaaaataccgtgtatcatttactctttctgcagctctatacgataggcaggagaggcttatgtggcagcacaagccaggtggggattttgtaamgaagtgataaaacatttgtaagtaatccaagtaggtgtattaaggcaccaaaagtaacatggcacccaacacccaaaaataaaaatatgaaatatgagtgtgaactctgagtagagtatgaaacaccacagaaagtcttagaaatagctctggagtggctctcccaggacagtttscagttgctgaatagtcttttggcactgatgttctacttcttcacattcatctaaaaaaaaaaaaaaaaaatcaaaattaaaatctgagtcagtccgcctgcctcggttctcattagtttaattcttaatgccttgcactttccggcaatcattcaatcaaaagagtgaaatgaagcacattaacaaagcaggaggcgccacggaccgcctccctccacaccgctccttccgccttcattccttgcccacaggcttgcactggaagctgaataagaatccccaaaactcaaacttcctagggatgccacccctttagtagctcacacctcccccctccaagagctaagaaacaaaggagaatgtacttttgtagcttagataagcaatgaatcagtaaaggactgatctacttgctccaccacccctcccttaataataacatttactgttatttcctgggcctaagactctatgttccagaactgtcacagctccccatgtcacactcactagcttgtgatctttgtcaaataactgaaatcttttaagcctctagtttcttcctttgtaaaacagagataaaatgttgtggtttttaagtgagataatccaagtaaagcacctaacatggagtagtgaatgaacatcggttgctactaaaagtggacatcctactgcatccttaatgccactaggcatttccatacaatctggggaccaaaacttcaatcatataaatgtatgaggttaattaaaaacactactgtaatctgcttgtatgatcacaaaccaccacaaaagaaaagatcgtgaagattacactgtaaacggactctcaaatgatcaggaggtggtcacttcgcaacttgctccctccacccaactcaaaacaggagctcgagcctgcctgtatttgagactggagctgcctgtatgaggactggatcaactgctagtcacgttatatccaaatctgcattatcattgggcacattttcacagaattttactgaattattccttaattgtttaatggttgggaatagtttgggaattaccttccatcaactctgctaagaaaggaatggattctggtagcaagacaatataattctcctttagtttttcagccagtgctaacacagtaatcaaagcagcaaatcgaacctgaaagggataaaagagcaaagaaataaaaagtagtgttactgtatttattatcttaagagctgtactgacttgagacaagctctaactttttaaacattagttcacatgcgtttattcacttcattatgttcattaagctttcatcttagaataccagtttcaccatttgggagctgtttgtaatatgtgcaaccttataaatagtgttttccaaactgtgtcccaggactgcaaatctttaatgtgaaatgtctttttataatctcttcctttaaaaaaaaccaataaaataaaatgccgcatgcaaactcaagtgtgtcaccagattttacttcattggcgctcgccagcccgccaggctggcaataaagtgcctccagccacctctggcaggtctcctcacccacagcccctgactggtcaccactataattgtatgaggggccaggacagtcgcttgggataaactcccatctcagcactgaataaaaaacattctgtgtcacaatatcctagttttggggctttaaaaacgtctaggtgttcctcacatgccttgtctataataaggaaagcaagcagtagttgggtattgttagcttttgaaacaaaagccctactggtcttctaattttggatattttaattaaagaatatctggacagtacaaagtgaattattaaaaaaccatttgtaactacctagattcaatcaggatttccttgatttgtgcaaagtaaaatattacaataaatttgatactgctacttgtataaaaacctatggtttaaaatgtgggggttcatcataatagtctcattgttagcatatcctaataaagaatttgaactaataaatcctattaataaaattctgctttggtctgttatagccagtaaagttctaatacaatcattagtttgagaaatggtgactcattgctaaaacagtttgaaattcgtaacacttgggtgtcaaattttgacttccactcaacctacccatgttttatttccactgccaccacttactcaacaagatcataagcctagtatctataaacaacagaatgtattgctctaactcaaaagactatagtgtggataaattcaatgcatttctctctggagcacaatgacatttcaatggcacttaaaaaagaaggaattacttcaaatctttgttatttaaaagtatttagaaagtattttagtacttctgcccaacgcaccattggggtggggatagggcattgctattctttacaaatagcctgtaagtaaaaaacaaaattttcttaggcacaaatttctgcctaatacaaaagaccggacctctagtactggatgacaaatagcaatgttcttccctgccagtttactagggggcctacatctgtgaccacctgcaggctgtttaggctatgcagtgaaaagatgcagtttcagtacttgtcacgcagttcctaaccttaggcgaggagtctctcgtctttagcagaatctggtagttcagtggtttccaaagagagtcatccgccatggccaccgaaaactgtgcgatgcatggtatcaggtgctttgtcacccgttcctggaatttctcttctcccccaagcctgttttccagctaggaagagtaagacaaagactttgaacaacaagtctcatttctttcttctgtttgaaaaaatatccaacatacaaatattttactatctttcatgatattagcaggttcaaaaaccaggcattattctaatactctctagggcaaatgtattgccttctagaactcaaatggaatctcataccctttatcatcgcccctttctctccagcagaacatctcagaggagctctttgctccagaggacagccatgctctgacgcgttctcagtgaggcccagttaaaacaaatgaatacattaaccatgacagcttatatcatgtctgtcttttgagcagtttaaaaaataaaaaataaaaaataactcagggccaggcatggtggctcacgcctgtaatcccagcagtttgggaggccaaggtgggtggatcacttgaggtcaggagttcgagaccagcctggccaacatggcaaaacctcatccctactaaaaatacaaaaattagccaggtgtggaggcgggcgcctgtgatcccagctattcgggaggctgaggcacaagaattgcttgaaaccgggaggtggaggttgcagcgagccgagattgcaccactgcactccagcctgggtgacagagcaagaccctgtctcaaaacaacaaaacaaaactcaaattccacaatgaagttatatctttgaaaaaacaattttcaaataaaacatttcattaaaaagaccagaaaaaacaaccttacaaagaaaaatcctagcaagctgtcatttgagcagatctaaaacctgccaagctcgaacagtgatggcttcctcagcaacgaaagatgattctgtttggttacctgatccaccagaggcatcatcaaggcttctgctctctctttacttataaaatgctgggtatcaaaaaggaagattttgtataaacagttcaaaataaactgcaacagcaagcagcacttttcagggtcattttcagagtcaaaaaatgcttcatctgtagacgtgggaagagtaaaaatgaaaaaacactgaacttaaccatttaatctccaatgtttacattgaaatcactattaaaataactaaatcagaagagtctaaaatgatctagaaatcataatcaggacgaaggcagaacacaatggatggtctctcgaagaatgattccttcttttagagttaagattctaacactcactctggcaagttaaattccctcaactgtcaagtgggtcacgtattagcattagagaataaactaatcttaatttttgcgttttaaagttacttccagtaactgacagtaacggccatttactttattctttctcccaagtgaggtgacttataacattcgctcatgatgctaaaacaacacttcactgtctgacaacaatgaagtaaaaaattcaccctccttagcttaggacttaagaacctctaaaatcttgcttccaagcactaggttgtgtcttactggtaccttgtataaggcacacagggcaagggtgacagctgaactgaagcgaccacccacctgttttggagatgttcacctggttcaaggtgtcagcaaaaggcttcactaagtggccggcaaacagagtaaaaagccctttcagcttttcagcaatgcaatctgccaagttgtaaaatgtcaacaacctgtcctttggggcatcttctgttttagcccaatcaaacagctgaaaggataagacagtattagtttcttcgacatcttgtcacttaaatctgagcacaaaagagaggaagaggaagaaagcgtcaccttgaagaacaggggcctgaatgtgacctcggaaagtttgacaaccatggctactagacagtcaatgatacaattttccgtttttccaacttcctccagatcgttctgaaaacagaagagcccatttattagagtgctgatacctgactgtaaattattttggcaagtaccactgttacacggctagattgttctcggactcttcaataggtggataacagctttaggatttggaggagtgaacctgagcttacctcagagtgctgggctcggaagtccagggcttccaggaaaaaggcggttagctgagactgatgggaggtgagctcttccttcttcatcaccccaatatgctcttgcaagatgctcataaacggacccatgtgattctaccaataacacaggaaagagatgtgccattttcaaatgattcctagagttcagcggtgtgtatttttaaaaactaaatcttcttctttaagtcaaagtttacacattgcagtaccacctctcccttctccaaagtcttaatacccaataagatctaaccttccagttcttctcaatctgcttgtaagtttttttgatggcgggcaacaggactcggggtgcaagtgtggtagccagtgtctttttaagagatgtgagacggatattagcctgtgacgcagaacccatttcactagtgattttctccagatgaatcacctacaggaatataaaaaaagtgatcagggccactgcagatcttcgctgacaaacacacacttacagagaggcttcatgatgaggtactagtgtttggaaaatgcttagcactttttaactacacacagaattccttttaaagtcagccctaaacgtcagtggataaaactgggcagacacctcttgcccaacttgcgatcagggacgaaggccgatggtagacgcagacgcacacacagcacccagacagatgattttcttagaggacaggaatgcaagggaccacggcaagagtcaagttgctaaaaaactgagaaagctcctcagagcacaggcccctttctctgagaaggctacttttaaaccctggctgtggtgtaagtgaagcggtttaatcatttgccccatggtaatgaaggctcctaaccttgtaaatggcaaatgatcaacacaatggaacagccaggtctcaacattcttgagcatcttcaatcataaataccactggcccctagcgtgttgacaggaaaccgctgacgtgcaatacaaaaattctgctttgcaagatgccttaggattatacctctcacagtagaaacagggcccatcaatttccacaagtaataaaaggcggctctaccagcccaactccaaagatctcacagaagaaaaaaaagccagaatacattccgcacaattaaagaagagaagcatctcgctaaaaagtgaccccca

SEQ ID NO: 10690 - DNA, 61330 bp, Homo sapiens
  misc_feature (1)...(61330): n = A,T,C or G, or insertion/deletion polymorphism (see Tables 1-2)
ttgtctttgactccttgattccactctcccctcacagctcctcttcagcagcaaatcctctgacccccagcttcagtgtgtgtatattttcttttctctttttaccgccttcaccagcccacccaagccaccaggcatggactgttgcagaagcctcataaaattgtcctttttttgtattggcttcttgctcagcagccagataagtctttttaaaatataaatcagattattttactaccctcccttccagtgcttctctcacattagaaggaaattcagcctccttgtcatggcctgcagaactattatacagtgtaacccctgtcccctcattcacctaatttcacagcagtcttccccatacccatttcaccccagtgacactggccttgatccctaggcacaccaaatatgagggcctttgcactcaccctttgtccatttccctagatatcctcctcctctccaatgtctgctcaaatgttacctcttcaaagaaacctttcttgctagcctgccaaaatagtagccttctgctcttgctgtcaccctgccttgtatttcttcgtaatgtttaacatggcccagcagtatattctttatttaagtggttagtttgtctctcttatggaatataagctctgtgagggtagagactttgccccggagctacagtggtacctggcacatagcaggatcaaatatatgttgaatggttaaattttcctattatgtggcagagatttaactgtcgtgccaattcacagggctcactatataaatattacagaggtcatgtattggggttgtgtcttctcaaaaaccgttttcctgtgaaggtagatcagtctgtgattattgaggggtagggaggtgtaagaacagctactcagatcagggtccagagttgcttttctagtggtgggacatgtctgtgtgctccttgggatcagtgtaaagtaaaacgacccaggcaaggaatctgcttcaggactttggaacacactgtgaagctaactgatctaaacttgaattacctatttatttatttatttatttatttatcttttgagagagtcttgctctgttgcccagactggagtgcagtagcatgatctcagctcgccgcaacttccgccttctgggtttaaatgattctcttatctcagcctccagagtagctgggattacaggtgcccgccaccactcccagctaatttttgtatttttagtagagatggtgtttcaccatgttggccaggctggtctcaaactcctgacctcaggtgatccacccacctcagcctcccaaagtgctgggattacaggcatgagctactgcgctcagcctggattaccttttaaaatttggcttaccacctgaactaatttgctacagaaaactagagagcttatactgtgctgatgagatatgatgcttcctatgaaggtatgttaacacatagagtgagtgcttgaaagtgtccaatctaacttcaggggtagatttgaaagggcaattttttaaaaagtgtccagtcccccttagtggcttcagtgtttatactgtggagccttgccagacttcttaggatcaaatcacagtttcctgagttcctttctatgggcttggctaggagctcttctcatttgtggacagttttgactaacctgtaattatatcgtgggcttaaaatctgtcatcaagattttaagccagatggcatgttctacctttttttttattagctcagagtgaaaaatttttcagatgaattttcatagattcttctcctaactctatgaaatggtggtatatgaaaaagttcagtggtcagtaattaaaaattgctgaatgatattaagtatgaaacagacttccaattaattagaagattttgcagagttgtttaaccttaaaattcaagcattacttccttttttgaagttgtatttacaagcatttgatgtaatatatttaagtatttcttaattttccacaaggggtttatggtatgaaaaggtcagcatcctactaggaacagggtttagcagagcactgatagtgatttttaaagtgtggtccttttcctaggagtttctagttgggaaatgaaagaaaatgttgatagcaaacactcggaagaagggtcaagtcttgtatatctggacattggtataatactgcttgaaacctgaggacaaatatttgtgtttcacaggatcatgttctaattgagctcacccaggctggattgaaaggctccacagagggaagtgagagctatgaagaagatccctacttggtagttaacmctaactacttgctcgaagattgagatagtgaaagtaactgaccagagctgaggaactgtggcacagcacctcgtggcctggagcctggctggagctctgctagggacagaagtgtttctggaagtgatgcttccaggatttgttttcagaaacaagaattgagttgatggtcctatgtgtcacattcatcacaggtttcataccaacacaggcttcagcacttcctttggtgtgtttcctgtcccagtgaagttggaaccaaataatgtgtagtctctataaccaatacctttgttttcatgtgtaagaaaaggcccattacttttaaggtatgtgctgtcctattgagcaaataactttttttcaattgccagctwctgcttttattcatcaaaataaaataacttgttctgaagttgtctattggatttctttctactgtaccctgattattacttccatctacttctgaatgtgagactttccctttttgcttaacctggagtgaagaggtagaactgtggtattatggatgaggtttctatgagaaggagtcattagagaactcatatgaaagctagaggccttagagatgactttccaaggttaattccagttgtttttttttttttttaagtttataaaagtttattatacttttttaaaattactctttagtaatttattttacttctgtgtcctaagggtaatttctcaggattgttttcaaattgcttttttaggggaaataggtcatttgctatattacaagcaatccccaaattttatggtcttccaggaaaagttattaccgtttatgatactaacagttcctgagacttagctatgatcagtatgttcatgaggtggagcagttcctgtgttgcagcttttaacaacagatggcattcattaaatcacaaagtatgttaaaggtcacaaaagcaaaataactgtctgaggctaaggcccacgtgggacagtctaatacccatgagtactcaacttgccttgatgtctgagctttccagtgcaatgtgaatttgagcagccagaaatctattagtagaaagcaagacagattaatataggttaaaacaatgatttaaatatgtttctcccaataattatctctttccctggaatcaacttgtatgaaaccttgtcaaaatgtactccacaagtatgtacaattaagtattttaaaaataaatggcaaacattaaaaacaagagtgaatactcaagtagatttgtcatgggatttttataagaagactggtatcaggtaatgtatctttaaagactaggctgctctgctgacgtagtaaccattttttattcctttactttcctaatagccttgctttcacttaagaaaaaaaaaggctaggcacggtggctcacgcctgtaatcccagcactttgggaggccaaggtgagtagatcacctgaggtcaggagttcgagacaagcctggccaacgtggagaaaacctgtctctactaaaagtacaaaaattagccaggcatggtggtgggcacctgtaatcccagctactcaggaggttgaggcaggagaattgcttgaacccaagaggtggaagttgcagtgagctgagatcatgccactgccctccagcttgggcggcaacaacaacaacaaaaaaagattcccaggcttcaccctctacagtctatggaaagtcatgggagtctattaaaaaaaaacagacactataaaccaaattaaaagatgggaaaatttttctatcacgttttaatatgtgatatccaaactcccattaagaatttttatatcagtaataagataaaactcagaagaaaaatgcccaattaacaagaagagcttcacctcttaaataatcagaaaaagaaaagcacataatatttacgtcaaagtatcaaaaatgtaaaagttttataataggcattagcaaggcagacggatacaggcacacatctaactctatgtaggatttaacttggaagacaatttgcatttcaatcaatcaaaaaccatttttttttttttgagatgatctccctgtgttgcccagactggcctcaagctcctgggcttgagcagtcctacagtctgagcctccaaaagtactggcaaaacaggcgtgattgaccatgcccagcctgtatataaggatattcatttgcagcattgtttgcaacacaaaaatgtaaaaccaaccggtgtttaatatgcaagatgttaatttatggtacattcttgctgtggaaagctatgcatctgttagaggtgggtctatatgttctgatacaggcagaactctaagagctattaagtgaagaaaaggctgaaaatacatatggcataattccatatatgttaaattgttctatattttaaatgttatacacgtttccatttgtatttacgtaataataatgatccctgagctgtactgttgtatacatgctacaagaaagacccatttaatccccacagcctatgatgaattatccacattctacaggtgacaaaatagaggcacaaagttaagtaatttttgtcaggtgagatttaaacccaggcattctgactcctgtataaccattaagatatgcagagaaagaaaactggaaagatacatattgctgaagatacttattataggaagaggaggggggagggtgaaggaatttgcaagtttttcatagatgtttccatattgtttgaatctcttacaaaatatgttcagcatatttttaaagagaaaatttggggcaaaatacttatttttgtattatgtaaacaaattttaaaataatgtgtggctgggtgcgctggctcacacctgtaatcccaacactttaggaggctgaggcaagaggattgcttgagcccaggagttcaagaccagcctgggtgacatggcaaaactccatctctactaaaaatacaaaaaattagccagtcgtggtggcgcacacctatggtcccacctacccaggatgctgagatgggaggatcacttgagcccaggaagtcaaggctgcaggaagctgtgatcgcaccactgcactcccacctgggcaacagagtgagacccggtcaccaaaaaacaaaaaaaaacaaaaaaaattggtaatcgttttcttcagacattttccgggttcctctgcttaacttgtataggaagtctgaggtttttgtgttggtctttaccttttttttttttttttttttttaagatggagtctcattctgttgcccaggctggagtgcagtggcatgatcttggctcctgcaacctccgcctcctgggttcaagtgattctcctgcctcagcctcctgagtagccgggactacaggcgcatgccacgatgcctggctaattttttgtatttttagtagagatggggtttcaccatgttagctaggacggtctcgatctcctgacctcgtgatccgcccacctcggcctcccaaagtgctggaattacaggtgtgagccaccacgcccggccctgatctttacatttttaaatattgcattagtgaaccgtgtactgattttgtgatcatagataacccagttaaatattaagtcttaattatcacttagtattttacaacctcagttgcagttataaagtaagggttccacatacctcctaacagttcctagaaaatggagctgtcttggcatgtagtctttattgccctgctaagtttttcatgctgggggtcagactgggagtctgatagaaatttcatttccaccgctggtcctctaaccaatgacttgctgcacaacctgagtggtctcctgggagaccagagttctaactttgtagcaggggacaaagacatgtatgtttgtcaccagccactgcccactttcctgccagaatacttcagcagtctccatgccagtcagatcacccattataaggtatttctgtcatgggcacagctcctcccagcaggargcacccagaatccagaygagaaaacagtgcagtgctaccggcgactcctcaaggccctcaagactgcacggcttcagcccatggtcatcctgcaccaccagaccctccctgccagcaccctccggagaaccgaagcctttgctgacctcttcgccgactatgccacattcgccttccactccttcggggacctagttgggatctggttcaccttcagtgacttggaggaagtgatcaaggagcttccccaccaggaatcaagagcgtyacaactccagacyctcagtgatgcccacagaaaagcctatgagatttaccacgaaagctatgcttttcagggtgagtacacattgacctgatggtgacccctcggcaaccttcatcacacaccttccccatcctccttagagcagattcgacatttctcccaactcaccttcagcagtcctcttatgtctgtgcatagggagaaattaatattgtaaattgatttcccactggcgataggaaggggtagctaacatggcaaaacactcagcatttcctttgaaaaatatctttgaggctcacgcctgtaatcctagcactttgggaggccgaggtgggcggatcacttgaagtcaggagttsgagaccagcctggccaatatggcaaaaccccgtctctactaaaaatacmaaaattagccagggatggtagcaggcgcctgtgatcccagctactcgggaggcttaggcaggagaattgcttgaacccaggaggcagatgttgcagtgagccgaaatcatgccactgtactacagcctgtgcgacagagcaagacacaatctcaaaaaaaaaaaatatgtatatatatatatatatatatatatacacacatgtatctttgaaataccccttgcccagtcttgagttgtgcaagcactgattgtctttctgtcttcctttccgtctatgtcctgctaccctgacttggaggcaaagtttcgtggtttcctgtccttccccctcggctcccctatacttacatgtcttagttggagcttacattgcagcttgggagacagacaaatacaagatgaaacaattatatatcacaggatgaggagagcacaactgtaactgttcacattcctgcctcctaggggacttgaagttctgatctgtaggcctaggctgaaccaggacatttgtgattataatcaattccctaagtgtatgttaggtacaccaattttgagaatcaattttggattatatatgctttcttgtttttattatataccatatacatacatatttgtatatatagtacctgatatatatatatatatatatatatatatatatatatatatatatatacttctatgttctactttttcattttaacatagtttatgactatattctcattttattaaaaacttgagccaggcatggtggctcatgcctataatcccagcacgttaggaggccaaggcagggggattgcttgaggccaggagttggagaccagcctgggcaacatagagagccactatctctaaaataatataataatttactccagtgctggaatagtattgcttaaaacaaaagaaaaacttgaaagcataactttcaatggtcttttaggttcccattgtataaatggagcataaagtttaaggtattttccttatttttgtatgtttattctaattttcactagttacaagttatgttgcaatgacattcctatctataaactatttcccaccttctgataaattctttctgacagaatcttagaattgaaactactaggtgaaaagatctgcattctttaagattttaaagcatggtactaaattattttccagaaaagttgtaatcatttatacgaacagttataaaattactctctgaccccattctgtcagtttcaaatgctatattttattactaatttgacagctgaaaacagcttattttcatgtcttgttaatttgcatgtatttgattatagagacgttaaacatttttttcttcttctttttttttttttttttttttttttgagatggagtctcactcttttgtccaggctggagtgcagtggtgtgatctcggctcactgcaacctctgcctcccgagttcaagcaattctcctgcctcagccttcccagtagctgggattacaggcacgcaccaccacatctggctaatttttgtatttttagtagagatggggtttcaccgtgttggccaggctggactcaaacttctgatctcaggtgatccgcccgcctcggactcccaaaatgctgggattacaggcgtgagccaccacgcccggccttaaacaaaaaaataaaataaggccaggcgtggtggttcacgcttgtaatcccagcactttgggaggctgaggcaggcgggtcacaaggtcagaagatcgagaccatcctggctaacacggtgaaaccccatctctactaaaaatacaaaaaattagcgaggcgtggtagcacgtgtctgtagtcccagctactcaggaggctgaggcaggagaatcgcttgaacctgggaggcggaggttgcagtgagccgagactgcgccattgcactccagcctgggcgacagagcgagactctgtctcaaaaataaatgaaaaataaactaggacatcatagctgccttattcacaatagccaaaaggtggaagcaacccagatatccactgatggatgaatggataaacgagacgtggcatagacataaaatggaatattactccacatttattaaaaagggaagaaatcatcacatgctacaacatggatgaaccttgaggacattatgctatgtgaaataagccagacacaaaaagacaaacgctgtatgattccatgtataggaggaaactagagcagtcgaattcatggagagaggaaggagaatggcagaggccaggggctggggtaggggagaaatggagagctctttaatgggagtagaatttctgttcagaaaaatgaaaaagttctggagattggttgcacaacaatgtgaatatacttaataatactgaactgtgcacttaaaaatagttaagatggccgggcgcggtggctcacgcctgtaatcccaacactttgggaggccaaggcgggcagatcatgaggtcaggagatcgagaccatcctggctaacccggtgcaactccgtctctaccaaaaatgcaaaaaattagccgggcgtggtggcgggcccctgtagtcccagctactcgggaggctgaggcaggagaatggcgtgaacgcgggaggcggagctttcagtgagccgagatggcacgactgcactccagcctgggcgacggagcgagactccgtctcaaaaaaaaaaaaaaaaaaaaaaagaagtttaggaaggagttctctccttgccaactctccaactgctctgcatttcatagtcctgattttcacaaaacactctctaaaggaacattatttttttaagccaccttgtcttctaaaatctttcagctagagtaaagtcatttggatgatttcttcaggtccataggaaatgaatcccccagtggtttccacagtcagagcctcctgccctcsctcacctgctgttygtgtctctggttggtttcaggcggaaaactctctrttgtcctgcgagctgaagatatcccggagctcctgctagaaccacccatatctgcgcttgcccaggtgacagcagcccaaaaatatacctgtaacatctgaggagagtttgattttaattttttaaaaacaagagaagttttggtctattggtttgacatttctgtaaatgcctcagaatgagtggtntatgttctccaggttcataattaccttaaaaacaaaatcttgaagctgcagctcctgcttggtcaagtgtcagcttccctgcaggaagaagccacttgcctctgctggctctgatttttgagtccaaaatagcttataggataagagatgagattatggcaaaacaggtactagggtaaaggggtttttcaaaaatgtgcacctggccaaacacggtggctcacttctgtaatcccagcactttgggaggcggagatgggagggttgtttgagccaggagtttgagaccagcctgggcaacatggcaaaactccttctttgctaaaaatacaaaaattagcaaggcatggtgatgcatgcctgtagttccagctgctcgggaggatgaggtgggaggattgcttgagccctggaggtcaaggctgcagtgaactgtgatcatgtcactgcactccagcctgggtgacacagcaagaccctgtcttgaaaaaaaaaaattaaaaatgtacgtatatcctctatcactttttattttttatttttatttatttatttttttacagacagggtcttgtggccttgctctgtcacccaggccagagtgcagtggcatgatcacagctcactgcagcctctacttccaactcctggccttgagcaatcctcccacctcagcctcccaaagtgtcaggattacaggcatgagccaccacacccagccaactatcactttttaactataatttatattttttattttattttttttttgagatggagtttcattcttgttgcccaggctggagtgcagtggcacgatctcggctcactgcaacctctacaccctggattcaagcgattctcctgcctcagcctcccaagtagctgggattacaggtgtgcaccaccacgcccggctaattttgtatttttagtagagatgggctttcaccatgttggtcaggcttgtctcaaactcctgacctcaggtaatccacctgcctcggcctcccaaagtgctggaattacaggcttgrgccaccgcgccagcctttaactataatttttaaaagaaaaattaaaataatctgggaagtgaacagctttgggcccccttgggcagctgggcagtctggaagccatgggaaccaccgccggtctccgtagttctgcagcatygccctggtgctgtagagatgttgtgctgctcattggcgtctgtgcgttgatgggggccccaggagtcagggtctggtcttcagattttccatttcaaacaygatggaaccaagactgataaggttctggagggacaactcccaggctgattgcacggccagaatggcacctaaattagtttacagagggcgataactgctatcagttatgaacgcaggagaccaaagtgctgatcagaaaaatgcttgtcgagaaatagcctttgtactggtctatctgccccagtccatgctgtgcaatgcttctgggtcatctcccaaaagcacagttctgaccagttacctgctgggaagccacacttccgagtgggacgaatcccacaggaccctccagtgcatgaacgtgtgggcgtctctctctgtctctctctggcctcacctcctattttgtccatgtgagtgctatgcttgcttcctaccctcctgcatcccctactggacgtccttcctgtcttcctgccttcctcaaatctccttccagcaaaattttctccattgttaatgtacacgtaactgtgctctccagctgaggcctcgctcagtaacactccctcactcaccctgatgcactctgtccccacccggacccttagccattgctttagaccagtggttcccaagcttgagtgggcatcagaaccacctagagagctaggagagagcacggagaccaagacttaatgtggtgggacccacctgggcctgcacaggcatccgaagtccccaggtgagtctaatccccagcaaggcatgagaaccactggtgtgggcttcttacagcacttctaaatttctgtcttctcctcgtgtgattggtgcatttgctaaccctccctattaaaggtgtaaacctctgtggatattatttatctctaaatgtgaatccctacccaccatccccacacagtgtgactttcagaggtaggaactcagtgacgatgtgttgtgcagaactgacagacataaggaagagctgcgagagtgggcagggaatgctggagtgatacctgccagtgtggtctttagtgaacactgatgacaacttgactgagaaagaaacagggagccagtagtgaaccacttattaacccatttatgcctgaggctgcaattttttgaacttttgcaatcagaccttagcgaagaccttgagcagtaggatataagtaacttccacaggcttagcattcccataatggaacactaggcattcacagagcacttggttctgaccaggtgacagtaaccattagtccttgtcttgaagaagcagatgatcagtgggagggataagacaggtaatgatctaatcaggccaagggtagacaggtacggccagccaggctcgtggaggggagcgcagcactgggggtgttggcatggtcctgtgtagactctgtgaatctgaagttctttgagcacatgcaggccagagacagggcagaggggacatcctcatcagaagtgtggatgggggtgtcgacgaccaggaccatgagggttgtctctgctaaagaggaagtccccagtgcgtactccacaggccctagctcttggcctggctagggataactgggggtggacttcaaacggtggcctgaaatttaaaccaaaaccaaacacccggtaggattcacagggatgactgtggagccatgcgtggctgaaggctccaccacccccatcctggccaaatgtgagggtctatggaggaagcaccaggggcagcactggcctctaactgcctcccatttctggcatacacactccttcacgcattcatttagccatcaacactgcgtgctttctgtgtgctgagcacagaggcgcatggatgagcacataggtgatgcattcccaacaacatacaggcacaggcaccccccgccccctacacacacacacacacacacacacacacacactttctcattccatctccatcttttcctttggaaaatcctgctttggaatatttggtttagtgataaggggagaaacaaaaaagcgtacttctgagaggctgttagtcttgacagtgcttaggttctaatgaccctatttaactactattttcaggacacggtsgatttcctctctcttgatttgtcttatgaatgccaaaatgaggcaagtctgcggcagaagctgagtaaattgcaggtaatttgagcccttttccacattaatgatgaatgcagcgaaggtttcagagagcagattagacatttaatgctttggctactgcataaactgaacttccatcaacagcagagaccggctgagttgtgtctggggagatttccattgcaagcatccctagagaacatcggatgttaggcagtctttcctagaagggatacaaggkttagcttgttaaggtgaatatttacatagatcctctgcttgcttgtgtagaaatctgccgagaattgagattctggggttcattctgagttttaaaaaggcarctcatcaatgggggtgatggttccataacgataagcgtccacttaacaccactgaactatacatttaatggttatgatggtaatttttttttttgagatggagtcttcctcggttgcccaggctggggtgcagtggcgtgatcttggctcactgcagcctccacctcccgggttcaagcgattctcctgcctcagcctctccagtagctgagatgacaggaacacacaaacacgcctggctaatttttgtatttttggtagaggcaaggtttcaccatgttggtcacgttggtctcaaactcctgacctaaagtgatccgcccaccttggcctcccaaagtgttgggattacaggcgtgagccaccacacctggcctgtaaatttcttctttatgtctattttaccacatttttaaaaaaacaaacatttcacacccaggtctactaaatcagatcccagctgtctggaccttccagtaagctcagtactccctcctgtacccagtactgcttttctcaagtctaatgatgcgggctcattagagaaagtgtgttaggagcctcctatccaactaccaggtttctctcttaggcttggtcactgctgtgtgacttacttgcttcattccctggagtcccaactattctcctgtgacaaggtctatctgatggtgcccacgttttctcctgcaccttccgagtgctggcagtattcctataaccctggagagctgccttcctgtgggcctttccaaggatgtctggccactggtatgcacccacattggaccccctgcctcttcaggtttgggcacaaaaccactccccgctgctttcagcctgtgcctcccatgagggaggcagagcagccccctacactcacctgtggttttgaatcccaccatctccgtcaccaaggaggatggtttacctgaggaattatccctttaaaggccaagtttggctaggcacagtggctcatgcctgtaatcccagcactttgggaggccgaggtgggtggatcatgagatcaagagattaagaccatcctggccaacatggcaaaaacccatctctactaaaaatacaaaaattagatgggtgtggtggcacgcacctgtagtctcagctacttgggaggtggaggcaggagaatcacttgaacctgggaggcggaggttgcagcgagccaagatttcgccactgcactccagcctggtgacagagcgagactccatctcaaaaataaaaataaaaataaaaggccaagctcaggaatgtcaaactgagcttcagctacatggaccctccattttacctgaggcagagtgcttgaaatggacaaattagcaccagtcctatcccaatgtctgtgtgtttctagctgtctgtgtagtagacactgctgcttttgttatctacaaataataagatgatctaatttaggggtccccagcccccaggcggagcaccagtactggtccatggcctgttaggaacctggctgcacagcaggaggtgagtggcaggcgagcaagcattaccacctgagttccacctcctgtcagatcagcgaccatattagataggagcacaaaccctattgtgaactgcgcatgcgagggatccaggttgcgtgctccttatgagaatcaaatgcctgataatctgaggtggaacaatttcatccccaaatcatccccatcatcccccctacctcccccaagtctgtggaaaaattgtcttccacgaaaccggtccctggtgccaagaatgttggggaccactgatctaatcaaaggtgacagatgcagccacaaagacatctgagtaacagctattttagtgcttgcttatcccagacacctgggaggcacttcattctcacatcatctcaacctctcaaaacacaccctaaggtttaaacaatttaaccaaggtggtgagctccagggttgggatttgaactagggctttctcattctaagacaccacactgtcttttcaaaagaaaaataagtctcacatctgtaatcccagcactttgggaggttgaggcaggcggatcacttgaggccaggagttcaagaccagcctgcccaacatggcgaaaccccgtctctactaaaaatacaaaaattaaccaagtatagtggcacgaacctgtaatcccagctccttgggaggctgaggcacaacaatcgcttgaacccgggaggtggaggttgcartgagccgagatggcgccactgcactccagcccaggggacagagagagacttgtctcaaaaaaaaataaagaaaaagaaaaagaagtccaagggtttggaacatgataatgagggtggtattttttaaatcacatatgatcagtttcagttgtttttgtgaatgcctcacctgaacctaaacttgcttgctgcccagggcctgtgcttgcgggctggctgacaaggtttctgggccttacgtaacactctagggtcttcgaggtctgcttgtgcctgtgatgactaaagctgccttttgtcctcctcatggaattaaaccagagcttgttgctaggctaatgggttcagacaaagctgccattttaaaaccatctctgttgtgcggaggtggcgtgcctctgacaggcagcagaggcactgcatggctggtacttgaggatgtgattttcagtctcttccctttttccatcacaacattttttttttaagatggagtctcgctctgtcacccaggctggagtgccccgtggcatgatctcggctcactgcaacctgcacctctggggttcaagcgattctcctgcctcagcctcccaagtagctgggactacaggtgcccgccaccatgcctagctttttttttttttttttgtatttgtagcagatacagtgtttcaccatgttggctaggctggtctcgaactcctggcctcaagtgatccaccacccccctcgacctcctaaagtgctgagattacaggcatgagccactgcacctggctaccacattttcaagacacttctaccagtgtctgggtaaagcactgaaacttcagtctgtagctggccagccaaatagtaaaactctccctggacaaacttagcagccatttataaatgttctgcaatggttatctattccttttacttccttgggtagggttggcccctcagaggcagcctcaaagattcggaaatgacagctgacaacccctgagctggagagcacactgttccttcctgggattgtggtctcatgcctggtagcatttcccatgcacagttaccacacccaggacagggagaacagctgagcctgccctgagaacaggggctgagttgtgtccacaggagcctgaatcgtgctgcccaccttcccagtgtcccctccctccctgtcctggaaccccaccctccccttgaaggggcctcttcctgtgggctgcgagggaagagggcgaaagcagggcagggaggagcaggcacctgcccccattcccaccctctccccggagcacctgcacagccctctctgagcctcaggggccctcagcggccactccccaacggcacacagctgtctgagggcctgagaacagcctcaagcccagaaatgaagagctgcggcacactccagggttctcggttctgnaggaggcacacgaggaggtcccccatccacttatcagaaaaagctgtgctcccagggagttctccgcttggcagaagacaggctgggggcctccgaggctcctctagctctccagccctgggacatcaccggctgcctcatggcatatccgtctttcaggaaggagaaaacccttgcttccctaagcacgccaccctgggtcatttgtccccactgcattgacccagcacagggagggatgaggactgtgtggagtcacagctccactaactgcgcagtcatgggcaacccgctcggcctctcgagcttctgactccccatctgtaaagaaagtcacaggtggctatgagaaagtaaagactatgcctggctccttttaaagtggttactattggtatcttttggtagcttttagttgctcagaggaggaaaaagttactgtgagtaaaatgaccaaactccaagccccgcaaaaaaggtaatttaaagtgaagtcaracagcatgtcagccctgagacgttttccttgatactgaaatggctagaaataagaagaggaaattacatttgcttccattttaatgataacagctaatataacttttctttttctttttttttttttttttgagatggagcctggctcttgttgcccagactgaagtgcagcggttcactgcaacctctgcctcttgagttcgagcgattctcctgtctcagcctcccaagtagctgatattacaggcgtgcaccaccaagcccagctaatttttgtatttttgataaagacagggtttcaccatgttgatcaggctggtctcaaactcctgacctcaggtgatccgcccgcctcaacttcccaaagtgctgggattataggcgtgagccaccacacccgctgggctgctgtaactttttgttttggaaaatttctaacatccaaaagtaaaaagaatgatgaacccctacgaagccatctccagctgcaagagctattattggctcatagctaatcttctttcacctaacctataacttctatctcccaaactagatttttaattaaaaaaaattttttttagagacaggatcttgctctgtcacccaggctggagtgcagtggtgcaatcatagctcactgcagccttaaactcctgggctcaagcgatcctcctggctcagcctcccaagtagctggaactacaggcatgcaccaccacacccagctaaccaaactggattattttgaagcaaatcccagacatccatagatggtggcctcttaactaagcttcttaagtagcacaggctctggatgtgagcagtggccttgttcctgatccnaacaccgtgcctggctctaagaggtgccctrtaagcctgtgatgaaagaagaggtgaaggtgggggttggtggggagggtagactatgttattgaaaattgtagatctttctccttcagagtctagagttgactcctttaattaactgagatacttagaggtsatttccaaagccagagtaagtgccacagcttctcatcttgaaactctgtccctgttatcaagatgctttccaggaggcttcagttcacttgctggtccttctctttttcagaccattgagccaaaagtgaaagttttcatcttcaacctaaaactcccagactgcccctccaccatgaagaacccagccagtctgctcttcagcctttttgaaggtgagtgggccattgctgaagaggttttgagtgacatctggtgcactggtgtgctaggtagcagtcttgaaagtccggggttccaatgggaggaggagcatgggaggaagactagtntaaaagcccaccccagactgggttagtgtactatgccttcctactgatggtcccttgcaaccatcccccattgacccaagaaagaggagaggttcgacacaaggatgcctcttatggacataaagatagttaggcctcagctgtgagttgtaagcatggaaaatcatctttgcctccttttattacctctccctccaaggtctctcatctctgctcctcttggcagggctttcctctgcccgtctctctccagccagccctctccacttacccttgttccatgtccccattatctcagtttgcacatggccctggtgggtacctgaccaagatgctaagaactttcaagtgtaggactcacagctcaagggccatcttcctagtgtctcttagttcaaattcttgaaagtgaatctgattgttggccatggatcaggaggctgcttctggtccaatcaagtcaggggaaaggtggggtctatgatagcattgaggctggcagtcactggagactctgcaagaagggaggaaggggcagagaggaatgtgcctgagggccctgatattcactcttgtctgtctgtcactcttgtccataggccagagtatgggagaagtcagtagtgttctttctaccactgtgtcttagtctgtcttgtgttgctataatagaatactctagactgcgtaatttatagagaaaaaaggtttatttagctcatggttctggggactgggaagttcaagatcaggcagccacatctggtcagcttctggtgagggcctcatgctgcatcctaacctggcagagaagtggaaggggaaggaagtgcctgcaaacagataaaacaccagaagcagcctcactttataacaaccactgtatggtaactaatccagtcccactagaatgggaactcactcactccctggagactgcactaatccctgaaggcggatccctcatgacccaaatgcctcttaaaagtccataacctctcaataatgttacactggcaattaaatttcaacatgagtttttgtagggacaaaccacatccaaaccytagcacacctggaccccatcccagcaatgggttggctccacagggcccctgaagtttatccatagataccatttaataatgcttatctgaactcacctttgatggcataacaatttctgttcttagatcccacctctctctaagtggttaaaattgtaccttttctgtttatgcgtattttaccacaattttaaaaatattccacccctttctgatctttgagttcttctaaatcaattgttcccaaagttgtggtccccagaccagcagcatcaacattagcatcacctgggagctcattagaaatgcatattcttgagccctacttgagacctactgcatcagacactcttggggtgggaccagcaacctgtgttttaacaagctctacagatgattttgattcaccttgaagtttgagaaccacttttaagtaataagtaagtagaattcacttctaagcttttaaagtcgttagcccatggtattttccaaaggggcttggaaccactgcttggagtttgggtgtgtcgtatgagcgaggaaaactgttgatttcagacttgcatgttcttagttggcatttacatagagttaattcaatttcttctcttacagccataaataaagaccaagtgctcaccattgggtttgatattaatgagtttctgagttgttcatcaagttccaagaaaaggtaatgtcaggttgcctattgaactatcaataactgatatttgtagaatactctgtttcttttacatgtataatcttataggactgttgtcatcaactcttgggccaccaagttgtttattgccattcaattgatgagaaacaaagactcagaaagaaagtagggagtctcttactgagtgggactcacgaggttctgctttctcatctgtcagttcgcccaactgtgcgcaactagcatgatggctcacacctgtaatcccagcactctggtaggcaaaggtgggaagattgcttgagtccaggagttcaagactgggctgggcaacatggtgaaactctgtctctacaaaaaattacaaaaatacaaaaattagccaggcatagtggtgcatgcctatggtcccagctacttgggagactgaggtcagaggatcgcttgagcccaggaggcagaaggtgctgtgagccgagattgtgccactgcaccagctaggatttgaactcctgccttctagtttaagatcttgctggagacagtgtgagcttgtggaagagtggccaggttaaagatagatctgaccatcccactgaagttacatgatgagtaagagaaatgggttctctgtgcccatttcctcaatatgaagggtgaaacatcctccctggaaggagacagcatagacaggaaagccagctgttgctgcaagccagatgcctaacttgacaacattctagggacagaggtttgaatctatggtggggttgtaaataatatcttactgagtgactcaagtgccaaagtttgcaaatgatatgctttaaaaaattagagcagattgccgggcacggtggctcacgcctgtaatcccagaactttgggaggccgaggcgggtggatcacgaggtcaggagatcgagaccatcctggctaacacagtgaaaccccgtctctactaaaaatacaaaaaaattagccgggcatggtggcgggcgcctgtattcccagctactcgggaggctgaggcaggagaatggtgtgaaccctggaggcggagcttgcagtgagctgagatcgcgccattgcactccagcctgggtgatggagcgagactccatctccaaaaaaaaaaaaaattagagcaggttttgaggttgtgcccataattacattgctttcatgcacgcatatcccaatacgctcttgagtgaatgagaaaagaatggcatggtagccagcactgggaattgcccagaacctcagcgctcctggagggatgttacatgcatgaagttcatgcaccatcccttagggtgggacaaaagctggagacaataattgacttccagaccttcaactagagttctctttgtcactcacctctgatatttccagtgcagccctgttcagggtcattcagtgccaacacctctttgtacctttcctcttccagtacttgactgtcctgagccatatcctccttctattgttccatcctctcaatccacttcaaatcagcagttcagatcaacagacccgcagcagcagctgtacctcaggctttgtgtggcagtgtagacttgcaatagacagacatgggttaccactgcttcctgaccacacttggagtcagccaagaaggactggctgtggcttcacaaaagaaaactcaagaagccgtaataaaatgggttccctgaaaagccagtgattacaagtgacaccagctcggagattctctcagcncttggtggtgctttgcctgaaggggagggccaacacaggcttacattaaacggacagccaggggcccctactcaggaggatgtggttggagaacccgctgaatgcaggggcggtgggtggggagtgattcagaaatgactaacgtagttttctccttcagaattctagaccttataggggagacagagcggcccctgaacaactctcacatgagaatgtggcaggagacacacagcactgcaccctaaaaaagggagaacttaggagccctgggtgtggagcctgaggtgccgtcatgtgctaaatccctctccatggccggcaaacccagggttcccagctccaagcctgtacagcaagttctgtttcatcccagggcagtttatttgtttccttaaaactcttcatgcaatccaggaggacagtcagggccaggagggctgggtaagagcgaggttcggagcagcggacgctgtgtttatgggcaccgtggatacgcagaggctgagcaccgaggggacgcgacacatccccagctgcgatccacagtcgcatatgttttgggatcatctacgaaggaaaggatcatttccctttccccctaatctagcaaatgtcagggagttgatgctgagtgaaacagaaggctcttaggttcggaagacgcctcctgctgggtgacccggccccaggcttcgctttttgagaggaagatccctgtgcagtgttcctgtcacttctcccagttctgcgctgtgggccagcctggtataggtgccatcggctctccacacgatggctgtgtgacagggagatgctcttgtactccacgtccttttccccaggcatgtgccacactcctcaaggccgacctctgctggctgtaatttgcagcatgcatgctttcctgcctgcatgacatgactcaatttagaagttggcaatcacaattgaaaaaaaagaaagaaaaaagaggaaaggagagtgggagggaggaaaatggactagaataaaatagaaaaatcagaccacattttgtataaatgcagcatgcacttttatgtgatgttttatttcatatgcatatacatatgtacatgcatatacatgcacataaacatgtatgtgtatgaggttaaaagcacagaatctgctccaccacctgcaagctgtgtgcaaggagaagttactcataatcaccaggaatccaggctcctttgttgttgctttgtcacctttaacaaggtttctacctcatggttcaggrtggatgcttgagctcctgccattatgtcagaaatccaagcagcatgaagaaaggaagcagtagccaggactgatattcaactggtccacatcagtgtacttctgtaccagctgataaatagctgctggctccctgaaatcaggaagttttccatttctttttctttttttagacggagtttcactcttgttgcccaggctggagtgcaatggcgtgatctcagctcaccacaacctctgcctcccgggttcaagtgattctcctgcttcagcctcctgagtagctgggattacaggcccccaccaccacgcctggctaattttgtatttttagtagagacggggtttccccatgttggtcagtctggtctcgaacttctgacctcgtgatccacctgcctcggcctcccaragtgctgggattacaggcatgagccaccacacccagcccccgtttcttttagtctcagtttcctcctgtgtaggatgaggataaatcattgtagtacccatctcataaatttgttgggaaaattaaatgagataatacacatccattcttattacagtggccagcgcagaatcaaggctcaataaattggagtcattgttattattagctatgttttacaaataatgaattataagaagaataaagtatggtactaacactgaagacaatattcaaggkcaatctaatacagagaacagtagcattgttcctgttttaaccatgaaagagcaagaatcactcacctcagaaggggtaataataataattttcccatctgccagttacttcctgcccatggctttgcagatatgacttttgactcagtgtttctggaatcttttctgattaaacacagtagtcatccgtagggggcatttgtaactgccagcgtcattcattattatgtccctttttgtcccttcaatcctgcagcatgtcttgttctctgactggcagcctggcccttcagcctgaccagcagcaggaccacgagaccacggactcctctcctgcctctgcctatcagagantctgggaagcatttgccaatcagtccagggcggaaagggatgccttcctgcaggatactttccctgaaggcttcctctggggtgcctccacaggagcctttaacgtggaaggaggctgggccgagggtgggagaggggtgagcatctgggatccacgcaggcccctgaacaccactgagggccaagcgacgctggaggtggccagcgacagttaccacaaggtagcctctgacrtcgccctgctttgcggcctccgggctcaggtgtacaagttctccatctcctggtcccggatcttccccatggggcacgggagcagccccagcctcccaggngttgcctactacaacaagctgattgacaggctacaggatgcgggcatcgagcccatggccacgctgttccactgggacctgcctcaggccctgcaggatcatggtggatggcagaatgagagcgtggtggatgccttcctggactatgcggccttctgcttctccacatttggggaccgtgtgaagctgtgggtgacyttccatgagccgtgggtgatgagctacgcaggstatggcaccggccagcaccctcccggcatctctgacccaggagtggcctcttttaaggtacttcccaaccctgcagctcctactaattggaggagaaaggacattggctggaagaaagtcattttctctgttttcttccatcagcaagcctttactttttgttctttctttaaaggaaatcggggagggaaggaaccataaattgttaattaaattgttaatcacctggccaggtgcagtggctcatgccagtaatctcttcactgtgggaggccaaggcaggcagatttcttgagtccaggagttcgagaccagactgggcaacatggcgaaatcttgtctctgcaaaaaaaatacaaaaattagctgggcatagtgttgcacgcctgtgatcccacctacccaggagactgaggtgggaggatcgcttgagcctggtatgcagaggctgcagtgagccaagattttgccactgcactccagcctggtcaacagagcaagaccctgtctcaaaaaaaaaaaaaattgttaatcaccttattttgtccagaccctctactggtacttttaaaatataatagttattacatactcagaatagcactgatggatgagtgaggctcagacaggataaacaatgtggtcatgatgacattgctagtgagtagccaggtggaagtcaggatttgagtccgagtcttcttgactccaaatcaagttcctcatgtcagtgacaagtgacagaaagctcaacccaaagtgacttaagcaaggagagaatttacacattcaggaggttgaaaattcttcatttagcctgatcagggtggaatttgatcagagcacaagcgatgccaccaggacccagttcctctcctgttcccctcgttggctttattcttgggctactttgcagccagatggcagcagccctgtttctgttatttcatgaccagtagggaaaaaagctcggctcttttctgtccttcccaacagaagtgtccctgtgtctcatggtctctcagtgggtcgcatacccaccctgaactcattgctgggtcctggccaggaggctgtgacaactgactggtgtgggccaaggacccatgctttactcctcaatacgctcactgagagctgaggaggcagagagggaagaggcaaggaggcattggctttccagacgccagtcagggcatcgtttcaacaagaaggggatgtatacacttggcacaaaattttaaatggctataggtcttttccattatttccctttttcttcggaatctcccagaaaacccaccagctttctttggcagcgttcttcaggatggacatgttagtctgccttttccctgtcactgtttgggttccattcttaaagatgagtatttccggccgggcatggtggctcacgcctgtaatcccagcactttgggaggccaaggcaggcagatcacctgggaggtcaggagttcaagaccagcctggccaacatggtgaaatcctgtctctactaaaatacaaaaattagccagatatgttggtgggcgcctgtaatcccatctacttrggaggctgaggcaagagaatcacttcatcctgggaggcggaggttgtagtgagccgagattatgccactgcactccagcctgggcagcctgggtgacaaagcgagactttcatctcaaaaataataataataataataatactatttcctgtgtcccgtgctaggtgttaaagaggggtcacagccatgccctggacatgttataaccttttggggaagatgacactaacacacgtagcaaaattacagaactcttcaaaaagaccattactagggtgagctggaacatcatgaataaataactcaatgaaatgtcaaacattgtagcacgtaagtcagagtttccattcagctcttgagcagcaagtgactgcacatatggagccattccaccacccaccttctgaaaatggaaggtttgaaatcttctgtttcactccttgttgtaaaacttatctaaaccttttcttcttaggcttttcttcccctttgaactgtggctcttgagatatctttacagagactttgatgagaaagtccccttcactcttctccttcaattcttccctttatttattagttcaatgttagaatgccattgtcttagtgagcttgagctgcaataacaaaacaccatagactggtggtttaaacaacagatatttatttcccagcattctggagctggggaagtccaagatcaagggaccagcatgtttgggttctggtgagggctctcttcctggcctgcaggcagccaccttcttgctgtcctcatataggggtggttggaagaactcactggtatcttttcttataaggacactaataccaccaccatgagagtcccaccctcacgacctcctctaaatctaatcacccctcaaaggccctatctccaaataccatcacattggggattagggcttcaacatatgaattttgatgggggaactaattcagttcatagcaactattaaggaaaaaatttaaagaaaaaaatgtcttgggccaggcgcggtggctcacacctgtaatctcagcactttgggaggccgaggcgggcggatcacgagatcaggggttcgagaccagcctggccaacatagtgaaaccctgtctctactaaaaatacaaaaattagccaggcatggtggcgggcacctgtagtcccagctactctggaggatgaggcaggaaaatcgcttgaacctaggaggtagaggttgtggtgagccgagattgcgccactgcactccagcctggtgacagagcgagactccatctcaaaaaaaaaaaaaaggtattttattattttagagtatttccttccagtcttggcttctttgcatttatgatgttgtcacagggcacctcagattgttgctcactgtttacttgatatcatgtcattagcacttttccctattattaagcagttgtgatgactgtttttgatggttgtctaatattccactgagctcccttcctgacactggctaatttagaagaaagacatccttgcttttgggaaaggagcacagtttgccattcgagtttagaactcaactaaagacgaatatttgggatgtgagaagcagccaggcgttttagtgattatggcatattttgacatgaaattcttcagaggtaagtgtcatcctcttcagatgataaaaaggaaaaaggaaagcaagctaagatttagcaagctcactcctgctctctgagtttctgctcaatgctttatatacacgtatttaatcatcccagatggatccataattacccacttcttgccaacaagtaagctgaagttgagagaataaattgtccaagttaacaagttagtaacagagtcaagatttaaatctaggcttgttatatttcagacaccctccttttgcccctacttcccacaaaaagctgttgctgtttgtaagagcatgagttaagtctacaaagaaactcctagtttggtttttcttccgagattccattaaatagaaagaagaacaaataagcaagaaagagccctcctctcccttgtgtgctaattaaaataatcctccccatggactaatttctcaaaaagcacttattaaggacagaggcagaatagcagtgtgggtaacagtaacaggcttggaatcagactgccaggggcttgttctcactttactcctgactcttggccttgtgaagttactacacagctctggatcttgttttcaccatctctatagtggtgataataattgtacctgccatatgaggttgtggtgaggattacatgagagaattcattaagtagtaggtgcccaatatatgttagttgttattgttaatgtggttgttgatgctgttattttgttgacaattttgaagaattgctgttgacttgttgactttgttgatgatattggtgttgacttgttgacattgttgacttgatattgttgaccttttcacattggtgttcacttgttgatgccgttcatgttggtattgatgttgttgacatcaacatcgttgatattattgacttgttgacattggtttggatttcttgacattgttgacttgttgacattgttagtatcagtcttaacttgttgtttatgttgttaacttgttaactttrttattgacttgttaacatcattgatgttagtgtcaacattgttatttgttgatgacttgatgttaacattagtgctgatgttgtcaatattgacaatgtcaatgttgttgttgtctttattgacttgttgacattgwtgttgacttgttattggttcattagtcctgttgttgtcattgttattattactaatcactgtatttccttcttactttttcacaaggtggctcacttggtcctcaaggctcatgccagaacttggcaccactacaacagccatcatcgcccacagcagcaggggcacgtgggcattgtgctgaactcagactgggcagaacccctgtctccagagaggcctgaggacctgagagcctctgagcgcttcttgcacttcatgctgggctggtttgcacaccccgtctttgtggatggagactacccagccaccctgaggacccagatccaacagatgaacagacagtgctcccatcctgtggctcaactccccgagttcacagaggcagagaagcagctcctgaaaggctctgctgattttctgggtctgtcgcattacacctcccgcctcatcagcaacgccccacaaaacacctgcatccctagctatgataccattggaggcttctcccaacacgtgaaccatgtgtggccccagacctcatcctcttggattcgtgtggtgccctgggggataaggaggctgttgcagtttgtatccctggaatacacaagaggaaaagttccaatataccttgccgggaatggcatgcccataggggaaagtgaaaatctctttgatgattccttaagagtagactacttcaatcaatatatcaatgaggtgctcaagggtaagaacaatggatgtgccagtgattggaagktgggtggtacttctccaagtcttcaaagtttcgtttaataagacaaagaaagtctcctagagaaatggagccaaagaaagcataatagtggggagtccttcacgtcagctccctaactctctttcccaaggttcattcatgtcattcacgtctttgctcctgtggtttttttgttttattttgttttgtttttgagacagggtcttgctgtgttgcccgctggagagctggagtgcggtggcataaacatcgctcactgcagcctcaaagtcctaagctcaagccaacctcccacctcagcctcttgagtagctgggaccacagtgcaaaccactatgcgtggcttattttttttttttttagacatggggtctcttcacattgcccaggctggtctcaaactcctgggctcaaacagtcttctcacttcaatcctcccaaagtgttgggactacaggcatgagccaccatgcctgacccagtgtccttattgcctagaatacctccctctacattctgcccatctgagtcctatgcagtcatcaagcctcattatctttttttttttttttttttagaatcagggtcttgctttgtcacatagactggaatagagtggcatgttcatagctcacttcagcctcaaactcctaggctctagtgatcctccggactccaacccattaactcttccctcattgctccagccacactggtcttcatttcctttaattggctataaaatctacattctatgtcattgattttgatccaattgatccacatctacggtctcattcttacctgacatactatttcatatgtctttttattccaattggaaaggtatggcaaatagatttcatctcacaggtcagtcctcagttaacccaggatgttcttatcttgagctcattaacttaattacatctgcaaagatcctttttccaaataaggttatattcactggcaccacgggttagaatttagacatatctttcgggggtcaccattcaatgcactgtatcagggaatatatgttttaggctttatttatttatttattttaattttaatttttttagacagggtcttgctctgaggagtacactgacctgatctgagctcactgcagccttgacctcctgggctcaagcgattctcccacctcagcctcccaagtggctgggactacaggtgcacaccaccacaccaggctaattttcttttcttttttctttttttttttttgagacggagtctggctctgtcgccgaggctggagtgcagtggcgcgatctcagctcactgcaagctccgcctcctgggttcacaccattctcctgcctcagcctcctgagtagctgggactacaggctcccgtcaccacgcccggctaatttttttgtatttttagtagagacaggttttcaccatgttagccaggatgatctcaatctcctgacctcatgatccgcctgcctcagcctcccaaagtactgggattacaggcgtgagccaccacgcctggccacattttttttttttttcaatagagacagagtctggccatgttgcccaggctgctttatttcttttttaaaatatgaaatatgttgtcacttaatgtcaatattactaaacataaacaaggaaaagcaaaagcatattgttaaaagattgatttatgtattttatataaaaccaagacaccctggtggtaacacatgggacacatcccctccactatttatttgaagatggggatgctcctttggtttgagatttatggccacaaaagtggcctgatgttttgtgaggatcttgtggattttccttttatccattctgaggaggaaaaaggatgaacatttggggggtaacccaagtcacccccaaaactttcatgtcaaaaggaacactttttaaaagcaacattagtaacagagactatacttctaatttttcaataaaaactattttattgaaaaacagtcctcgctggtccgaggtaataacttatctcagttgactgttcacaaccagttacagatcaaacagcttctaatacccttctcccccttctcactactgcactgactagtctttaaaagataaataaataaaataatggtgcactagctcactcctgtagtcagtcccagctacttgggaggatcacttgagtccaggagtttgagaccagcctgggcaatacagtgagaccccatctcaattaaataaatccataaataaataaatctaatttttatttttcttcacagctatcaaggaagactctgtggatgttcgttcctacattgctcgttccctcattgatggcttcgaaggcccttctggttacagccagcggtttggcctgcaccacgtcaacttcagcgacagcagcaagtcaaggactcccaggaaatctgcctactttttcactagcatcatagaaaagaacggtttcctcaccaagggggcaaaaagactgctaccacctaatacagtaaacctcccctccaaagtcagagccttcacttttccatctgaggtgccctccaaggctaaagtcgtttgggaaaagttctccagccaacccaagttcgaaagagatttgttctaccacgggacgtttcgggatgactttctgtggggcgtgtcctcttccgcttatcagattgaaggcgcgtgggatgccgatggcaaaggccccagcatctgggataactttacccacacaccagggagcaatgtgaaagacaatgccactggagacatcgcctgtgacagctatcaccagctggatgccgatctgaatatgctccgagctttgaaggtgaaggcctaccgcttctctatctcctggtctcggattttcccaactgggagaaacagctctatcaacagtcatggggttgattattacaacaggctgatcaatggcttggtggcaagcaacatctttcccatggtgacattgttccattgggacctgccccaggccctccaggatatcggaggctgggagaatcctgccttgattgacttgtttgacagctacgcagacttttgtttccagacctttggtgatagagtcaagttttggatgacttttaatgagcccatgtacctggcatggctaggttatggctcaggggaatttcccccaggggtgaaggacccaggctgggcaccatataggatagcccacgccgtcatcaaagcccatgccagagtctatcacacgtacgatgagaaatacaggcaggagcagaagggggtcatctcgctgagcctcagtacacactgggcagagcccaagtcaccaggggtccccagagatgtggaagccgctgaccgaatgctgcagttctccctgggctggtttgctcaccccatttttagaaacggagactatcctgacaccatgaagtggaaagtggggaacaggagtgaactgcagcacttagccacctcccgcctgccaagcttcactgaggaagagaagaggttcatcagggcgacggccgacgtcttctgcctcaacacgtactactccagaatcgtgcagcacaaaacacccaggctaaacccaccctcctacgaagacgaccaggagatggctgaggaggaggacccttcgtggccttccacggcaatgaacagagctgcgccctgggggacgcgaaggctgctgaactggatcaaggaagagtatggtgacatccccatttacatcaccgaaaacggagtggggctgaccaatccgaacacggaggatactgataggatattttaccacaaaacctacatcaatgaggctttgaaaggtgtgtgagggttcagttccccttaaagaaatcttccaacattccctgggtcatatgcctgaaatgttttgccgggatgatttatgaaccatcaatagatctctctcttaggtcccaactccataattctttatctgtttgggggttatatgttccttgagaagctgggggaaaaaaggctatggttgtctctgcagaggaaaaatacaaacactacacacacagggtccctagcagaatattcatattgtcatgggtccattcattcattactgagcaagttctattttaggtgctgggaatacagcaatgaacaaaacacaaatttctgccttcgtagagcttatcccatgcaccccagaacaagaaagttgtgttaattcaaacttccttttttttttttgagatggagtcttgctctgttacccaggctggagtgcagtggccaccgtgcccggctaatttttttgtatttttggtagagatggggtttcaccatgttggccaggctggtttcaaactcctgacctcaagtgatccacctgcctttgcctcccaaagtgttaggattacaggcatgagccactgtgcccagcctaaaaatcaactttttgtttcattgattttttttttttgagacagtctcactctgttgcccaggctggagtgcaatggtgtgatctcggctcactgcaacctccatctcccgagttcaagcaattctattgcctcagcctccccagtagctaggactacagatgcattgggcttaacttcctaagtgggctgaagatcttgaatttggggcatgtttctttaccccaagagaagaatttgatttggagatgatcagtcattaatgcttgctgtggggtcataggtactggcagaaaagtaagatcaacagatgatctgttggtctctcagggtgtatgtcacttttaggaccacaaccttgaattgaggagctggcagtgggttggstgcatggaggtcctgactcctggtgtcaagctctcctctgctccctttgggatgttcccagcctacaggctcgatggtatagaccttcgagggtatgtcgcctggtctctgatggacaactttgagtggctaaatggctacacggtcaagtttggactgtaccatgttgatttcaacaacacgaacaggcctcgcacagcaagagcctccgccaggtactacacagaggtcattaccaacaacggcatgccactggccagggaggatgagtttctgtacggacggtttcctgagggcttcatctggagtgcagcttctgctgcatatcaggtgaggagttcaggatggtgggacaccagtgactgcacacctgccctgtgccaggctctgggctcagtgctgggaagggcagatgcatgaacaggagattccagcagacccatggaggggcagcatggggtctgggaggtcctcttccagacagcctggcttcttcacacccccaaatttacccagaccagcatggtgaggctcgctgtcctgagatgggtgcttgcagggccagatggagcagggggagcctgggcagaagtacttgggcaaagacacacaaatacagtcacgcattgctcacaacagggatttactctgagagatgtgatgttaggtgagttcatagttgtgtgaacatcacacagagtgcacttacacacacctagatagtgtagcttactacacacctaggctacatggtatagcctagtgctcctaggctacaaacctgtacagcctgttactgtactgaatgctgtaggcagttgtaacacagtggtatttgtgtatctaaatgtatctaaatgtagaaaggcacagtgaaaatatggcataaaagctggacagggtactcaccatgaatggagcctgctggactgggagttgctttgggtgagtcagtgggtgaggggtgagtgaatgggaaggcctaggcattactgtacactactgtggactttatgaacactgcacacttaagctacactaagtttattttttaaatgtttttctttcttcaataacacattaaccttagcttactgtaacatttttactttattaactttttaattctttaaacttttttactcttttgtgataatgcttagcttaaaacaagcacattggtccaggtgtggtggctcatgcctgcaatcccagtgctatgggaggatcgctcgagacgaggagttcaaaaccagcctgggcaagacatggcaaaaccctatctctataaaaaaatcaaaaaaattagccaagtgtggtggtgtgctcctgtagtcccagctactcgggaggctgaggcaggaggatcactcagcctccccattagctgggattacatgcatatgccaccacacccaatgaattttttatttttaatttttttgtagagatgggggtcttgctatgttgctagggctagtctgaactcctggcctcaagtgatcctcctccctcagcctcccaaagtgctggaattacaggtctgagccacagcacccggcctgcatgtgctatacttttatactgctggccatacggtagatttattgacatgagcactgccacaagcatgaataatgcagtgctctacaacgttatgatggctgcaaagcactaggcaataggaatgtttcagctccattataatcttatgggaccaccatcatatatcaggtccgtcattgaccaaaacactgttctacagcccatgactatgacgagtccctgttggacccctttattccccagctagatccttccaagcaggcagtttgctcacattggctctcagcatgggcctgagcttattctgatgtcctaaaaacatcacaccactactgtattcatgccaaaatgaggcttactcatacagaaaataggatggttttattttgtgcaagaaaaatggaaaaggcaagagtgacttgcctggcagttagtggtggttcctgctttccatcttctgtctgcgtctgtctctgtgcaagagtgggcctgccacatgcgtagagaaagccaggggagttccgagactgagcgggggccagagcaggctcccagaggaggtaaccacacttggctaatttttttgattttttttatagagatggggttttgccatgttgcccaggctggttttgaactcctgggctcgagcgatcctcccatagcgctggggttgccggcgtgagccaccacacatggaccaatgtgcttgttttaagctaagcgttatcacaaaagagtaaacgtcctgacttgagactcacccagtgaaagaaaggaggctgtgagtgcttgactgaatgacttaataagaccatgtcttgtcatcttgagattgaaggtgcgtggagagcagatggcaaaggactcagcatttgggacacgttttctcacacaccactgagggttgagaacgatgccattggagacgtggcctgtgacagttatcacaagattgctgaggatctggtcaccctgcagaacctgggygtgtcccactaccgtttttccatctcctggtctcgcatcctccctgatggaaccaccaggtacatcaatgaagcgggcctgaactactacgtgaggctcatcgatacactgctggccgccagcatccagccccaggtatggtgggtcctggcaaggccttgggaaagtccacatgcaggaaccagcagggctsggggagcacatttatcatgtaaacaaaatgctggtttcaaatttagcttttgttgttattgttgtttttgagacgtagtctcgctctgtcacccaggctggagtgcagtggcggatctcgtttctcagcctccagagtagctgggcttataggcacgcatcaccatgcccagctaatttttgtatttttagtagagacggggtttcactgtgttggccaggctggtctcaaactcctggcctcaagtgatccacccgcctcggcctcccaaagtgctgagattataggtatgagccaccgtgctcgacctcaaatttaactttttaattgtcagtgaattcatatgatgcagaatttgaaaagcataaaagagtttccttcccaaccttgacctcagccatctagttctccctgaaagcaatttacccttttcccaaaagaaaaagaaaaaaatctttgagcctttttgtctcataagtcactctcaggatttgcagcagacgttgatgctggcacatctaacctagggcttcccatggaaagyatgactgatgcaacagctgatctggcttcttcccaggtgaccatttaccactgggacctaccacagacgctccaagatgtaggaggctgggagaatgagaccatcgtgcagcggtttaaggagtatgcagatgtgctcttccagaggctgggagacaaggtgaagttttggatcacgytgaatgagccctttgtcattgcttaccagggctatggctacggaacagcagctccaggtaagtcccagccctggctcataggctctttgaatcatggcattcttagcacatcaagagttgaaatccagatggcacaggacgaggcaaccaagaaagccccatggcagaaaccctgyctcttgctcagggctgtagaggtttccctcctggcattgcattgttaaacatgaatttcacatctcaattcctcaaggtgggttcatttctttgctctgtgactctgatcggcctcaggtgggaagctctctgagatcagagatgtgggcaaattgatgtggggaaggacagtttgtcaggctgtacaggtctacagtctatttccacaattcccaaaccccaaagtttctgacaattggtttggctgacctgagctcatttaatagtagtgaaacctgactcaaaccaacaggaggctgctcatggtctttatcgcactgagcaaacattcctaagttctgctgcagagatatcagtgtgcttgactatggagagctagctgtctgcggcccatggggctgataggtacttttctcaaaggaaacatttaattccaaaacacatctgaccctaaaagattttttttcttttaactttggttgacatgcaataattgtacatatgtatggagtacaaaatatattttgatacatgtatacaatgtgtgatgatgaaatcagaataattagtatattcatcacctcaaacattcatcatttctttgtgttgggaaaattcsgagtcctcttttctagctttttgcaaatatacactaaattcttttgtatcattattttttattcattttttatttttttgagacagagtctagctctgttggccacgctggagtgcagtggtatgataccagctcactgcaacctccacctcctgggctcaagcaattctcctgcctcagcctcccaagtagctgggattacaggcatgtgtcaccatgcccagctaatttttgtatttttagtagaaatggggtttcatcatgttggccaggctggtctcgaactcgtgacctcargtaatccgcccgcctcagcctcccaaagtgctgggattacagatgtgagccactgcacccagcctaaattattgttaactacattcactctacagtgccacacatcactagaacttcatcttcttatctagcttaactttgtatccattaaccaacctctccctgtcctccctccctactacccttcccatcctctaataatcacaattctattctctgctgctaggagctcatctttttagctcccacatgtgagtaagaacatgcagtatttgcctttctgtgcctgacttatttcactttacataatgacctccagttccagcgatgttgtcacgaatgacaagattcatccttctttatggctgtatagtattccatcatatatagatgccacattttctttatccattcatctgttgatggacacttaggttgattccatatcttggccattgtaacagtgatgcaataaacacagaggtcaaggtattgatttggtattctgacttactttcctttggataaatacccaaaagtaagattgcgggatcccttagggttttgaataagaaattgtggacctatttttgtgccttgagaaccatccagtttcccttttatctagttctgagttaataagaataaatttgtgttcattcatgtgattcctcagaacactgtgtaacagctggaaagagccaccaggagatgtgcctcaaatcgttatcagaggcatctccattggtcctagttcgcccctttggtttacactccttcaacacatgagaggcgcctctcttgcagcattcactatcagggtatctccgtgtcagctggttgcattagctacattctccaaccctaatgatcacaatgggtccccaaggagctccagattatcaactcctgtcaattcatttgagcccaggagttcaaggctgccgtgagccatgctcatggcaccactgcactccagcctggatgacagtgcatgaccctgtctcaaaaataatcataggccgagtatggtatctcacgcctgtaatcccagcactttgggaggccaagacaggtggatcacctgaggtcaggagttcaagaccagcctgatcaatatggtgaaactccacctctactaaaaatacaaaaattaaccagatgtggtggcatgcgcctgcagtcccagctactcaggaggctgagacaggagaattgtttgaacccctcggctcactgcagtctccacctcctggattcgagtgattctcctgcctcagcctcctgagtagctgggattacaggcgcctgccaccacagctggctaattttttgtatttttagtagagacaggtttcaccatattgggcaagttggtctcaaactcctgacctcaggtgatccacctgcctcagcctcccaaagtgctgggattatgggtgtgagccaccctgcctggcctgggttgtcttttaagttttaaaaaatcatttgtacatatagtcctttctgaatataacattggtttgaagctaactcaatagaaagaaattccatctctttagtctctctagtttgactatagtagctaacagagctgggctgcaatgtcacacttcacctttaggtgccaccatctgatttgatttgctccagcctaagcatttcttaaattgggggctttagattctgcgataggtatctctattatgggtattttgcctgagacgtacgagccactcttctggaggaggggaacagaagccaacatttatcaagtggccttccctcttccagacacagtgctgctgtgggcgggtttcatacactgtttcatttccctctcacaagcactctctgctgcccatttcaccaaggaggaaactgaaaggctgaattactcacccaaagttacacagccaggtaataagagggagagccagggtttgaattccagttttcctagtgtcagaatctacaccccttctcccaaacacagaggggacatctgcaggcagggactaacaatctcagtcacatccattctatccattctctgttgacatccatgtgtatgtttccaggagtctccaataggcctggcactgccccctacattgttggccacaatctaataaaggctcatgctgaggcctggcatctgtacaacgatgtgtaccgcgccagtcaaggtggcrtgatttccatcaccatcagcagtgactgggctgaacccagagatccctctaaccaggaggatgtggaggcagccaggagatatgttcaggtctgtttttcctctgggcrcttgttcttactcttgtccatctttccttccagcctaatggaaacagattgtgaatcaaagatttagggtgtggtggctcatgtctataatcccagcactttggaagtctgaggcaggaggatttcttgaggctaggagtttgagactagcctgggcaacatagaaagaccttgtctgtgaagaaaaaaaaattattagggcatggtgacacacacctatagtcccagctgctcaggaggctaaggtgggagcttgagtccaggaggtcaaggttgcagtgagccatgatttcggcaccattaaactccaggtgacagagggagaccacccccaacccccaaaaagaagaattattaggatctaagcctagttttgctattgcctgattttgtgagcttgggaaaatcatctaactttttcgtaccttagtttcctcaacttcaaactggagatgtcctgcccacctcaaaagtttgctgtgatgaaagtgataaagtctgtggggttaagttgtctttaagtttttaaaaatcatttgtacaggtaattctttctgtaacattggtttgaagttaactcctagagagaaatttccatttcttcagtctctctggtttgactatagtagctaacagagctgggctgcagtgtcacacgtcacctttaggtgtcaccatctaatttgatttgctccagcctaggcatttcttaaattgggggctttagattctgtgaaactcattagtgcccctaatttgccaactcaatgagtttaagaacagcatctttcagtcatggaatttcacccaaggaagtagagacattactaggaagccaactgggcaaggtggctcacgcctgtaatcccagcactttgggaggctaaggcaggctgataacctgaggtcaggagttctagaccagcctggccaacatggtgagaccccatctctactaaaaatataaaaattaccgaggtgtggtggcacatgcctgtagttccaactactctggaggctaaggcaggagaacccagaagctgagatcaccattgcactacagcctgagcaatggagagagactccatctccaaaaaaaaaaaaaaaggaagcaggtgccagcatggcctacctttatttccacctgaacccctgactgacaagaggagagaaggaaaagaatgatcctcgttcacggcacagctcctctggctcctcctagaaagggatagaaggtgctctctcctacattttgcatcaggaaggaaaggcaagggtttctctctggattggttcccactttgggctccgtggaagagtctgccaactgtggcactataactctctcgggrgaaacaccatgggccttggtttgccaaactcttcacaagagaacttgacaaagatagtcaaattaataaatgcaacgaagggcttaattttctggtctgctagccagctggggaaacagttttgaaacaaaattaatgtatccctcatttcagactcacagaactggtgatttagaacaacatttccttttttcctgaaatcaaaacttcaaacgtcaggaaacgttaggctgtcatatcattagattgagccacttactggtgaactgtgatactgcagccatggactatgacagatgcatctcttattagaatcagcttccacgaaaatatctagtgtgttaccttggagtgggtgcatttaagcctctttaccagggcatgtgtgttccatgcctcatctctgaccatgagtggaagctgccctcaccccacattcccagcagcagccagtgggtgaggagaggatttggagagactacagaaggctctcaaacccccagcatcatagtgtttgggtgccacgtatccccgcacatgataaggatggcctaggcctcattagagaaaataggtcaaacggttccccactctggggctgtgaaagcccattaagagttatyctttgcccggaaagtcaggaaagccttgcatttcagccctccccagaaagttctgtttgctccttgggcactttgatgaggaagtgcagccgctcagtggtgagaaagagaacccggagcctggaggcttgtgggttctcccttctcctctgcaggacccatccaagggcagccaggaagcatttgttgagcaccagggccagtgcccaggtcagttactgtcacctcaagctacaactatgaagaggtggccctgtcctcagtgcaacagcaactgagcaagcacagacccagctgggagacctgtggacactgaagctgcaacaggcaggagccacagggaagagagcttaacctgggggtccaggaaaaggagggaggttgtgaggccaggcacttctgagcggggacgatgctgtctcttgctgtgcccacctgtaacgcctgggctgtctcccccaccctacccgcagttcatgggaggctggtttgcacatcctattttcaagaatggagattacantgaggtgatgaagacgcggatccgtgacaggagcttggctgcaggcctcaacaagtctcggtaagggcctggtgcccgcagtggtgagggcatgggcgtcggggtcacagaggcatgtctcgggcaagttaccntgactgagcttctttgcttgctgggaagttacatgtgatcntatatgtaaagcttagcccagcacctggcactgctatatgcttgacagaggggtttgctattatggttattatattgtggaacagccaggaaatctgttccaaggctatccacctctgagcaaccccactatgccactccacagacaaatcccagctcatcctatcctatttcatcaccgcacgtgtgaatgtgggtggcagtggctgacagtcaggcgtgtgctttgcatcacttggccagcaggtggcgatggtctgcaccaaagcgtccttccttacccgcccgccccttcttgtcaaggaaggagtagcaacattagcagccaacgtttacccatcttctgttggtatctttatttctatttaaatacgagtaaagtgaggcgcaaagattagggcaagatcacccagctattaagagatagagctgagatttgcagccaagctgtcggcccccagggcgcatgctgggggcttgagaatcatgcaggtggggtgagaggtgtggtgtgaggaagcgcaggaagcggcagtcactgcccacgggaacatgcccaccgctccaaggctggcgggaatcaagtgtgaattcycaacatagtctttgagtcctgcccctagacgcccccatatagtccagctgaggattaaaaatccagctcccaggccgggtgcggtggctgacgcctgtaatcccagcactttgggaggccaaggtgggcggatcacttgaagtcatgagttcaagaccaggctggccaacatggcgaaaccctgtctctactaaaaatacaaaaattagctgggtgcggtggcgggggcctgtaatcccagctacttgggaggctgaggccagagaattgcttgagctcgggaggcagaggttgcagtgagccgagatcatgccactgcactccagcctggacgatggagcaagactctttgtctcaaaaaaaaaaaaaaaaaaaaaatccagctcccacctcacaatgcacaccctggcctagttagggtaagttccccagagcaggctgtgcctaaaggtctgatctgcgaactgtgatctccagcaaaaccgatgagcgcccggcccatctgcacaactttgccgagcacctaccatttgcccgagccagggccagggggaggggtccatggaaggagaggattccattcggctcctcaagctgctgacagatcagctggaaagacagttctccatcccattccccaggctcttcagtacaaagaaaactcagaagatgagatcagggtaggctgggtagacccaggagatttcatggacaaggcaggacatcagctgagctgggccttgacaggggatagaatgtgggggattgcaggtcattctttccacggggcagagttgtgaagacaggcctagaggtaagaatgagtgggggtgccagagctgagagtggggagaccagcccagcagcagtgaaggggctgaggccacatggtggagggcctggaagccaagcacagggccttggctttggtgccacaggccattgctggcttctgagcagaagcgtcagggacaggaggaggctgtgctttggttttctcccatcatctcagaaaccccagggaaggaaggttcttgatccctcaggttaatggtagcagaaaggtcaagatgaaagtgtcagaggcctcagcagggcatctctgggccacacctaaaccagaagccccaggtctccctgtgggcatgcgcatgcattcaggatcacctgtacatgctgcacacaagtgtattagtcaggttctacaggagaggcttttcactcagagtgcctggaaaatgctccatctanaggttaagaagccaaagttcccaggctcacaagtaatctcagcactttgggaggctgaggcaggaggattgcttgagaccaggagttcaagaccagcctgggcaatatantgagactttgtctttacaaaaaatttaaaaattatctaggcatggtgacgcacacctatattcccaactacttgggaggctgaggtgagaggattgcttgagcccaggagactgaggttgcagtgagctatgattgcaccactgcactccagcctcagggggcgtgcagtgtcctcaggaggacagggcgagaccctgtctgggaaaaaaaaaaggaagaaagaaaacaaagttcagtgaaatcgtgagaactgagaaattcaaactcaaatactcaatttgcaaattatttcccctgctactttgaagatcttgaagctattattattattattattatwattatwattattagagttggagaaaagaggcatgcctaaacaaaccccaagaggagcagagaaacttggaaagggcagaaaacggaaatacaaattacacaagatacagggccgggtgtggtggctcatgcctgtaatcccaacactttaggaggctgaggtggggggatcacttgaggtcaggagttcaagaccagcctggccaacatggtgaaaccccatctctaccaaaaatataaaaaatcagccaggagttgtggcaggcgcttgtagtcccagctacttgggaggctgaggcaggagaatcacttgaacccaggaggcggaggttgcagtgagctgagatcgcgccactgcactccagcctaggtgacagagccagactcagccacaaaaaaaaaaattatacaagatctaactttacaaacataggggaagagtctcagatatgtacctcaggcatgctcttgattttgaaatctgtcatagatgctaaatatcagaatttgcatatgttgtttgaaggaaattaaaaactgtttatgcatgtgtgtgtgtgtgtgtgtgtgtgcgcgcgcgcgcgcgtgggtgcgtgtgtgtgtggtccttcaggtttcagaggctcttgtagagacctagggaagccaggtttatggtctggcgggaggagcygcaggtgcttcctgcaccgcctgaaggacctcttctccttccctgccagtttcccctactcactgccaagtgcctggggttcggagagctcccccgccccagccctrtgacgttctcttctcaaagcatggctctccctgaagcccygccctcaatggcttcttccacccaggctgccagaatttacagagagtgagaagaggaggatcaacggcacctatgacttttttgggttcaatcactacaccactgtcctcgcctacaacctcaactatgccactgccatctcttcttttgatgcagacaggtaagtccaccaacagggagccyggagccatctctggaaaaggcagaaaggtgcccttggctgtgctctctgaggcctgcccagcctcaaaacagggcctccaacgccgaatgtgccggggtttgcaagatgctcgccaccccacagatcccaaggaaatctccagcaagcaagagggagagaaggccggggtctccagggcacctcccattagggcacatgtgcttggctttttgtttttttatttcatttttaaaatttatttattttgcgttctttttcacaggctgcttaactctaaaaatgcttggttgttaaaaaggattttcaagaaaaaaattgtttaggttttatcaaaattcgctttaatattaataaatattacaataatacaagagtaaaattttattttctctttttaaacaatgcttttatgaagtagagatagtaaaagattttggttcaccttttaagtaacagtttttatttttattttatttattttttttgagacagagtctcactctgtcaccaggctggagtgcagtggcacaatcttggctcactgcaacctccaccacccgggttccagtgattcccctgcctcagcctccaagtagctgggattacaggcgcgtacctccacgcctggctaattttttttttttttttttgtatwttagcagagacggggtttcatcatgttggccagaatggtctcggctaattttgtgtttttagtagagacagggtttctccatgttggtcaggctggtctctatctcctgacctcagatgatccccttgccttggcctcccaaagtgctgggattacaggtgtgagccactgcgcccagccgattgtctttttctttatgatatctatttatctagagactttttcatccatatcctgtattgttttttaaatttctctaagttaattttcacctttctctagtacctccttgagtagtttaataatcaaccttctgaattctttatctggcaattcagagatttcttcttggtttggatccatagctggagagttagtgcgaccttttgggggtcttatagaaccttgttttgtcatattaccagaattaacatttctggttccttctcattcaggtagactgtttcagtggaaagatctagaactcaagggctgcccctcagatccttttgtcccacagggtgatcccttgatgtggtgctcaccccctttccctaaggatggggcttcctgagagccagactgcagtgattgccattgcccttctgggtctatccacccagcagaattactgggatctgaactggtgctgaggaatgtctgcaaagagtcctgtgatgtgatctgtcttcaggtctcccagccatggataccagcacctgctccagtggaggtggcaggggacttaagtggattctgtgagggtccttggttgtagttttctttcgtgcactggttttctcaaacgctggttatgcgagcagtgaagttgtcatgtggacagactcaggacctctggttagccaggatgttgcaggcagtggaattagttgttgttttctctttctttggagcagggttcttctgttatgagttgctataatggcgtgagttggttggtctccagccaggaggtggcactttcaagagaggaggtggcacttttgaggtgctttccccttccactgccaccagctgcggtagtagaagggggattacaaggttgccctacgttggccagggtatttgggtttctcaggttatgggcggggccatagagctcccaagagtttatgtcttttgtcttcagctaccagcaaaggtagagaaagaccatcaggttggggcagcattaggcatatctgagctcagactctcctcgggtgaggcttgctgtggccactgtgggggaatagggggctggttctcaggccagtggagttctgttcccaggggtattatggcttcctctgctgtgtcatacaggttgctagggaagttgggaaagctggcagtcacaagcctcacctagctcccatgcagccagcaaggccagtctcactcctgctgtgccctgccaacagtgcncagggcagagatctcaccccaggccacaagccttctctctgagaaagcaaacagggctttcaggccttgcccctccccacctgcccacactgttggctgtggcttctgtgcttttatctgcacttcttgtttgcccccaagattctgctcaggaaaattcatgcttctagttgaaattaataagttgagctagaagcttccttaatcctgcccctccctaattccactggcttccttctacaaggacccctgtaggataaagtcaggaatggcttccctgggctcaagctggggacagggagtggctacagggctcttcccactgcttcttctacttttacatttcacttggctccctaaatccacttgcgctctaggtaaggttaaatccttctcctatgatctggatgttcaggtccccagagaggatgtgtgttcagaggcagactttccccttctcacactttgggaactcacagttttgcagctgtctcatggagtttgcagtagcattctgcttctttcaaaggtctgtgaattcttttggtttttctggtatgttccagcagtagttcttggagcaacagttaacaatgtgagtctccacacactgttctgtccatccaagtgggagctgtacctaagtcctgtctcttatctgccattttcagaaaatctcattttgttccttttccatcaagcatctttccacaccagtagctctgactgtgtccaggttctttctttgaaaaccagcccctccactcccactgtatcctgaaacccccagagtcaggctcaccaagggggctgaggagactccagaacacccctctactccttctgattctccctccctcttatgagccctggggctgtccctgggaagacctccactagtgcttatgaaatggcccacattcaattcagctgagtcagataaatccaggtgctgataaaaccaacattttttttttccctgaaagatctgagtgtaggaagtgtctaaattcttggttcttatttgacatatgtgactacaggtgatcaggcttctgtggcctcccccagcaggcacccctgtggcaggagctgtccacctcctcgtccatcactgaagagagaggccaggctcttggacacttgaaggaggtgccagcctgtctgctgcctgtcttcacacaaagcagggcccctacaaatattcgtgcctgtggcctcacccgtggtctgcaagtggcattgactagacatgggtgacttgggggagcccattctctgaagacacagcactggcgtccattggaagcctggagctggggacccatagcctttcatagctggtgtaaggagccatctattcagagtagtggagggctgggctccatgagcaagaccattctctgcacaggcagagaaattgaaggacggagagctgagtggcttgtccaatgctatacaagcacagagtgcaggcagctagaaccagcgaaaggaggagaatttgaggcaatttgattcttctgggtttagtatgattcttaaggctagacaaaacctaaggcttttcctggtctaagtcctgttttgtgtttcgtgtaaagggcctcttgagatttacaaaacaagacctcatctttagtttttgaacttgtagaggagttgcttccatcgcagatcgctcgtggccagactctggctccttctggctgaagatgacgccttttggcttcaggaggatcctgaactggttaaaggaggaatacaatgaccctccaatttatgtcacagagaatggagtgtcccagcgggaagaaacagacctcaatgacactgcaaggatctactaccttcggacttacatcaatgaggccctcaaaggtacgacgggcccgcccttccmcagcgtgcaccttyccctgttggaaacatctgctatytgcaggagtgtgatacagcgtccttgggccacagtaagaagagaacgataagscttcttgctcctgtgggggttaagctttgctttagggccgcactctgagtttttttccttcctatgtctaagctcagcaagcaagcccagtggcctgatgccaccaaaccctagttcctggcctgagtcacttgctccccttgatcctccctgatgtcggaacagcagtgccctcctgagaatggtctgggtagggcccaggaggagtaggctgtgtggttgcctgtagggtctcttagtctccgagcaaaagtttgaggctcttggctcagccctaacaacttgagatgggaccatgaggataagagaatggaacaaatgctgagtaaaagagcaagcaatgcaccagcaaaggaaatgattagaaaaatcctacccagctgaaatatattctatctaagggctattttctacagggagaagcattaacattctaaggcactgaccaagatcatggatagaagtgtaggtgacccagggaaattagtccacccatgttcccgactcccattcagggctgagcctttctaaagatgctggtggctctacatctccatccacagaggacccgctaacagtcactgcatgcaaagaaaggggcagctttctcacagagctaaagccaaagcttayygccatctgtgaaggcggtggggagagcagtaggcagacctggcttccgaaggcctggcaggaagctgccttatgagataggaaacttatgcctagtcctctgtgtttgagcagctgtgcaggacaaggtggaccttcgaggatacacagtttggagtgcgatggacaattttgagtgggccacaggcttttcagagagatttggtctgcattttgtgaactacagtgacccttctctgccaaggatccccaaagcatcagcgaagttctacgcctctgtggtccgatgcaatggcttccctgaccccgctacagggcctcacgcttgtctccaccagccaggtgagatgtggctctgggagggaataaagcctaagggtgaagggcaggtggaagggcctctctcagtctgttttcttctagtttattaccctcctctctgctgccccatctccttcattcattcaacaaatgtttattttctttgaatgctccagacatttcctggggtggaacaaaggacacttagggtcaatgttacacctagaaaccagagccctgacctgggaataagcaggtctagactcttcttccagccctaccactaacttgctgtgcactcatagataagaaaccaggcacatgcttcagggcagttataaggatcaaataaagggaccatgaaagtacaatgcctgcaccatgtgggtgccccgtatttgttaaatgtaagagtataaatcactacacaaatgtaaatgacaattatccagtttcaattatacaggctgagaatccttcatctgaaaattcaaaatccaaaatactccaaaatctgaaactttttyagcatgactggcatgacaacacaaatggaaaattcaacacctgaccccatgtgacaggtcgcagtcaaaacacagttaaagctttgtttcatgcacacaattatttaacatattgtatagaattaccttcacaccacgtggataagttgcatataaaacatatatgaatttcatatttagacctgggtcccatccccaaaatatctcattatgtatatgcaaatattccaaaatcttaaaaaatcccaaatctgaaacacttctgatcccaagcaagcatgtcagataagggatattcaaccgtattctaattgctgatagagatgtttaaaaaatacaactgcttaacttcactcagaggctcctgacacacagtgaaaggggatgggtacctccacctcggcatcccgtcaatggctgtgcggatttggggtaccgtgcagcctctgctggggtctcagagatctgagaactcaaatcagcrccagagcaccaaycaccctgtgtcacactctcctagatgcyggacccaccatcagccccgtgagacaggaggaggtgcagttcctggggctaatgctcggcaccacagaagcacagacagctttgtacgttctcttttctcttgtgcttcttggagtctgtggcttggcatttctgtcatacaagtactgcaagcgctctaagcaagggaaaacacaacgaagccaacaggaattgagcccggtgtcttcattctgatgagttaccacctcaagttctatgaagcaggcctagtttcttcatctatstttaccggccaccaaacaccttagggtcttagactctgctgatactggacttctccataaagtcctgctgcaccgttagagatgactttaatcttgaatgatttcgacttgctgagtaaaatggaaatatctccatcttgctccagtatcagagttcatttgggcatttgagaagcaagtagctcttgcggaaacgtgtagatactggtctagtgggtctgtgaaccacttaattgaacttaacagggctgttttaagtttcagagttgttaagggttgttaagggagcaaaaaccgtaaaaatccttcctataagaagaaatcaactccattgcatagactgcaatatcatctcctgcccttctgcaagctctccctagcttcacatcttgtgttttccagaaaataaaaacagcagactgtcctttctcctatggttgcccctccttgagaaagtaggttcaagagaagttatgaagtcacacaagccatctggagctccgattaagctttctcaccagaccaagtctttctgttgacattatattccttggggcaaataccacaacatgcagaaagtggccttttcccacccctcgaacacccccactgccactttttatgccatccccagctctcccatctgaccttggttcatttagtctgtttccttcctcctttcccaatttgtggtagttctaaacggcacataggacaactatccatattcctttgtgtcttcccaaatgctactccttccacctaggatgccctttcttctgaaaatgcctttaagtctcagctgaaataatgtacttcctcctctgaatggcttccctgaaatccccaggcagattctccttcgtctgctttgcttgtaaatatcccctattacaacttgaccatccagtttctatactggaattgcgtatttctctatcatcagcttcttaaggccaaggaccatgtctcattgtctctggcaagcacaacttggagagagcaatgaaaagcacaaatgctcctttcgtgtgttcacccattcacatagcatttccagggcagtggtgggagcagagatatgttctttacaatcccctcaaatgtgctgagagacaatctcagtgtgaaacacctaaacacttgattggcccatatattacatctagatagctgggaaaatgttttgtaaaaacagagtaattttgggctggtcttaaaaggatgatcacacttgaaatttgcttcttgtaagcattcctttccctatcaaaacattccaacgccatgagtcccaacctggcagtcaggagcttgtggtgcacaagcatttttctccatcaatcgactggaaaagtttgtcagatgggggtgggggtggttctaaaattgatattaaagacatttgttggccgggcacggtggcgcacacctgtaatcccagcactttgggaggctgaggtgggcagatcacgaggtcaggagatcgagaccatcctggctaacatggtgaaaccccatctctactaaaaatacaaaaaattagccaggcgtggtggcgggtgcctgtagtcccagctactcaggaggctgaggcaggagaatggtgtgaacctgggaggcggagcttgcagtgagctgagatcacaccactgcactccagcctgggcgactgagtgagactgtctcaaaaaaaaaaaaaaaaaagacattctttggggagaaactcagtatcataaggtgccaattatacctaaataatctcaaaactcaacatcacttttttgggacaacactaacaaaataatataaagaagtttcatatatgaaataaacttgtaagaagagccaggataaatctgggggaagaagattaaaacacattataaagctagcttagtttggtatagcagagagcaaacagatcaataaaggaagagaaagcctagacacagaagcatctgcacatggaacagatgcccacctcgcaggcagtgcgcctactcggggcagagggcccatgaaggcagtgagggaacaggctcctggggatgttagccacgggcatgggaaggagccaggtcctttccttggataccagatttaaacatacaaaaaggaaaccataagaatcctaggatataaaaaaattaatttttgaagtgggaaaggtatttataagcaagactcaagacctggaggtcataaaggaaaacacagataatactgtggaaaaaattaccaaatatactcaacaaaagggagggagaagccaggcgcggtggctcacgcctgtaatcccaacactttgggaggccgaggcaggcggatcacgaggtcaggagatcaagaccatcctggctaacacggtgaaaccctgtctctgctaaacaaaatacaaaaattagccagctgtggtggtgggcacctgtagtcccagctactcgggaggctgaggcaggagaatggtgtgaacccaggaggcagagcttgtagtgagccgagattgcaccactgcactccagcctgggcaagcgggagactccgtctcaaaaaaaaaaaaaaaaaaaaaaaaaaaaaagagaaaatattcactgcatatgctagcaaatggctgtaatgtacacagtagtcttataaatcagtaagaaaaatatgaaaacaaaaattggcaaggaatacacggagctctcacgataagccaaactgatcaataacatcaagatgctcacttcattcatgataaatacaatgcatacgagattgtatcatttttcatccatcattttgacaaagctaagaaagtatgataatacagtgttggcaagggtgtgggaaaatggacattctcatgactgttggtaggggttcaaattcacacagcttgtagaggaggcaatgcaacagcatctttcacaatccaaactgcaaacactcttctttcacttagcaagttatacaaacatattctacaggtatattttcacagtaagactatacctcccactgaaggttgcttacgatggcaatgtttgtaatagaaaaacaaaattgtgtaataaccactgactgccaccagagcatggacagtaagctgaatgcagtacattcatcaagcagaatgctatgcaaccattaaaaatgaggtagctcagtgtcgacaggaaaagatctcaagactatgtaagcaaaaaagcaagatgcaaggtagaatatataatatgatcccatttatttaaaaaataaagattacatatttgcttatatacgcatacaaatttyytgaaaattacataagaaattgttaatagattacctctggagaatagtactggggtaagaggtgagggggcagaattctcattttacagccttatatactgttgtgaatttttttttttaccatgtactttttaaaaatacaaaattgaggagggaacctcctactccaaaattacgaagcattcttttatgtacatttctctaagagttatatttgatatttttcaaggcaaactgacttgaggtactcgatgtttttaaatgtatttctaataattattagtagggtcacacctatttgacagcttttttaaaaagtcacatattgctgtatttttaaagatgacaaacctttatttaaatgagatgcttgctggagattttctttttcaaactcactttttaagttatggaaataatatcactgctgaaagtttggaaaacatatataagggtgccaaaaataccactaaaatcacataaaccaatcttaccattattaatggtgtgatttctttctttacatatctattaatacctagtactatctatgtagaaaatgtgtttgcaaagctgagatcacactgtacctatagctctggatcctgctgctttttcccccaacacttaacagatgctcagtaaacatgttaaaccaagttgttaattagtattgtaccatttctcctcatcaaaaattacttctatagaaggcatttagttggtttccagttcttgagtaaaataaataacacttaatgagtatgtctttacctaaacattgtctgcatttatgatttagaagaagctactggatcaaacggtatgaaatattttaagtttctgataaatgtttttcagaagaattatactggttttcactcctaccaacagcgcagcctgtgttgctgtttccttgccaacactgtcaccattttaaaaagtcactgttatttcacaggtaaaaaatagaaagtttgctctgagaaaatttcttcctcccattacaaaataaagtcacagtctttccgtatgtccactctagagtgctatcttccaatctaaaacagaggaactgttttcaaacatcattagtttagcggtctccactaacaaagacatacggataaagtaacatgtaagtcagattaagaatctcaactttttaagaaaaaccaaatgactaaaggcatatttttattctatactttttgtcctataggtactctaggtccttgtgtaattattgaggacaaaacgtcagttaaaggtgagagggaaaactaggttgcagactagcagctgttttgcatctcacaagaacaaaggccttaacaaaccgtatactttatgcaaacaaagtgatgcctcactgacttaggagacaagtcacatgccatcagtgtgtcagaaaatttctttcttcagtgatagttaaggtaacctcgccagctactttccagagacagctccagggcaatactggggaaaaaaaaaatcagagacataggacctcaatagagccctgtgcaacaaaaagatgctagataacaaaactcaaagcaaaactaagatcattccaatttaggggaaagtttttttattcagtgtttaagattaaaaactacaagattttgcttgcagctgatgagtaaaaagagaagttaaacataaattctcatctgagtggctagttaaaatgctctgacaccgagtcaagttactcagtgacataccagttactttgggcttaagagtcttggagcaaagtagctctaaacaaaacgtgtcatctgaagcatagggctaatgggcatatgaaatactaaataagaagctgatggaggcaggctgtggcagatttttggttcttttagggttctagcagtggttgccatataagcaaggacctagcagagagttatttcctgtctttacttttctgagttaaacaccttcaacccacacccactaagcaggaataaagagacattttatagaccagttggaaaatataaagcagtcccacttctccagtagaattttagttgaattaaatcataagagaaacaatgattattgcacatattatacttgtcacactacatctgttgagtggaatttccattccaagtgttgttttcatcttcaccatcatcttgagtccttaatctataaattttcccctcctttttaaagtcgtctccacgtttttccagcactctttttctcactggttccctgatacgaaaaagagggagcaaggggaagatgtcataaaataaaaacaatagtaatacaagctgtttccaacttccatcagtacaggcaactaagttttacttttaatgccatctaaagtaaggaaagtccatgggagaccattatatctactaacacagtactagactttagcagtctttggtagtttagcttcatctgatctctaagtcaagccagccagccaaatcatatattccatttccattgtgtttcttagtgacttaataagcattagaggagtgtgaccatttgccaactaatctttcctttgttatttatgcaagccgacattatctactaaaacatttgtaacttagcaccctagagactatccaaagctccagtcagcttgacagaaagggtcaattttaaatccttcgcaaaatcttcaagaatgacttatttataaacaattaagaatgaagaggacttcctattctgaaaatacaaaggtataaggataaaatttaagccaacagacttttataactctagaggggagagaaaaaaggaaaaataatggtggaacacaaagcttcaccctctctttgacacaccttttattccatcctttgctctaatctaagacctttctcttatttgaaaaaagtgttgttttttgttcttttttgagacagggtgtcccctctgttgcccaggctagagtgcagtggcacgatcacggttcactacagcctcaaaactctggagctcacacaatcctcctgccccagcttcccaggcagctgaaactataggcacatgctatcacacacagctcactaaaagttttttttgtagagatggagcctcactatgttgcccaggctggtctcaaacttctggcctcaagtgatccttgcgc

SEQ ID NO: 10691 - DNA, 230101 bp, Homo sapiens
  misc_feature (1)...(230101): n = A,T,C or G, or insertion/deletion polymorphism (see Tables 1-2)
caggctggagtgcagtgggagccatctcaactcactgcaacctctgcctcccgggttcaagcaattcttctgcctcagcctcctgagtagctgggattacaggtgcacacgaccatacccagctaattggtttttttttttttttttcctatttttaatagagacagggtttcgccatgttggccaggctggtctcaaactcctggcctcaagtgatctgcccgcttcagcctcccaaagtgctgggattacagacgtgagccaccatgcccatcctcctttggtttcctcttatcctcggctcctctgggcatttcctcttgagcctctcctaattttctgttccgctttgatgcaccccccggcccacccaagctcgccttcctatccttgttgatatttgcatcttgtccttcgtgggattccaggtacattcttggtggacttggtggtggttatgtgtgcggttggacggacagacttgcttttagcagccacttgtccttgctggcagccactggtatttatatgtctgtccccagtgcccaacrtggtgtctggcataaataaatcagatgttccattaatacacacacaagaaaactgcatggtatcagcacttatctgtctggcattagttttaaaattgtatgtgtcttagaatttgctaagaaaagtttactgtaagctcttgaggaaagcttttcaggaggaattaatttggagaaaaatgctccatgcctaggagtgttgagtgctcacagatgacactgtgtggggtccctgccactccctagtttagttttatttcttttcattgccccttccccacaataggtgctcagttattaaaaatcgatgatttaagtaaaaatataaaagtcatagctgcattatgggaaatgtggataatgggggaaagggaactgtaattgactggttagggcgtggtttctggagccagttgtgtgggttcaaaccgcagccccaccactagcggctctgtgatgctgagcaggtgacttcatcccttaggttgcttatctgtaagatgggaacagtaatataacctacatcctagagttctgaggattaaataagtgcatgtttattatgtacttagtaatcactgtaagtgttggtaaaataaaatgatcgtaaatgcatgcttaccatgctaacacttccatttcttctctttggagcgacagaagctcctcctcttaccaacaggtttaggttcccaagactgctgagaagtccattcattttaactccaaatcacctaaccaatgaccagtgggttcacatacacagaatttttttttttgctccgactcctaggctggagtgcagtggcatgatatcagctcactgcaacctctgcctcctgggttcaagcaattcttgtgccacagcctcctaaatagctgggattacaggcatgtgccaccatgcctggctaatttttgtatttttagtagagatgggtttcaccacattggccaggctggtctcaaacacctggcctcaggtaatctgcccaccttggcctcccaaagctctgggattgcgaaccactcccctggcccacatacgcagaattttaattttttccccaccataataagcttctgtctcttctcactaggacactactattgcttttgtacttactggacaagatggagttgtgttctttaaatgtctcgaaagtaatcacatacccacaaaatacacacatacactcagcacagggaagccgtccctgagcatgagccatcctgagatggccaggctgaaatgtggattgtgaaacactgctcgctttttattattttttcctggattgtggttttgctcttatctatgaaagtttgaaatctgagagcttgtaaggagaggggcttttttttgttatgtttttttgagacagagtctctctcccccaggctggagtgcagtggcacgatctgggctcactgcaagctctgcctcccgggttcacgccattctcctgcctcagtctcctgagtagctgggactacaggtgcccaccaccacgcctggctaatttttttgtatttttagtagagacggggtttcaccatgttagccaggatggtctcgatctcctgacctcgtgatccgcccgcctcggcctcccaaagtgctgggattacaggcgtgagccactgtgcctggccagaagaggggctttcgtactggaatccctccctgccttagctcgtttgagtgttctccctgtgccctttccgtgcttgtactcctgtgtccatagctctaagcttttcatggagctgtgttttttgttatgatcattgtttttggggctccgtcatatgccttcaaggcccctttctcctggatacattctggcattttctcctccctttttcttccctggtttacctttgtttgctccaagtgtttcagttcctacctttttccttcagttgcacacccttctcccctccacattcccggtattttccctgagtgatcactggagggagagctgggagagctgagcattccacagtgggctgccaccctccgctctccaagcccatgccacctgtggcttctggagtctgtggatgctgtctctcttcctcagtgaccacgtgatcctgtcatctcataaccgcgcttccttacatggggtagaggtgaggggtggagggtgcatatcttaccctttgtaatattccaggtaccctctgaacattctcagtggacgcttgggtatttggttggatggacacacttgcttatcaacaagtagtttgtttacggagtgcctcagtgctcgctccctgcatgccaggggcaatccaggtgaactgggggtcctgctacccactgtaagctccaggtgtagcgcagaagaccttagagtgcccttggcaggcagcctttcctctgctgtgtgcagctcatgggaggaaatctctggaaccttctgagacaaggtgtgagcaggtcagttcggtgttaggtgatgtttagttctgtggccgccaatgcagtgggttgattgttgtgaaggaggtagttcctacgtccagatttttgtgcccctgtcatcacaggaatctggaaggattgctcttagaagaatgcagctctgtccatcattcggagggttcttttagcaaactgatacccacaggggtaaaatgtagccagcctccatagtaaattgctcagtttaccaatgtcctccgttaacaacaacagcaaaaatcttagaacccctccagctgttaaaaggttccttcatttagtgtcgattccagctaagctttcggaaactaagctcattacattgcagatgattcactggggatataagataacttcatttttttttattaaaaaaccgttattttcattattaaaaactgttaaaggatttcactatttaaaaaatttcattttcattatgaacgaagcaaactcagtttgtattttggttcaggtcgtttctgtagataccgtattttcttacactacctgccttagatttaggcatctagagggccacggttaagattgtgctcactcgcttcctccgaggtgccccagacggtgccacagtgagcacgtcatgtccatttctcttcagggatggtacttatttgtcctttctgtggttgattttttttttttttttttttttttttttttttgagatggagttttgctcttgttgcctaggctggagagcaatggcgcgatctcagctcaccacaacctccgcctcccgggttcaagcgattctcctgcctcagcttcccgagtagctgggattacagacatgtgccaccatgcctggctaatttttgtatttttagtagagatggggtttcaccgtattggtcaggctggtcttgaactcctaacctcagatgatctgcttgcctcagcctcccaaagtgctgggattacaggcatgagccaccgcactcagcctttctgtgattttaaaacaagctgaagaaactgtttaggacctagtacactgcattttacccatagctctcacactttaaatcaggaaagtcctggtttaagttacttgtatcactgatgttgacttctacgcctcaaaccttgtgcccttatttttgtctcagaaaacataaggccctgtgctgagaaagtgagggagcgataatctcgcattgacaggggccttctctgttgcactgtcattcccttggcttagtcaagaacttatctttgtagtagcaaaatgcctagattgctgtttgccgacccactccggatagttttatggttcattctccgaaacaggtattttctttctttgtactgtggttgagaagtagcttcctgtcctctccacagtgtctggtatagtacgttaaatacaacaggtggatagctcaatgcactttgaattaaatttcagtgctatgtacctggtacatttcccatctcttcctacttgttcctggcatgagtttccagctttttctctcccattgcacaaatgagtaacatgctctttcatgaacctcctgttttttgtttatttagagatgggggtctcaatacattgcccaggctgaccatgaactcctgagctcaaatgatcctcccgcctcagcctcccaagtagctgggatgacaggtgcaggtaggctacccactgcacctggcatgaatcttcaattttgacaaaacctccgaatgttttttaaaagatattttaccagtatgtgagtcacaaaatatcccattgatagatacaggtgcattatattcttttgtttcttcatctctactttcctgttggctgatttaaacttctctctatgtgtgacatagaacattgaatgaatgagagaaacaccatgtggtcgtggtggtttaaaaacaccatgtgagctgtgtctgagcatcggagccaggtatggctgctcgatggttaacgattactcctggtatctcctgggccctgacataaaggagctggagagtaggattctgtgggaaccagctctaatgttgctgctttttccagcagtcttattagaagacaagcggggaatagcagtgctatcgtagggaaagtcttgtctccatttctgctttgtgaaaaagcacattattgacaaacatcgatactttaactggttttggtaacagatcatgtgtaacacgtgaggacttcttcctgaggcagggcactgcgtgttgcagtacctgcgcgtgggatgctgaggttgtgtggggggtggaggttgctgctacatagcttcaaggcggggggagtgtcttaccaatgttgccatggtggatcgaggactgaaatgcaagtttctgttcgtgaaatatgtgtccatcttagtggtgataatgacctctagaacacggatggttttgctacgccgagacctttattgttgacctgtgtagagatgtactcattagtctttttaactaattaattaattttttttttgagacaaagcctcactctgtttcacaggctggagtgcagtggtgtgatctcagctcactgcaatctctgcctcccaggttcaagcgattctcctgcctcagcctcctgagtagctgtaattgcaggtgcatgccaccactcctgactcacttttgtattttcagtagagacagggtttcaccatgttggctagggtggtctcgaactcctgacctcaagtgatccacccacctcggtctcccaaagtgctaggattacaggcatgagccactgcacctggcctcagtgtactagaatacttattcctggtattttctattacaacattatgttgcatcttgaaagttataatgaaatggtagtggcactaataaggttttttttaaaaaaaattaaaaataagtgaatatagtcaatatgattaaactgctctgatttttttttttttgattgctcttaggtaattttttctgcaggatgaattaagagaagagacacttgctcatcaggcatggagagcactttgtcagcttccaatatgcaagacccttcatcttcacccttggaaaagtgtctcggctcagctaatggaaatggagaccttgattctggtaggattttgttttcgagattcatctggatttttgatgaattgatcaatatcttcctgaaagtattcaggaaacaatggggcaacatttgtagatctcacatactgtctggttcctgggatttgaagtcctatttataaggatatggccgctctaaaatttgggtcaagattcttattttgaatactagacagagaggactaggttatagtgcagcaacacatcacttcagaatctcagtggcctgggcaggaaacgtctacaaatcacygtagcatggagtcgttgtgcaccatcctgcagggtttgttgtgagtgagaagagcagggttggaggtctcggaccagcagtcatctgctctggctcgcaagagacaaatgccatttttgctcagaaccccttgacaggaagttagttgcatgtttctgccacagcaagggaggttaggaaaaagaattccctcccaagtgctggagagagagagacaggacatccagatctgcctacgtagtagatgccgatgatacagcatctaatatgttgagcacatctgtcagaaaagcatacagtgtggaaggaagtgaggtcatgcggattggtggtgaagtgcgtctcccttccagaaatctgaaaaacagaacagctccctcctcggactcaaacacagccttcgattcaaatgtatgtatgtatgtatgtatgtatgtatgtatgtatgtatgtatgtgtgtatgtgtgtgtgtgtgttttgagacaggatctcacctgttgcccaggttggagtacggtggtgcaatcatggctcactgcagccttgacctcttgggcccaagtgatcttcccacctcagcctccacaatagctgggactacaggtgtgtcccactgtgcctgctgacttttaaattttttgtggagatggggtctcactgtgttgtccaggcttgtcttaaactactaggctcaagtgatcctcctgccttagcctcccaaagtgctgagattataagtgtgattcaccacacctagccttgattggattttaattatttaactaatgaagttataaatgcataaatgtatctttttctaaatacttacacaataaagggtttatttagaaaggatacctttaaaaaaaaaaagggttgcattgtttatacataccagcaaatgacttaaggacagtttagtcctctgagttgtaaacattagctatggtgaattcctataaaaaatgttgcgcattaagttagcaggtcacttgaccatggtccaaagaagtcacaaagtttgtcttcacattttgatgagactagtcaatgacagattacaggttgctccatatcattgaatttattagattaagtttatgaaattacatctttatatggaagaaaccctggaaaaccctcacatgagggaaggccttactgtgttgaagggcgttagtatctgtttccaaatcggctcatttgtccctctttcagatttttctacacataaaccagatgggagaagacttctcctgcaagtaaagctggatcattgttcctccctggaaacatggaaattattttctgagaaggcatagttgtataggctgaaagttcatcctaattattctactttatttaagtacagatttccctttttaaaaagtctttcctatgtttgctgagtgaagttatttttcaaattctggagttcctgagctttcagggtatttttgtagtatatcatctgcacacatccaacgtggattactgagttatttctcatgatatgttttggaaactgtttaaacaccaactgtgtattggcttttcatgtgcacacggttgcagtgtatctctctaacttaagtagtttctgaaactcattaatgataatctggtgtcgggaaaatgatttgtaccgacatttcattaagggtggctgtatggatggcaagtgtgagagcgagaatcattatatccttggctgggggagtccatgcagaaaacccatgtatactcatgttgtgattggttccttgctcttgcatcggggatggcctaaatcatacaggatgttcagatctttaatggaaatactatttctaaatggctctaaatgatcttaacatttttcagatattggctcagatttttctccacccccatgtggctaatctgtcctttcgccttgggatttctgtatttacttgtgcggtgaggagagttttagatgacgatacagactctttaaagaggacacacatttaaagcagagtctaagactttgcagaggacagtggctggattcacttgagaaactcaaatctagttttgagcattttcattccacaagtagcttattttttttttactaaaatctagttttgagcattcamactattaagtatgattctacaagtagtttattattattttttccaatctgctaacccacaaaatatttccagtcctggaatcacttggtgagatatttggttctgggaccagctgggacaggtttggggctgttgcagagtcttagtgctgaaggtcttctcctgggaagcattttcagatgggacttactcatcccacgtacaggaggaggcaaacccagtgttctttagctggttctgaactgactcgcgatgataggtgtatgagttcagactgtgtggcaggcacagaaaatgttaagttctttgcgtgtgttaattcacctaatccttcaacagcccactggcattcaacagcccactggcatagctgcttttattgccccactttcacagatgaggagactggacgacaaggtgaagtgacttgagccctgtgttagaagcaagatttaatttcaggcattgtgaggctgtggagttggtgctctgaaaccctggggggcacctgccccttcaagtgcacagatgagtcatcaggaaatcccaacagcctcctacccacccatccatacactcacacccacactcacgcccaccccacagccacacacacccacactcacaccaccccacagcgacacacccacactcacaccaccccacagccacacacccaccccacagccacacacacccatgcacacacccgaccatccacccatccacacatacacccacacacacccacactcacacccatccatccacccatccatccactcaacccacactcacacccaccccacagccatacacacacacactcacacccatccatccacccatctatacatacacccccccacacactcatacccatctatccacccacccatccacacatacacccacacacacccacacttacacccatccatcacccatccacacatacacccacacacacccacactcacacccatccatccacccatccacacatacacccacacacacccacactcacacccatccatcacccatccacacatacacccacacacacccacactcacacccatccatccacccatccacacatacacccacacacacccacactcacacccatccatcacccatccacacgtacacccacacacacccacactcacacccatccatcacacatccacacatacacccacacacacccacactcacacccatccatccacccatccatccacccatccatacactcacacccacactcacacccatcatccacccatccatacactcacacacacccatccacatacacatgcacacacacactcacatccatccatccacccatccacacacacactcccacccattcacatacacccccacattcacacccacctcccccccacacacacaaccgccccccccacacaaaattttgggggtacagacacaacttagattctttgttgttctttcctactctttcctcccgtgccacctcccctgtgtcccgtgacacatttctacaggggttcccaaccccccggccacagattggtactggtccatgggctgttacgaactgggctgcaccacaggaggtgagtgtcaggtgagggagctgagtttcatctgtattgacagctgctccccattgctcacattactgcccgagcttcacctcctgtcagatcagcagcggcattagattctcataggagtgtgacccctattgtgaactgcatgtgccagggatctaggttgcacggtccttatgagaatctaatgcctgatgatctgtcactgtctcccatcacccccagatgggactgtctagttgcaggaaaacaagcycaggattcccactgattctatatcatggtgagttacagtattatttcattatatagtacaatgtaataataatagaaataaagtgcacaataaatgtaatgtgcttgaattgtcctgaaaccatcctcccatcccctgtatctgtggaaaaattgtcttctacaaaaccggtgcctaattgtcttccacaaaaccagtccctggtgccaaaaaggttggggaccactgtgttactgtctccctcgcaagtgactacactcaagtgactaaagtttttccttgagaaaattatgggatcgaagaaaggaaaatcaaacccgcttggggtgttttctctttttttttttttttttttttttttttgagatggagtctcgctctgtctcccaggctggagtgcaatggtgcgatctcggctcactgcaacctctgactccctggttcaagtgatcctcctgcctcagcctcccaagtagctgggactacaggtgcccgccaccatgcccagctaatttttgtatttttagtagagatggggtttcaccatgttagccaggacggtctcgatctcctgacctcgtgatttgcccgcctcggcctcccaagtgctgggattacaggcgtgagccaccacactcggccgggtgttttctcttatgtttgtttttttttttttttgccactgtccaccccgagatgctatgaggctatgattccttgcagtgatgcccccaagaaggaagacttcagctggcctcagtctcattaccaggctttttttttttttttttttttttttttttttgtgggagggccttttttttttttttttttgagacagagtcttgctctgtcacccaggctgcagtgcagtggtgtgatctccgctcactttaagctcctcctctcgggttcacgccattctcctgcctcagcctccgcagtagctgggattacaggtgcccaccaccacgcctggctaattttttgtgtttttagtagagacggagtttcaccatgtcagccaggatggtctcgatctcttgacctcgtgatccgcccacctcagcctcccaaagtgccgggactacagggtgggggaacctttttctaaggaaagctcaaatcacagttgagatcaataaccgacacccaagtcctgtaaatgaaataggcacaatataaaattactctttctcccaggaacactgaatatgtgattagaataagcccagggagaggaaatagctcaggatctgtggcctccccagcagacaccatagacagcatcatcccaggggacaccaagaaggaagtgtgcggaaattccaatgctgggattccaggtgttgtcagttgctgtgataaaagcaagcagaacaatatgctgacacagtgttcagtagattccttgacattctttttacaggcttgcgacgtgaaatttcctgaygaagtctatagataaagyggtgttgcacatttagacagggtgagcctcagtggagagaattatgctgaaaatgtgagcttgattcttcttcttggcatttggtattaactggagaaccacaggctcttctatttgggaaggaaaggaatcaacatttttcttagaaaaattcaggcctcactcttcacgctgggaactggtcctgtgtgactcaatggtattcccttttttccttaaccctcctttgaatagctgtggcttcccctggctaggtratttgtgtgtgtgtgtgtgtgtgtgtgtgtgtgtgtgtgtgtgtgtgtgtgtggttttttcttttctcctagagtaactctggccatcgggtagttggatgagtcaggaggacctttgtgccgtgaggactgtccctgcctgtggggtggctctgcagttgtgagctcagattctaggcaggtggccacggttcctttctgagttgtttgcacagatgcttccaatgaatatactcatggtggaactaatttctaaatcttaggatagtattaaatgactatcagtatttacaagaagaaagacttaatgtcttctttctgtctctttccacattaaaaaaaatatctagcatctaagaaggtgctcagtaagcattcaccctgaatctgccaattcccggttcctttattggtgtagtgggcacaggctttaatattcagccttgtaaagtcagccttgtttcagattgtaaaattgtacaaacccaagattttattccttaaacaaagatgtatgggccgtttgtttattccatttttcactctcacgtcacttacactccagcttctagtaaggtatagtgaggtattctttttatgtttcttatgaaatattcttgcctcataaatagctttctgttttctaaaactggatcgctgctaatgaacactgttttcttttaaattgtgaaattttcttcgtagcttttcctagtcggttttcatgacatcatggggaaatacttcccactggttcatttacatggagggagattgtcagaatttccttgataaaatgtttatgggtttaagaggtttatgaatcagctataaatatttgctctgggtttatgagacctctccccataaacattttgtgtgtttttctattgctcattgaaatgtctttggagaatcagctccttggggcacataggcctggggaagggttgtacgtgacccattttaaaaggctgtattgtgaataaccgtaaattttgtgcttgactttgttataacgcacagttcaagtcatcagtgctgggcatgaaggtttgagtttttttaaatcccattctaggtctgacttttggttacctttttaagtgttttctttagaccagcagagagggacagagcttagtgttctactgattcctgcaggggagacacagtggcaccctctgacctcctggttaacttgactgaatgaaaccatgtgcactgaagtctgtagaaccctgtatattgggaaatgtagttgtaatgaattaaaatttgacagaaacaaaacttttggtaaaattctaatagtatagattagaattgtatggagaataaagaactgcaaccagcggtctcagtgttgaggctgaaaattggaggctctggtctcccctgatctgaagtgatagaatcatcgaatctttgtgggtaatgggatgggtcactaaagcctctcatcccaggtgctggtgactgcaggcagtttctgaggttccgcctcaatgtgcgtgtttccttttttttgttttgttttgttgagatggagtctcgctctgtgacccagtctagagtgtagtggcaccatctcagctcactgcagcctccacatcctgggttcaagtgattctcctgccccagcctcctgagtaactgagattataggtgcatgccaccacccctggctaattggtgtatttttagtagagatgggtttcaccatgttcaccaggctggtcttgaactcttgacctcaagtgatccaccttccttgccctcccaaagtgctgggattacaggatgagccactgcgcccagcctcgatttgcatgtttgtgatttgcaggaaggagtcacccaggacaacttgtcccgtttttcagcagctatcattctcggagtcctacgtagaaccttgtgcctccttcggcccaggactgagtttcatgccgatgtcttcttcccaggtgctcttcttcttcctcacacrcaggttctgggagctcagtccactcttctcctcttcgcaggtggccacggcttcctgtgtcttcccttttcctgcttttttggctgtagactgtttcagggttcaccaacatggagagacagactcatcactttgaaacctcyctaggattctgcaggagacacgggtggtggcagtggtggtttctggtgcatgatacaggtgggagaaggagggggaaagtacttcataagagctccagctttggactcctgaccctgatgctggacaacagtggctcagggtgattccctgtcctttctgagctctcaagattgcccctgtgagtatacatccatcatcgttcttgggaggattgtgaggcaatacctgtaaaccactgtttcattctgtttcgtrttcctataacagaatacccgagtctgcataatttataaagaaaaggtttattcaactcctgattctggtggctgcgaagtctatgacgggcagctgcatctggtgagggcctcaggctgttcccgctcttggcagaaagaggaaggggagcaggtgtgtgcagagagatcacatggaaagaggaagcaagagagtaaccagggtcttaacaacccactctcgagggaagtcatccattccttcaagagccagaactcacccctgagggaggacattaatctagtcatgagggatctgcccccatgacccagatagcccctgctagacctcagctcccagcactgccacattgggaatcagattgcaacatgacttttggtggggacagacgacattcaaatcatagcaagccttgtagcacagaagtgacactcgaacacagcagagctcttaggatgtgcctgggagggcggtggctgctttgtagagctggaagttactgacacaggctagggcaggcagggggctgcaggagggtctggttcaagctgaggccagacaaggaggatggaaagaagctctggactttgtctgcagcaagtttgctatccttagatactgcatcaggacgttggggcagagcaatagtgctgagctgacgcctctgactagtgcatcggaaagcaaatttggtaagaggtgcccagtgccgttgggaggcaggggactgtcaacagagccatcaggtaccaccctgaggtgttttccaggagacggctgctttctctctagttcacttcgctgtgtctgtgacgctctaaacttcttggtgtcatccattcttcactggaggctgcaggacctgttgacttattttctcaggaagtgcatttctgtttgaagggcgtcaatccctgggtgggaccgaatgttagagcaccaccaaggaaaggttttctctcctgatagctttttctttttcttttttggatgtttgactgtaagtcactttattgaagcaaaagttgaggaggccattctaagcaacttgggcttagaaggcaaaatttaaaatagcctttcaattcagctcttctgactttacaaaaatgatcctcttccctcaatttctgagagtacacaaagtattaagagagacttacttttcctacttataattcaaaaatttcaagaaggccgggcgtggcggctcacgcctgtaatcccagcactttgggaggctgaggagggagggtcacctgaggtcgggaattcgagaccagtctgcccaacatggcgaaaccccatctctactaaaattagctgggcgtggtggtgcaagcctgtaatcccagctactcaggaggctgaggcaggagaatcacttgaacctggggggtggaggttgtagtgagctgagatcgcgccactgcactccagcctggatgacagagcaagactccatctcaaaaaaaaaaaaaaaaaaaaaaaattacaggtrgacaaaaagtagtgatagtctccagaagaaggcattcttatttggccccatgtcccctggcctatctgataggatcggatatcagttctctaccagccacaagatggaaagcagtatttactcttggccagtgacacaggctcttgtttctagaagataaatgggttgagcatcagcatccattggacattattgcaggaagatcatctaaacttttggaactctcgtgtgcattttggacagctctttctgttgtatgttcttatcatggccttgccaattggttcaaataatgtttacagcttattatttccatttaaaatgatgccatcacatttatgccgtgtatatgttaaaatgcattatttgatgctttttggctatacaagttttatcgtatatgtagccttaaatgtttggggaattgcttgatttccttcaagcctgggtgtgtggatttgtgaaattcaaatagttatgattctggccgggcatggtggctcatgtctgtaatcctagcactttgggaggctgaggcaggtggatcacctgaggttcagagttcgacaccagcctggccaacgtgtagtgaaactctgtctctactaaaaaatacaaaaatttgttgggcgtggtgatgcacgcctttagtcccagctacttaggaagctgaggcaggagaattgcttgaacccaggaggtggaggttgtagtgagccgagattgcaccactgcactccagcctgggtgacagagcaagactctgtctctcaaaaaaacaaaacaaaaaacaaaatacccccctacaaatagttacgattttaagagccatgttgtgcatttgattgtatttctctttattccttgtggttggagaaacacatgcactgttggtttctgccggagtgtcgggccccaacagctgtgtcccggcagtaggtaagagttgggagccttggactggccaggcatcgggagtgtcaggcagctggtcggtttgtgttgttgactggctgggtggccccacacactcgagcaattctttggggcctcattttctctttttccccttaaaatgatgccagagtcagtgctttatctttataacaattagtgctgttctctgtatacatcacagcctacatcacagcccttgctcagcgcacgatgggttccttcgccttgtcctccagcctccctgcaggctgggatgtctactgcagctaatttcaaactattacacgaacatgtagcaaatatgcgttggaacatgtctcatgttatttaccccagagaacccagtgttactcttgatttcatcagtgcagtcaaagyggaatgtcccatgttttcctttctttagtcaacacttctaaaatcagcagactgaagctttgcaaaaaattcagcaatatccttctgaactgtggaattagcttgtgtcttgtatgaaggattttctggtctcagttgcaggccagcacctttctgtcctccactccagtattgatattctgttcttttgtttttcaacagaagaaggctcaagcttggaggaaactggctttaactggggagaatatttggaagagacaggagcaagtgctgctccccacacatcattcaaacacgtatgtaaagcagcttgtgtcttctctgtgtctagaaagtgggaagggaaggaatctatagggagaagccggagaactcaatggaagaagggcagaggaaagagggaaattcgtggccaggcatggtggctcacacctgtaatcccagcactttgggaggctgaggctgagactggcaaatcacttgaattgaggagttcaagaccagcctgggaaacatggctaaatcccatccctacaaaaaatataaaaattagctgggtgtggtggtgcacgcctgtagtcccagctacttggggggccgaggtggggagggtcacttgagcccaggaggtggagattgcagtgagccaagattgcgccactgcaccccagcctgggtgatagagtgaaaccctgtctcaaacaaaaaggcaagatggaaattcagccaagatttcttaggaagaaggaggagacctggaagttagcttggtttccctggatagctacagggaatatagaccacaggtagggtcagcttgagtaagtaaagagctggaaaactaaaccagtaggtgtaatgtattcttagtaggtgtaatggctgtatgttttcagtttcaattaatattttgattttgaaaaagctcataaaagatttccagccatttattggcagatgagtcagattagaggaactaaccataaatatgatgaaaacatttggatccaaccaaaaaaaccactctcatcaataatgtttctttggataatgcaaatagcatgtccagcactgggcaagtcccagaaaatttttaaaaagtcagtttttatcaggttttcgctttggtgtaagatactggtaatgtataatatcattagcagggaaaagtctaactcacctgggttctaagaagttgggtcctggaaatttagtctttaatttttgttttaatagaaatagaaatggagatttaactctgagaaacatttttcactttgtccatgcagggcaaagattcagcctgagtttcatcagtaaatcggggcactttcttaacctgttcttccttttggctccttggctgaatgaagaagccagaactttgattccttatttttatttatttattttctgttagccaagtctcgccatgttgcctgagttggcctcgaactccaggctcaagctatcctcctacttcagcctctcgagtagctgagattacaggcatgcatcaccatgcccgatttgattccttattttaatacaacattttattctttttagaggtgaagtgttctttccaaaaggaatttaagatttttattaaatttctgtgaccctgaaaaggtagatcatgtttccatttctctttatactcatcatgctatatttactagtttattatgaacgtgattgtggctgtttagtaaaaccaagagctaaatattaaaacatagcaaagctttcaagcatatgatgtggttatggtcccgcaaaagccattgtaacatttatatcttaagatgctgagatgatttggcagttgccttaggcagtttaggaaagagacattgatcacaatttttccttcctttctgtactgagaagttatcaatttctctctgtatggagtcactcctatttyctttgattcagtcaatcctcccacctcccttttaatcacaatatagtgtcctgggggccagagctggaggctgtccttcaggctgcagaagtccccaggtccgtatgccaggtttaaaggaaaagtagcctcagacccatgcaagtgtgattgataagtctgtcatctcctttcagcagtggccacttgcggacagcggatatgtcagctttgcaatgttaagacccaccaggctggaaagctttttctggggttgagggctggtagatatcaacagactatcacccttaattaaaaaacaactccattttctagggccatgttgttcatggaatagcccctatcatgtggtcctgtgagtccttgaaaaccgtgtagtccacattcagatgtgctctgagtgtagaatacacaccaggttttagaggctttattcaaaaagaagacagttggttgtttcattaatgttttttatattgattacatgttgaggtgataatgttttggatatattgggttaaaatatattgttagaattaaatttattcttttttgttcttaacgtggctggctgcaaatgtaaagtttagcattacgtttgtggcttccatagygtattacttagataaatacatgcctgttttagagcaacaggaatattgtttgtaagtgccatattttttagtggtttttgtcatcttctggatgtattgtgtctagtgtagtaatgggttttctctatttctgattccttaaggttgaaatcagcattcagagcaacttccagccaggaatgaaattggaagtggctaataagaacaacccggacacgtactgggtggccacgatcattaccacgtgcgggcagctgctgcttctgcgctactgcggttacggggaggaccgcagggccgacttctggtgtgacgtagtcatcgcggatttgcaccccgtggggtggtgcacacagaacaacaaggtgttgatgccgccggacggtgagcccctgtttcaaaggcttcgatttacgagccgccatccttcatgacgcctgtaattttgcaaggagcagagagaaccttgcgtagaatccctaatggtcttagtgcaaaggtctcacagttctttcagagtggtttctcaggtttccttagctggagggagatcagtgcattttcagatgtcagagctggtgctgacaatggagccaaacttggcttttcggaactgaaagtatgcctaatccttaaattccttttggagggtaagaaaggaaggctgaaaggacatcaggaattggagggtaagaaaggaaggctgaaaggacatcaggagttgagggtaagaaaggaaggctgaaaggacatcaggagttgaggtcttgtgtttggtgattggccatgttgcttttcttctgctttagcaagtcgacatttgaacagtaacagagtgtcttaagcaggcttctctaataacttttcatctgtcttgttgggagactgtcagggtgtcaagcttttagaaaaccatacagcacttgtgccctaaaacttaaggtataattaaaaaaaaaaaaagaaagaaagaaaaccatacagatgagagaaatgacattggtctcaagggagtggtcaaagcccatatagatatgatcaatttagttgctacaaagccactattctctccgggggcagttttaccccccaggggacacctggcaatatctggaggcatttttggtcagggccatgggagttgctactaccatttagtgggtggaggccagcgatgatgctaaacccccgcaatgcacaggacagccccataaccaataattaccaggctcagcctgccagcagtgctgagggggagaaagcctgctggaaaagaatgggctggacatgataaatgcattgaaggaattcatctgatcccctaagtgagaaaactgagggcagctaattacgtgaatctctacaccccactctctatgttttattgtatgataatggcagcagcgatacttgcaggctcttgatgccaccttgcaaatgtgtgtggtgtcctcttcgtagctagctgcctgttttcatcttgaagtgacgtataaacttggagaggtgaaatccccaggttcattctgtttgtggtattagcagttgccttacttagcctttcacggtatcggagctctatctttttttttttttttttgttatgatatattgtttttctgataatttggaatagcctgtggttttttaattaccctttgttaggtgtaattgatagcctgctaagaagggggtcataaaatggctggagttaagagttgcatttatgtgacatttgtcaggatcgaacccattgccatggcgttagctgacattttgaccctttattgtctccaaagaaagagaaaaagggtcttctttctttctttcctgcattgggtctttgcacccgctctttcctatgctgagaacctccttcctttccgcatcctcctcctgctccagctgtcagcatagctccctcttccacctgcaccaaggttgacactgtctgtgctcatrggccaggtcacaccctatctgcaccacgtggctgcctgcgccttcagtgttcatcacggttgcagttgtactattcttttcttttcttttttaagatctaattgacgtgccataaaactcaccactttaaagtgtacagttcagtgattttttagtatattcacaaggttgtgcaaccattattactataattccagaacatttcttttatcacctccaaagtcactccccattctccccctccccggaaaacccttggcaaacactaatgcactttctgtttctgtagattttcctattctgggcattttacatgcatggaatcctatgctgtgtggccttttgtgtttggtttattctcttaagcatagtgtcctcagggctcatccccatggtagcttgtgtcagaatttctttcctttttaaggctgaatcatattctctggcatggactgatcatattttgttctcccttcatcagtgggtggacatttagaggcagctgttcttccacttgggtggttctttgaatggagtacactttatccccccagacagtaagctgcatggtgtgaacccactcgtctgtgtacaccagctctagcacgtgctgcctgtgcttgaggaattctcagtaaagattcactgagtaatcgagtgatttactgaagaaggtaaaagtgcggcttacatggtcrtctgaaatagcaaggaaaagaacagtcattgttacgaaaggaggaagcacgtgcgctctccttcacctttcctccttgagctgccagtagtgctgtgtgcaccttctctctggacatgcgagcctggatttccagcctctctattcaggtgagtgctggagaatggctgttcttaagtcaggttttatttttagttcccgctccagctctgtgtacgcaaatcgcagggtcaggaggcacaccctgggaggcacagtgcatgctcatgcttttggtaacatctgattcactcagccccagacccagcctaaacaggtcctgagggagattgttagatctgcctttgaattaaaacctccactgaggtgagaagctgtggtgtaacgtttgattaatttacctatgatttctgatccgtcgtgaagtaaatcagccttgatggaggaattgtactgatggaatattgaggaaatgccaggtctagttagagatttagagaccttcccccatccccaactctgcacgcaggtgccacacatttgtgccccctcacactcaggggagttgcgttcatgccgggggccgtgtacacacttgggggcatcaagagaagggcacacagagggggcacatagagtgggtgggagcctcaggccccatccttgttgccgacggttttaccatcacattcatgactcactcttcaagtttaacacttgaatcttgaaagscccttggaaaggatgtaagatggtttcattttgtaatagcttctctagtgaatagttttagagacaagttctggggtcttgaatctgaatactctaagagctaatgggttcatttggtaaaaatgtatgctgttgcttgagaaagagggcagagtttattaatcaattcttccttctccctcagaagacaaatgtggcagcagtcacacacactctcagaaacaccatcaaatttgtatcctactgactttgccacagtcacacttaaaatgacaagttcaaaaagaaaaatgagaacaccctggaaaaagggaaaccataaatgtgatggaaatacttaaagtcttttcaattgttaacaacttatgctaatttgaggaattcttcagtgatattttttaaagaactcaaaaacatttagtgggtaatcagtatgacttggaaatctttaatatggagagcagagtcaggaaatagcaggttcatggggcaagaagttttattgatcgctgtaggacagaataattattgctttgtagccagaggcggcagttgttccggagggaacagtagaatctattttttaaacaaggattcttatttgtgtgtttttttttctgtcttagagacctgatatcattgtaaattctgcaaccatacctggtcgatctttgctgtggttaaacttgaaaggcaccgcagaatatgaacaggagttacagcgatccagggtgtatgatgtttctgtttgggaggcttcttggtgagacggagattttcttactgattccaggagtcagagtggtataaagggaggggcctgtggctgcagcccaagatctgagttcttatcttgcctttgctattaacttagctccatgggtgagtccccttcttggggttctcatctttgcatgaggggggtattagtctgttctcacactgctaataaagacatacctgagactggtaatttataaagaaaaagaggtttaggcagggtgtggtggctcacgcctgtaatcacagcactttgggaggccgatgcgggcggatcacgaggtcaggcgttcgagacaagcctggccaacatggtgaaactccgtctctactaaaaatacaaaattagctgggcgtggtggcgcatgcctgtaatcccagctactcggcaggctgaggcaggagaattgtttgaacccgggaggcaaaggttgccgtgagccgagatcgcgccactgcactccagcctgggcaacagggcgagactccatctaaaaaaaaaaaaagaggaggtttaatggagtcacagttccacatggctggggaggcctcacagtcatggtagaaggcaaattagaaatgaggagcaaaggcacgtcttacatggtggcaggcaagagagcctgtgcaggggaatttccctttataaaaccatcagatctcttgagacttactatcctgagaatagcgtgggaaaaacccgccccatgattctgttaccacccactgggtccctcccacaacatgtggggaattatgggagctacaaatcaagatgagatttgggaggggacactgccaaaccatatcaagggggttgtggtatagaatctctaaagagctttctagtctgaaatgtctaggtttgtgacccttgtgaaggaagaaaggaaggagggtttgggtgctagttttcctatataatgcacgaggaatggagtttagtttggagttaagatccatggacgtctagcccaggaatctgtccaaagcacagacatcaagtttgtgaattactgttggaggtgatgacagtttaacagattgtgagacactgtcattaggtcagcaagttacggtgtatgcctgggtagaattttcccccataaagaattgtagaccccagttccccattggaaccagagaactgagagtttttagcccttagctgagtaatcagcggaagctgagtcaagtcagttggttgtggataacagcctgggaatgtttgggaattttgcccttgtttcatgggggaagggagagaatgcctttccttgtcagatggaggttgcagagctccagatcttcgaggacactttgggattgtccaaagtagttttctagtaactggagtcactgcattgaaagaaagtggttttattatcttagatgatagttttacagagcacttaggaccctgtgcagtcccatgttttcttgcatggctcttttaaattaatgtaagctgtgaattaatgcaagccatcattagtctgtgaaatggtacaaggaaggagaaacagcatggcggcagctccaggagatgtcatcactaggggattcccatcagcaggcagagctccattaataaagacgcatttagagacctgggctctgtgaccaatcggccgttcagagcagcgttcctgcttgtgagctaatcagggctaatctttcatattaaaagtattaaggaacatatgacattaaagcgtcacccagtgccgcggaggattatggctcttattagtggagcaaaatgtaaaacgttttggtttagtaaatcyataaggcttgatttattcataagcgcatgcaatgcttgcaaggggcagctgccaaataattattgtttatggtgagaatgtatggaaatcatttaatccagtgacgacttcattgttatttattgaaaagcagtgacattacctcttaatgtctggggctggggagctttggagatttagtcggtgcctgcygagcccccaaaaagatgctcgtggaagattgcaggtaagtatgtgtgatgatgtggctccaaataacaccccttggcttgtaaatggagacgtatttatgagtgctttctactgttgccataaaagtgttggaattatagtgccttaggagtcatgctgctaatttttattttccccgttattaaaatttctgtcatttgaattgcgtactctgcagtcttggcagaattactcaatttaccattcaaagttaaatcaaaattagtggagttagttaatatacaactcatttgaataaaggaatgtttattcatgaagtgtgaggagaaagtgtgaagatggccttatgtttatgtgggcagctcctgccaagttttaaagcctggttttaggaacgtttttgggaattgccatttttactgtagttgattgtagaggacaagatgctggcaggtggcacatgggacaggaaagtgactagacaagcaggacttacccagctgtgacatggctcaactgtggactccaaaaagtagaattaggttgtgtttttatgagactgaccctttttaaaatttatattttataatgtaaatgacatttcagtaatattaagggaacttaaacaatcacattattttctttggttatctgacattgtaactggagttccatttgtttatcaataagaaaatttagtatatatgctaaaaactcataatgaatcctaactgggcacccaggcttgagggaagcagagagacactcattaaatattagatagcttagtaataagagagcagaacacattggtataagaaagggtaggattatttgacaagtatgtctgtaaataaaccaaaagtcatagttagatattttattaaaaaatgtttaaatattctaaaagttttaaataaatattttaaaaagtgagttagtattgtattgtcaaaaagccatttttgatgatggtgtgtgaaagagggaacattcaggtaggaaacaaagtaaccctttctcaataggcactgaatggaccttttacaacaattcccatggttttgaattctatctgatcaagtagagagtctgtgtacacattcatcatggtgtagaccaggatgggcttggcttgtagatgtgtgtgacagagagagtaggtatgtatgtgtttgtaacttttggtgtaaacagtatttaattttaatatctatcatttacacatcacatcataaaagagtcctgctgtgaatcaaaasccttcatataggtaatggcaaataactctttgtttatgagtaaaaaatgaatagtttttttttccccccagaaatccgtgtttggtgtttgtatttgtttttcactactcacaatatgccacacactctcttttttatttttatttttttgagacagggtctcattctgtcttccagtctggaatgtagtggcgtaattttggctcactgcaacctctgcctcccggggtcaagctatccttctacctcagcctcatgagtagctggaactacaggcacgcaccaccatgcctagctaattttgtattttcgtagagatgggggtcttcctgtgttgcccaggctagtctcgaattcctgagctcaaatgatctttccaccttggcctcccagagtgctggggttacaggcgtgagccagtgtgcctggccccacacactctctttggtcatcttgaacagtgaatgaatgaatcacgaatttcattctgtttgtgtcatagctctccaattagaagatacttttgtgtgcacctcctgtggtaccaggtaacgacgtttaatcctgtcaatcctcagaacatccttttgaagtggctggtattattcttatttcatagttgaagaaagtgtgtttgttcccagatcaggcagtttgaagtagattttaagctaagaggattctggccagttctgaaatcratgctttgaaaatagcaggaggtctgtaaatatttgtttattgattagattatatcattaagactttagattaaaatggtcagactgaatatcactgagaaaagttgtagagttggtttcttggtgatttttaagagtagggtagaaagctgctgtccagaatattttccaatttgtcttttttggcggcaaataagtggaagagatgtggtctggaagttctttgccgaatggtaaccatgagattatgtaaagttatgtaaattgcatcagatgctatttgggtttttctgcgctacatgaaaaccgtaagcatgaagcagtgactagaaggttttcctttttagtgctagtcataaatgaatttattttctcctgcttctcaacccagcaacatatgtaatttaagtcaagcatgtgtttgattctgagtggaattcgaggggggagttggtgctgtgtgtttccatggcctcgtggctcatttttgcttccgtgttaactccttcacttccataattgtcagagcctccaactcatctggcctctccctcccttggtgccccacctccccttgtaaggatcctggccctggcctgctccagatgcagctcagatgatcacggcctcgggtgcatggagggctcagctcccatctggccccgttcctgctctgggtggacctttgaacgtcctgaatgatccttgggtttcacttgtatgggaagccccgtggcagctttacacagacaaggcccccgggcacagctcggcctgcaggatgtctggctgctccaggcttgaccctgcctcgttgacctccctttattccccctccacctccacctgttcactcttcttcgtgccactgaccgtcctctagtttgttggactggggagcttctcccactgtgctcgcagctctggcctcctatccaagcctctgactcccctgctgcttcttattaagtcttctctcatggctccatatttcagggcatacctccattctagggccatgcagatgttctagggacatgctgatgtcccaggggtatgcagatgttctagggccatgcctccattgcagggccaccatgcctccattccagggccaccatgcctccattccagggccatgcagatgttctagggccatgctgatgtctcagggccatgcagatgttcaagagccatgccttcattccagagccaccatgcctccattccagggccaagtagatgttctagcgccatgctgatgtcccagggccaygctgatgttctagagccgtgcctccattccagggccatgcagatgttctagggccatgcagatgttctagaaccatgcctcccttccatggccatacagatgttctcgggccatgcctctgttccagggccatgcaggtgttctagggccatgccggtgttctagggcaatgcctccattccagggccatgcagatgttctagggccatgcagatgttctagggccatgttgatgtcacagggccatgcagatgttctagggccatgcagatgttctagggccatgttgatgtcacagggccatgcagatgttctagggccatgcagatgttccatggccatgcagatgttctagggccatgttgatgtcacagggccatgcaggtgttctagggccatgcaggtgttctagggcagtgcctccattccagggccatgcagatgttctagggccatgttgaggtcacagggccatgcagatgttccagggccatgttgatgtcacagggccatgcagatgttctagggccatggtgatgtcacagggccatgcagatgttctaggcccatgcagatgttctagggccatgttgatgtcactgggccatgcagatgttctagggccatgttgatgtcacagggccatgcaggtgttctagagccatgcctccattcattccggggccatgctgatgtcccagggccatgctgggttccactgggtttcactccagggctgtgccaacattccagagccataccaacggtcgtgcctccaactcgagtccttaggttctgccggtcattagggagagtctgcctttttgagcctggctctcagggaatggttggtttgtgcaaagcttgtctcctgagtctagaatcatgttaaagcttggtgagtacgaccttcagttcaaagtcttgggaacttagatggttcccaaggattattcagaggttaatttggaattgttttagtcagggttttccagagaaatagacctgatagggtcagtacatacatagcaagaaattttatgtttaggaacatgtgattgtggatgaccagtgagcccaaaatctgatggggaagatctgtaggctggaaacttaggaaagagctgcagtttgagtctgaagcagggggagccagtgttgcagatgaagtccgaaggctgcctgctggagaatcccctcgggctttggggaggtcagcytttcaatctatttgggccttcgactgatttgatgaggcccacccacaagcaagaggatgatctgctggtcagtgtgtacttatttaaatgttagtcgcatccaacaacaccttcacagaaccacccagagtaatgtgtgaccagatgtcttgtctgggcaccgtggcccagccaagttgatgcataaaattaaccctgccaggcgtggattcagagctagagctgaatcgcccacttgctctcccctggcgtcatcttaatgccttctggagaggcagaacattttrtgtacacttggaatcactgtgctactttgccctaacagacaatgttcagttgatatttctgaatatagatgcccttaacagaaagctctggtaggaattcgagagattgcgaagtaaatgcatggattatctttaatgctgtgaaagtataaatgtcagagtggcaggtcagagagtctcttgaaaaccaatacgaagtgggtaggaagaagaggcagagacatttcacccactttttaggctcactgcctgctgctcagcagggccaccatgatttatctgaattctgtgtcaatttccataactgcatatcactctacaggtacccactgggattacttacaagggattttgctaatgaggatgtacttccgggtacagggttctgtggcatgcatttaaaaaggcagtagctggctgggcgccgtggctcacacctgtaatgtaattccagcactttgggaagccaaggagggaggatcacttgaggccaggagtttaagaccagcctggccaacatggtgaaatgctgtctctattaaaaatacaaaaattagccaggcgtggtggcacatgcctgtaatccctactygggaggctgaggcaggagagttgcttgaacccgggaggcggaggttgcagtgagccaagatcatgccactgcactccatcctgggtgagggagcgagactccatctcaaacaaaacaaaacaaaacaaaacaacaacaacaacaaaacgcagtagctagtgtgccttcatcatgggttgccttgaactcctttgaaatcctgcatcttaatcactatatggcctgtcctcaaccccaggaaaaaaacgaacacatgagcagcctttgaggttagcattacacttccacgaggatgagaggggcctccagcctggggtgtgccttttagagaacgcagagaatcacatgcacagacaaccatgtgtattcaagagtacggagatgcctctccctcggatcctgttttcaggactggtctccagcaccctgtacctacacatcaggctcaaatggagaaattctctgcatctcttgtgcccttgggaaaaaagacctgtgtccgaatgctgtgattttgtgagttgtggtgttgccactgtcagagtaagagataaattaatggtcaaattacttctttcagaaagcacaaatataataaattttttacagagtgaagaatcactttgcaatagttctgagcagtttctattctggaagaaattagtacagaatttccaacagttgtatacattgactggggcttcattatttatttatttatttatttttgagacagagttgcaccttgtcgcccaggctggagagcagtggctctatctcggcttactgcagcctctgcctcctgggttcaagcagttctctgcctcagccttctgaataactgggattacaggcgcccgccaccamgcccagctaatttttttgtatttttaatagagaaggggtttcactatcttagccaggctggtcttgaactcctgatcttgtgatccagccgcctcggcctcccaaagggctggggttacagacatgaacaaaattaactttgttttacaaaatgaaaatgaaatattttaccatacaaattcacactgttctcacatatgggaatctggaaccctagacgtgacatggatgaagccgatgttgactttttacattggcaactgagtgaatgttgaatgctagaactgtggatagttttatttctttataaacatgcttaatgagattcagtgctgaaaaaatagataaaatatttaattttattttaatattttaaattaaaatgtttgatattcactaattttaatttgcatttccctattaattttagtagacactttagaaagagtaggaggacatttggaatcgtaggacacttagaaggaaaatagcatttttgaacaaaatgattaaaaaatttgaatttagcattttcttcagtttacgtattttgatgaaaagaattaagatgaagtagactgggtatagtgatattttatcttttaatctgttaggtgatttctgtgactagaacataaattatgtgaaaatctagatttttaactaaatagttaattttgctgaaaggaaggccaaatagataaagataaaatcatttatgacttacgtctttatctgattactcatccaaacattgctggcccatcagcagaacacccagactcatgttctcataattgaatttagtcatctctggcttttggccaactttctgtcttctgtgctctagtgcttttccagactttttgattgacattatgaagatatatttgtcagtgaaggaggacagggcatactttacttaaaagcctgtttgcttgattaataacttgtaaatcttaaacatgtgctacgtgagctacatttgtatttgcacttggtgtgtctgggcctgttttagggttcagatasagcccctgtgaactagaagtctttctaaggatgatttgggcacgcgtggatttagggagccagtttctacatccaccaggcctgtctcttccatgagactgatctgcctgagaatagaccagtgccgtcctttcccacctgtcccgtcttctctcccactctttcctctcctacgttggttgagaaggatgtcaccaactgaggtatcgagatctcatgcccactatgccagccgtgacatgcagacacaccagtttatctttttatgtttactcatgacactgccacgttattcgtgttattttgatcaagactaatgacaattttaatcatctaagccaaaagaaaatttttctcttatggtcaaagaaattttttaaaaagttgaattatatactgcctactttttgttgttgttgcagagaaattggataggataaacaatacgagactgttgggataagagtctggggcatataggctgctgttaaagtagtacttatgtatatttttatttatttatttttttgttttatttatatttttttttttttggagagggagtctcgctctgtcacccaggctggagtgcagtagcgtgatctcggctcactgcaacctccaactcccgggttcgagcgattctcctgcctcagcctcccaagtagctgagattacacgcacgcaccaccacacccagctaattttttgtatatttagtagagaaagggtttcactatgttgcacaggctggtctcgaactsctgacctcaggtgatccgcctacctcggcctcccaaagtgctgggattataggcatgagccactgtgcctggcctattatgtataattttaaatgtaggatggaaggtatcagatcatttactgaatatatttatgggagtaatataggagttttattccaaatgtcagagttgcagtacacaggaaattacatcctttgtgatgattgaaatgaatgaaacatttctcaacgccaaattgaaaatgcatgatgggaggacatgagttcttcaagattcttgtatggggggtatatgaacaagaaagcttgaggaccagttttcacaaatggtactcaaccatagcccttctcatttacccattaagatgtttttttttttttttctttatgatttagatgcttagatgttcttagggctttggaaggatttatcataattgagcatttgctgagtttctgtttccgtcattggattcctttggtaatatatttgcaagtctttctctgagttctttgctaataggaaaacaagagctgacaggaagatcttgggtggatgggtaaaaatggctactggctgttgatttggtccactgtatcaccacattactgttgacatagtaatggaaacactttaatatcaatcagtgcatattggggttctattctgtgcctggtgttttttgggtgggaatatatgatacggttgttattaagcattttatattgaagcacactggtaatatagtcaacttttggccaatagtgtgtactcagtgatgaactcaattttggcaaagggtgtcttctgtggtggcccccagtgtacttattttatttatttatttatttatttttatttattttgagatggagtctcactgtgtcacccaggctggagtgtagtggcacgatctcggctcactgcaagccccacctcctgggttcacaccattctcctgcctcacctcccgagtagctggaactacaggtgcccaccatcacgcctggctaatttttagtatttttagtagagacagggtttcaccatgttagccaggatagtcttgatctcctgaccttgtgatctgcctgccccggcctcccaaagtgctgggattacaggcgtgagccaccacgcccggccccagtgtacttatttatttgttggccatttctgccctgctgttgactgtttcactccttggcttagcaagaggtgttgggagctgatttgaaactctaatctctggaggcatggggaatatgactcctctattctgggtggggacttctctgagatagcatttcttttcttttgagtttaaaaatgtgtctgtctaagcctgggcaacatagcaagacaccatttctaagaaaaaaaaaattaaccaggtgtggtggtgcatgcctgtagtcccagctactcaggaggctgaagcaggaggactgcttgagctcaggaggtcgaggctgcagtgagctgtgattgcaccactgtactcccacctgggtgacagagtgagaccctgtctcaaaatatctttatgctatacatttttagaggtctgttcaacagctatggaaacttccaagagccaggcactgacctgaccctggcacctggagcgtcccttctgggagaatccgcctgtggatgaatagaaaggcccctgctctctgctggtattgaaataaaacactggcatctctggaactgagttatgtctagtaagtggctcctccgaccagtatacggggtgggaagtgttggtgtgagtcacctggcctgagctagggcctcaggcctgcctagcactgaaaggagcccagaaaaaagcgacttcagaaaaaagcgacttcatctgcttgcatcacactgtcctcatcttcaccgtgacaaactgacacaatcttgctctcggtttgatggcaaacgctctctgtaacctgtcatgtggaaagttccctcctcatcagatatatatatatatatttttttttttacaggtaagaggctttaataggccttgacaaagggccgtatgagtggagaagtatctgcgccctaatagcagggcacttgaaatacagccacacgggtacagtgtctttcccttagccagtagctcctcactcggccacgtccactgtccagaatactgtcgaagagttgcctttttaccccctgtgagctcagagaattttgatcatacttgcctgtgctatataattgtttatgtataactgatctcagccatttgcttatgaaagtaaggctgcgtgaatgttttgttttcagaaatacacattttggatcctaatgccaccacttaattaaacgtgcgaacctgggctaggtattttctctctcaactttgtgacctgcagtattcccatatgtaaactggagataatgagacctgccttacaggatcgttttgtgcattaaatgggatttgtgtaaactccttagagcagtgctaagaatgaaggtggtaatgagaaatgcagtttttatccatcctcattcttctggttaaggatggtattttattcaccttttgatttcttataatgccttgcacatagttaaagctcagcagttgttaaatgaataaggaacaaagcccccatgaaaaaacaacaacacacaaaactaattagtactagtgtatgtgtgttattcactggagagccttttcaaatcctaccacattcagagacaacaatcacattacttgattttgaagcccagcacatgttggaagcagaaaattagaagcatgagaagacagctgttagtcatgcatattgatatcacaaataaatcctagtgggccacccaattgcaaggaaggaggtagaggagctgggaaaagtggtatcaacagtagagcaatctaatgccttttaccagaggagcggatagccccatccacagatccagagggtgtgtggctactaccaagggaattgccagccattgcatagtaaagcagmataattgatttatggcactcaatcctccaaaaagttgtaaatttctttggtgtctaccaagtaggtggcaacagcaaaggctaacctcagggggatttgcacaggaggaaaaacaagattgtaaaaacctgctgttctaggagttgaaatgtattattattatggctatggtagaactcttctcttctttgtcatgcagacttaaagtataaarcagtctttattccagcttgttaaaagtgggaatgccgtaaaccaacacagtgagcctggagcaatgacaagctacacaaaaattaaacatatttgtatttcaagatgtagcgagctgtcgtggccagttcatggccactttgggaagacatttattaggaggaagcaagatggcactaaagcgtgggagaggacagaagctggagccgtcatgggtgcagaataaggctggcccggaagagtggctgggtggggtcacacctggtagttcagatatcttttgctatcgattttctaattttctaagatgaagtgttaatgtcccagcgtgtggatggtgcctccggatggacaattcaggttgcatgccccagacctcgtgattgggactggccagaacagacaagaccccatcagcaggatggacaagaccccatcagcgggatggaccccatggaaaaaaaaaaaatctaggaactaagacacgattgggcaggaggctgggaaacttactaggaaggatcaaggttgactttgccaccatgacctagccacgaacacgatgggaagaaggctgtggagtggggctgtgggcagygcctcccggggccctgaatgaagcaagcttggagagggagctggtgtgtgggtctgagtggcttctttaatgtcagcatgcgcctatgaggtgctgacgtagccttattgcctctttgagagttggcttcccatagggacatcctagacactggaagatttttgcatcggcatcttcagtccatcaaatactgtccttgaaatcccastgtcctcagttggtgatggacaggggacagacatttgtggtctcatgctgagggtcttaggaaggcaagaggtggataaaagagtcagggattgagggccgggcacggtggctcacacctgtaatcccagcactttgggaggccgagacaggcagatcaccctaggtcaggagtttgagaccagcctgcccaatatggcaaaaccccgtctccattaaaaatacaaaaaattagctgggtgtggtggcgggcacctgtaatcctagctagtcgagaggctgaggcaggagaattgcatgaacctgggaggtggaggttgcagtgaactgagatcatgccactgcactccagcctgggagacaagagcaaaactccgtctcccccccgcaaaaaaaaaaaaaaaaaaaaaaaraaaagaaaagaaaagaaaaaagagtcagggcttgaaagtgagaggatccaaactgcatcctgtcctgcccacagggtgttctgtccaccttaagtttgacatggtggttctgaaccaagcctgagactgtgttgggatgaaattcctgggggctgtagagttgggcagtctgtgctgagcattccatcacacgtgccattccacaccatttggagatcgagcagaacaggtttgattgatgccgggtcattttgttttagatcattttcacatttatgatctctgggattayggaagaggtctgtgattcttgtgatttcaagagaggggatttaaaaatggatagggaggtttgtcacagattcatgagacctgggagtgagaaggaaagcggagtcagagaggtggagaatgggtgggtgaccatccttgacctgggatctctgtgaccaggactctctccatttctcatccaaatgtcctttttggaggtctcatccttgtcatggtggtgacaagacatggaacttaccacttctgaggacttgaacaccctgagagcctgaggctgcagaaatgaccgtggcaggttccctgccattcacggaaactgaaatgtgccaaagagcttatatccaagccaaacagcgtttgtattggagaagttgcctttctctcaaaaaggatggataggaagcagtttttaaaaaaaatctgcctgctttctgaagatgaacacaaatctggttacatccaacagaagatagaatgattatacaacatgaggcttaaatgtttgtcttttaaaatgttcttaggttatgcagcaagagtttacagtagccaacctgtatttccaaggagatttaatcagaggaagtatcaaagaattgaagattagtatgattttgaaggttttcctaattatttttctgatgatctcttctcaactaacagagctggtaagtagagttgattaaacaatgtcaattttttgaaaagcccttaatgacatatttacacagtagttatgaagagccccccaaagcccatcatggattataggagcaagttatagccattaaaaccatctgtgattattttttcgtagtagagagtgatgtcaagccatcagcttctgttcaacatatttcttagaaaaggatgtctcaaaacttcttcgagaccgtcacgaaatgaaacaactccccgatcccacacgaacctctcccaccaccctcaaacataaaccaacccaaaccctttgaaaagctccaaagaaaataaaatgtttttagaacttcttttcttgttcaaatgtttgattgactcgtagagatgaagggatgatgatgatttatatgccgggtgtactgttatttggagtaatgtttcattagatttgttttgtgaaatgaagaaagcagtatgtactttacatttttcatctctacatctaatgtgcaatttgttagcccatcaaaattaattttagatcccaaatggatctttagatttgtaagtaccgttaatggttttttcagttaagtgtatgtatttatgtgcccttcttgggtgaatttctatgaaggattctgcagggtgaatgttgacatgaataactaaccagcaaataagtgtcaattaaaaattctattaccataattggccgtggcccttcctcatcaaagtacagtatgtttagatcaaatttaattttttttgagatgcttgcctgcttagtttcccaatttatctcctctttctgctaacaaaagaagctgttttccatttagaggggcatctttctacgctacctacatgtgaatactatgttcaaacactataaagatttttaagtgttttttaaaaacaaagagatttggtcatttttgcgggtttcttttctccttctaaatttcatggtcccttttatcctttcttcatggattctctacttttctttctcaaaatttccccttttcctgagggatttttgcttccagctgatgtgagggctttgatggtgtggtttatgtgttaggattacaactgctgttcccaaaaggccctaaaatgctgtggctcaagttaatttagaagtttactgctctttcttccaaattccatgtctgcatggtggaaggctggttctcctccaggttgcccagcaagaaagagggaaagggagaggctggggacagcagctcacctcccactagcaaaactcggtctcctgggattccaccaggccctacctagttacaaagagactgggaaaggtactccctagctgtggggctcctccttgctaaaatccctgggatggggaggctgcttttcctacaacaaagaagggagggaaaaaagccctgggggacagttagtctctgtcacaactcatttagctacacatttttgttttgttttgttttgttttgttttgttttgttttgagacagagtctggttttgtcgcccaggctggagcgcagtggcacaatctcggcttactgtaacctccacctcctgggttcaagcaattctcctgcctcactcagcctcctgagtagctgggattacaggcgcctgccaccatgcccggccaattttttttttttttttttttgtatctttaatagagaaggaggtttcaccatgttggccaggctggtctcgaactcttgacctcaagtgatcctcctatctcggcctcccaaagtgctgggattacaggcgtgcaccaccttgcccagcctacaaaaaatttttaaagataactagttcatctttggaaaacatctaagggaaaatgtaagagtgttaaaatgtaaaagagaatggtattttttttccttcatttgggagtcaaaatgtattgtctatagttgatacaccagtgtagatttttaacacgtgatctttgctgttgatggaataggggatgcacttttccttgcattaacgtttaaagagatggatgttacctgtacacaacatttgtaagagacggttctaaaaggtttgttttaaaaattacccgtgtcttgctcacatcctctgtttcatgtcctctgtttcaatctggtttttactgtttaagatgaatgcaagcaatcaccaagacacagcttcctaaaatgttagaacaccggggtcagaaagatcctacaagtgtctagaagtaaaacaaaacacaacagattattttaaaaggctggtgattaaaatgtttcgattcaatcactttgcacaaggggataagagcaaaaattatacagtgtgtattataggatgcatatagtcaaatgtcaggctcaaaattaggccagtagcttctgctgcttggacgttaatcttgaagcaaggaagaatgagggaatttcgggggggtgagggcgacagagttaaggtgttcagtgcttttatttttgtcctacacatggtagcaaccgagtgctctgcgaaatagcagtgacccgttattccagagtcagggactgttcttggcactcgaagtggaatgttgaagtggaagttttgcctcccagaggatttccgttccagctagtgtctgtgtcgctgtgaagacatggaggaagggtgaatgccatttatgcaggagattctagaacactcggttaagaccatctgttgatgggtctggggagaagggaaggacacacttctgtgtttgtggctatttgctgctaggcagcttgttgatactccaactcttctgtagttgtagacttggccatagaatgaagaatgtaaaaaagatatttgggctgggcacggtggctcacgcttgtaatcccagcattttgggaggccaaggtgggtagatcacgaggtcaggagttcgagaccagcctgaccaacatggcaaaaccccgtctttactaaaaatacaaaaattagccgggtgtggtggcacatgcctgtaatcccagctacttgggaggctgaggcaggagaattgctttaacctgtgaggcagaggttgcagtgagtggagatcctgccactgcactctagcctgggtgacagagctagactctgtctcaaaacaacaagtaaaaataaatatttttgtagttattagtttattaaactgtaattttcttatttctgtaggagataattatgtatttagaatggtcttgaagggacatcatgacatctagagaggtcgtttgaagctacaaggtctgggacatggaatttgtcttttataagccctggcaccttctaaggtgtctcacttgcagaccccagggaagccattcagctttctgattctgtggtggtttctgttccctccacggaggttcctggctccatctctctgtgaagccctgtcagggttctttcactttccttgtttgtctcctttttctcctgattgcctgaaatcacattacaactctcttgtatcatctttatccatgtgccacagctctttttttttttttttttttttttttgagacagagtctcgctctgttgcccaggctggagtgcagtggcgcaatctcggctcactgcaagctccgtctcctgggttcacaccattctcttgcctcagcctcccaagtagctgggactacaggcacccgccactgtgcccggctaatttttttgtgtgtatttttagtagggacaggttttcactgtggtctcgatctcctgacctcatgatccacccttcttggcctcccaaagtgctgggattacaggcatgagccaccgcgcctggcccatagctcttaaaaaatagggataaattatagacagaacagccaaatgagaactttcttgattccctctcttcttgcatggtggttgtattagtcagttctcatgctgctaataaagacatatccaagactggrtaatatatatagaaaaaaagggtttaatggactcacaattccacatagctggggaagcctcacaattatggcagaaggcaaaggaggagaaaggcacgtcttacatggtggcaggcaagagagcttgtgcagggcaacttccctttataaaaccatcagatcttgtgagacttactyactatcaggataccagtatgaggagaactgcccccatgattcaatggtctccacctggccccacccttgacacatggggattatcataattttaggtgagatttggttggggacacagccaaaccatatcagttgtccacccacacggaactcaccttcctaacccatgaaatgcaaaaatgcctaatacttcagtgttagggatatgaaaagacagaaaaaatatttcctctcttcccctaggaagctgacttgtgcatgcacaaataggacaagagattaaaccaggaaggcacgaaaaagcccctgactacttcagtcaaattatagcttactgtggtatctttcagagcatatgaataattgtgaattggcctatgatctttgggccagtggaagagaataatattagggatgaatattttctcttctcatctcatctaaactctcaggagatgttatccaacaaccatgccaagattcttggaggaacagaacagccattgaagatgttgtagtgataacgtcacattttctaccccctcaaacccaaagtccccatggtcttaacggtttgcttctaagttagaaccatcaccttattccaccaacatcagtatggttttcttgtgtagaaaggcttctaaaaaaatgggcaaaggacatgaatagacacttcttgaaagaaaacatacacatggccaacaagcatatggaaaaatgctcaatatcattaattattagggaaatgcaaatcaaaaccacaacgagacaccatctcacaccagtcagagtggctattctaagaaattcacaaaataacagatgctggcgaggttgtggagaaaagagaatgcttaaacactgctggtgggaatgtaacttagttcagccactgtggaaagcactctggagatttctgaaagcacttaagttagaactaccattcaactcaacagtcccttatgggcaatacccaaaggaatagaaatcattctaccttaaagacacatgcacgtgtgtgttcaccacagcactattcataatagcaaaggcatggaatcaacctcaatgcccatcaacagcagactggataaaggaaatgtgttacacatacaccatggaatactacgcagccattaaaaaaaaaaagcaagatcatgtcctttgcagcaacatggatgtatgtccctggaggccatcctaagcaaactaatgcaggaacagaaaaccagatgctgcatgctctcacttagaagtgggaactaaatagtgagtacaaatggacataaagatgggaatcatagacacgggggcctacttgagagtggatggtggaaagaaagtaaggattaaaaaactacctatcaggtactaggctaattatctgggtgacaaaattatctgtacatcaaattactctgacaccctgacacatatgtatctcctccttctccccacaaaaaaatctaataaaattcttcaaaagatgtggaaatgttagtaacattgctttcgacaatttttgaatcaaagtggtttatgttttggctcatttcccagttgtttcctgatagttttgggtaaaacaaaggaaatatggacacgagtgattatattttttaataatggagttaggtaaataaacttcctttggtgattgaaagactcactccaggccgggcgtggtggctcacgcctgtaatcccagcactttgggaggcagaggcgggcggatcacaaagtcaggagatcgagaccatggtgaaaccctgtctctattaaaaattcaaaaatattagctgggcgcggtggcgggtgcctgtagtcccagctgctcgggaggctgaggcaggagaatggcatgaacccgggaggcggagtttgcggtgagccgagattgcaccactgcactccagcctgggcgacagagcgagactctgtctcaaaaaaaaaaaaaaaaaaaaaaaaaaagactcactccagtgcaattcctaaattctgtaggctctccgtcccttctagaaggatattctggttcccccatccattcagtttacgagtcaaatttgcacaggcatgtatgcttatgtgtgcttaacatattggcagtaggtcaataaatgtgctctaaactcacgtaatatccctgtttgcttgtcataacagacacatatatactggagttctctttagtactaaccaattcgctggtatttgggttgtttcacttggagaccttggagccttcacaatgaacacatggtaactttttttttttttttttaatgaggcagtgagctgcrgaccaagtagatttaagaaggaaaaaggaattaatgaaggtcttcaacttctcaactcttcattggcacactcaactaaaaactggagctcaaataactatttgctctggttggcacctttccttttgctaaaagaatggcaaaatgcccctccattctgctttgaaaactttttattatgggaaactcaaacataaccaatagtagacagaatatatagtgaacttcatatgctcgttacccgacttcagccatgagctgttcaaagccatccttgtttaatcaatattaccaccctcgttttccagactctattgctttgaaggaactcttagacatcatttcatttcatctgtaaatattttagtatgtgtctgtaaaagataattctgcacatgtgtgtgtagaataattgccaagctctggtatttaaagagggtctttgtttacgaaatgatttctacaacgtggagccaaaaatggatttaaaaaatacccttctaggggaagttaaatgcaatgtatcttcttctatctcctcaaaaatttgttgaatgaataaaaaccaaaattagatcagcacccctcttcctctccaaacaaaagcaaaacaagaaaaaggaatactttttatattttaaatgatgtcttgggaacggaaaatttgcatttctcttcccttagtagaaccagaatgaacgttagatttaaatgtagtaggtttgggtttgactgtggtggtgaaaatggctttgtgttactgaatagctgtagctgccccatattttgcattttcagatgtccagtcaagtgagcactaatccttagtgtccacaacaggaacgttcccgctctgcccctgatacgagcttggatggccatgaggcccgaggaagttcactgattgccttaggtgaattgattccatgctaatactggagtactctttgtaatggcttttctgtagagacatattaggagtagaaaacatggaggtgccctctgctgcttcacatttcacgctgcagaaaagatgagcttgttctgtcctgggtgctttgaaactggcatttggttctatagagtgctcctggttatctgcatgggctttgtttttcagctggagtgattgttaaatcaagtcatgctcttccccagacatgcctttagtttctgtgtaccccaaagaatccctgcagtttctgtcccagttactttgtttgttaattttctagctttttttttttttttttaagtcaatgactgctgggacctcgcactggttggcagtgtgctcccatctgctctcttcaagctgaggtcacagacgggctcctaaggacgtgacacctcatctagtgatactcagaagctattgttttgcagtatttttttttttttttttttttgagataggttcttgttctgttgcccgggctggagtgctttggcaggatcatcatggctcactgcagcctccacttcctgggctcaagccatcctcctgctttgcttgagcctgttggttgtaacattgagagacaaaataacctgggaagagtgcagagtgcatgcaggactgacttagaaaggttgtgttagctggggaatggggatggagcagacttagaagcagatgtgaagcatcttaaaaacaactacagttgacccttgaacaacacgaatttgaagtgtgtgagtcacttatacgtggcttttctttgcctctgccacccacgagacagcaagaccaactcctcctcctcctcctcacctactcagcatgaagatgagaggatgaagacctttacgatcatccgcttccactgaatgaatgctaaatatattttcgcttccttttgattttctgaatagcatgtcttttctctagcttacttgttggtaagaatactgtacataatgcatagaacatacaagcgtaacaaatcccaaaatgctgggattgaggccggcccctgatggatccccaccgactgtggctgtctcaggaacctgcatggctttcacttgcacactcatgccccgtcagacctgtgtgaattggttagtgttaaggccctaagcactcatttgcgtaatgagagtctttcacttagaaactagctcatcctgctgaccctctgggccagcatttagcatctgtacctggagcctcggctgtgggaactctggccaccggtctaggcattatcatgaggggagccctgttagaacagaggattctcaaaggcttatttcttccctctgacagtcatgaagtgggttacattcatgtaagttggaggagatttattcagtgcttgctctgaatgacgaagttggcctgtctaagggaagctcagatgccatggaatgcagttcccagcccacttcagtccctgtgaaatctgtcagcggatgccttttaaggatgcagtctaatttgtggagagtaagatataaggcttaggggtgatgaagatcacagctctgaattgaagcagattttagagctattagaatcctatgcagtgcacctatcaaaacatacatttctgatgaaagaaattttattccgaagtcaaattatagttgtttcaaaataggaagaaaagaagtatcttcagctcttagcatttttctgatgttaagaacatatccatttatttttgccctaaagagaagttacaaagcatccaactcctttgtgtggaattgatttgagtaagtgtgaagcaaaaagccaattcagttttatcgaaacttatttgttttcattaaaaagccaatatttatttatttattcatttatttatttattcatcgagatggagtctcgctttgttgcctaagctggagtgcagtggcgtgatctctgctcactgcaacctccgcctcccgggttcaagtgattcttctgcctcagcctcctgagtagctgggactacaggtacctgtcatcatgcctggctaatttttgtatttttagtagagacggggttttgccgtgttggccaggctggtctcgaactcctgacctcagatgatctgcccacctcagcctcccaaagtggtaggattacaggtgtgagccgctgtgcctggccgccaattcagttttaaatagaagatttgaaattaagcaagcgtcctgtacctgaacagcagacattaccctgaagagcctgttggttgtaacattgagagacaaaataacctgggaagagtgcagactgcatgcaggactgacttagggaggatgtgtccgctggggaatggggatggagcagacttagaagaagatgtgagcatcttgaaaacaacttcagttaacccttgaacaacacgagtttgaactacgtgagtcatttatacgtgagtcatttatacatgggttttcttctgcttctgccacccctgagacagcaagaccaactccgcttcctactcctcctcacctatgtagtgtgaagatgataagggtgaagacctttatgatgatccacttccgcttaatgaatactaaatatatttttgcttccttatgattttcttaatagcattttcttttctctagcatacttgacgataagagtaccgcacataatacatagaacatacaaaatatgtgttcatcaactgctatcagtaaggcttcaggtcaacagtagtgttttggtagttaaattttgggggagtcaaaatttatatgcagatatttgacttttgggggattcagtggaaaaactagaatttcagttttacagggtcaattgtaattccagtgaagttcatgcacattttacttattttttgaggtatggcagaagtgattctcttagggcaaatgtggtctgtgtgagatgaattgattttccctcttggtgaatttcctcactggttagcccagagcaggacaaggcaacttattgttatttttccccttagctactgtcatttctgtaccgtggaagacaatgagagctgttggtttggtttaggaggtcacatgtgtggagggctgggttagcatggatagtggagacatcaaagtgttaaagacctcagtgaaaagctctgagttagcagatgtgcagcagagtttgctgtgaggtgaggacaagctgtgttttgggggccaggctggcaaggattggtgctccagaaagtatttgaagattaatttgaattgaactggaaacatgactcattgtggtccaagtgttatagactgaatctgccattttcgtcttcagttgattccagggcaggtacagagggcctgatagaagatggaacaggagctcttatggtcttgggtgcctgtgttattatccattctcacactgctacaaagaaatacccaggactgggtaatttataaagaaaagaggtgtaattggctcacgattccacaggatgtacaggaagcatggcttgggaggactcaggaaacttacaatcatggtggaaggcgaaggggaagcaggcatgtcttacgtgggctggagaaagaggaagagagagaagggggaggtgccgcacacttttaaacaaccagatctcatgataactcacttttaccatgacaagaccaaggaggatggcgttaaaccattagaaactgcctgcacgatccagtcacttctcactgggctctgccttcaacactgaggattacaattgtacatgaaatttgggtggggacacagatccaaaccatatcaaggtggaaccttggaatagaatgaaatgatgctcttgcaaagaaaccctgtcctcatgcaggggagcagcctacgttttctrtctttgggcctaatagcagcggctttgaacagatatccatacgtttagtaggacatttgactaccatggcattttgcatccttgtaagctttcatctaaaccacagttttatgaaagattctctcaggaatagagacactccctcattaaatcactgtacatattaagtcagtgcacacagtaagtcatggtgcatcatatcaatgaaaagaaatgggctattttattcttttcattgggttaaatcttactggtgacagaaagtactccaacagttgatactgtaaatagttgggtctaatggtacgttgcctggcttggttctctgagtttttctcattgaataccctctgtctctgttctgtcttcacgcactttattcctgatcctcagttttctctcagctgttctgctaaaattgcatgttctggtctccagcagttctcttagtgtgaaactcagtggcctttccctgttmaccttctcataaatttgttacatttttcatttgattactccctcagttcccccaatgttagttccctagtcattcactatccggatctctcgattgattgattgattgattgattgattgattgagacagggtctccctgtgtcacctaggctgtaatgcagtggcatgatcatagctcactgcatccttgaactcctgagctcagtgatcctcccgcctcagccttcccaagtgctggagttacaggtttgagccactgtgcccagccttatcctgatatctcattacatctcatttccagtgattcttcattcttctgcctcattttaatttgctcatatgatgcaagataaataaaacattctccaaaagttgccttgaagtttggtggtgtggctctgccatgaagacccatgagtgttgattttcttaggcaagccagtctagaaattttgcgktcagctgtgggcttttactatctgtaaaactcttgcaggagccaagtattactattgtatccagakagaatcctagctaattctagtgtaaagaaatcagtgaggagaaaagtaaaacataattatgcaggaaagtaggcttttatgactcaattaacatattttacagcgttttattacttcaaggcaatatttaatttacaaatgatttaagattttaaaaactgttggaactgagttaagatgggtggaaatattaagtacttcagtttttctrtgctgcctgatactttgtactagccagtaaaatatttgttaaagaagtgtttgtccttcctttgaggtattttctttttttttctttttagtggctgagtctattggaagggccttagttatacatcatgccatatggtattagtgacaaaaatattttgaggatagatttaataactaaaacaattaggttagaaggccattgtgagaacgcttggccagttgctttcagatttaatcctttgttacgttacagtccacagaatgtagtgtcttttgcctgagatacagaaagtgttatttctgatgtggattggattttggctcatttagaggacgtcaccaatcctatacaacagagcaggatggatttcttttctaagttaatatgaagtgttctgtgcaatttatgtatatggttgtgtgtgtgtgtgtgtgtgtgtgtgtgtgtgtgtgtgtttctgtttctgtttctgaatatcttttaaggtgttacttttttgagaaagagaaatttattggacgttttaattgtggtggtctgcagattctccatagcaaccgggggtgcaggcttactccagaagcaagtagcagttggggtcaccaagtaatgctgttctatagattataccggtgagctgcgtctgcatttgatgcctcctaagatagtgtgatatagttggattgtaagaagttgggtcatggtttttgtttggattttaaaaattgtcaaatagacataacatacaatttgcaatgtggaccagttttaactgtacagtttggtggcattaattatattcacgttgtcgtgcagccatcaccatgggccggagtgctttcctctcccccattggaaactctctacatgttgaacgtggttcccagtccttacccccttctctgggcaaccaccgttctgttttctctttctatgaatttgaccactatagaaaaagatcagtttctcccaaactttgcctaaatccccaaatagattccttttcccccctccggcttcttttgaacattaaagcatcctggtgatttatgctcccgcctcaattcctccctagcttctgtctggctgtgtcaggcctgtttcaggtgttaatttctgtgatcatttccctggtaaactcctggatggcaggttctaggttttaytcctgtcgtcctggaacttcacgcttgtctctgatgcagtgcaggcctcagctccgtagggaggttaacaaatgaagctgagttccgcaaggcagcccaaagcactcgagttacaattgcagacagtgggaaacggcaagtcagaggaagagcgctgggacactgggccgggtctgcgttagtgggtttgtcaagagccacggaaatccttttaccctgcctctcatggaataatgctttagttaatgtctgtatcggtgacaggtcccgcttttaatgagcagctcacttataaggtctgagtatgatcaggaacctttaggaacaaacactctgttgtggtcctggttgtgggactcagggacacagtgttctagtccccgtttaatgacacttctcgtttcctgtattgttccattttggtacagttaaggattgggagctaattccaaagaggtttcgttagctgtgatggggagctgatgaagaggcagcctcttagacacggaaggcagcacacagcaggccgaactgtgtgtctgagcatcaggctcctggtggtggctttggctgtgtcactgggaaggtggagggggtggcctctcggaggctgcacggtgggtttctgagcctggttctccaggccaggtggatgtgayggtgcctggctgtcagcggccaggccggctgtggatgacgcttgcctttttcctcttgatagaccatcatgttgctcccatcgtcagcaatgagttgtcgtgtcctgagatgaactccctgttgtcggaggcaggggaagagccgtcgcgtagcacatccggtgtgtgtgtctgctttgtcaggcccacttcacaaaatacgtttgaaatatgaagtttccccagataaactgtgaagggtgaagagtgctttagatgtgtgctttccccagattttatttacttatttgttcccaaactcatttcctgccttcccgtgtttctgcaacaccagcgcttcctagtgtgagccttaaagaaagacgatatttaacaaaagaagaaggggaggaaggaaagaaagcgggagtgggggagagagaaagcggggaggccctgtggggagctggggtggggaggccttgcggggtgttggggagagagagagagagaaagcggggaggccgtgtagggagtgggggagagagagaaagctatgtgaaaggtgagtcaatgaaaacttttgcatttataaattacccagtctccagtatgtctttattagcagcgtgagaaaatactaatacaccccatctctaccaaaaaaaaaaaaattagctaggcatggtggcacacacctgtggtcccagctactcgggaggctgaggcaagaggattgcttgagtctaggaattcgaggtggtagtgagctatgatcrtgccactgcactccagcctgggtatcaaagtgaaaccctgtcccttaaaaaaaaaaaaaaaaggtaagcctcaaagttatcctcatccaccagatatttactaggtgcctgtaatatgccaggcattatggtgtgtccttaaacctttatttgaagaagttattgggctcaaaagatatctgaatttttctacccatattttatttgtgctagtcttctatttttccttatctctcaagttgataaagctctcatgaagctaaagtatgatcagaaaaacttgtttctggcaaggcgcagtggctcacacctataatcccagcactttgggaggccagggtgggcggatcacctgagttcaggagtttgagaccagcctggccaagatggagaaaccccatctctactaaaagtacaaaaattagctgggcgtggtggtgtgcgcctgtaatcccagttactcrggagggtgaggcaggagaatcacttgaacccaggaggcggaggttgcagtgagctgagatcatgccactgcactcccgcctaggcaacagagcaagagtccgtctcaaaaacaaaaaaagaaaaacctcatctccattagactcactgtgtaatttctctttggcctattctgagttcctttgttaaggcttccaaggtgctgcctgcacccagtgctgtgctgtgaatagtgacctcagactggttctctatttgtgtgtttgttcttgcaattctgtcatggacattaatggaaatatttaggttttagtgaaataatttttttttcctaggagaatgaaatcaatgggcccagtagacttgttttcactttggcttgttttaataaaaagcatttttataagctgggtcggggaggaagtgaacattgtaaaaatttctcaaacatttgttattttacaagcgcaaataaatatgtctgtttaatttaaaaagttaacttattgaacaattcctttttctgcaccttccctccccagttaaggcaaactattaaagaatatgcataaatagtagagcttttaattgctattgatgaatagcacccttttgcatgtcttttatgtcaagccttgggtgagccctgtttttgtcttattaacacacattcgtagcgtcttctctcatttggatgtagatttagatgctctcttagccactcttctcagccttattgaagttcatccactgaaacacttgcaagaaacagaataaagtagaaaagtctcagctgtagaaacctacaataaactgcagttacacacagaaacccagtggctcattggtaccaagagccaataccagtagcctccataggtgaccatcactccgcagatgacttcggcggtagatgacctgtaggtctggaagagctgtaaccattcacctttcttttttttttttttttttttttgagacagagtctcattctgttgcccaggagactgtagtgcaatggtgtgatgatctcggctcagtgcaacctctgcctctgagcttcaagcgattctcatgcctcagcctcctgagttgctgagaatacaggggcgcaccaccacgcccggctaatttttgtattgtttttttcagtagagacagggtttcaccatgttgaccaggctgattttgaactcctgacctcaggtgaaccgcctgccttggcctcccaaagtgctgggattacaggagtgatgcgcacagggtcccatgtgaagcccaagtcatgcttctctgggtgtcagtcacttcatctgtgacttgagtggatgtgactagcttgcaagttctcagtgttgggggcgcaggaagagaggaaggatctttaccaccacagtggacagggcggcagtggtgggtgcaggagacaggtgctcttctgaaaagttctgcatgtggggatgccttttagtctctgatcctctcctgggaagatgcctgggtttaatgaactaaaatgactttccgactctgacatcctgtctttataaggtaaagaccattagattcaagagcataattggatagatatgtttaaaggttgtctttcaggattattgtgctgatcacagttttcacctggctttcctgtcccagtggatagtgagaatgatttccctattaaaaaattacccatcaacagactcctggttagacagtgtgttgagaattaatggtgtgtgccatcgagtgatgaaaggcagagagaaggtcttagcctatgggggaattctgagctagaactcacagtgtaatttttccttctttacaatgacatggtttataatgaagccttggtaggctggaggacttgtgtcagaatacaagtaccaaagaagtcacagaggaatattaactgagaaggcttttaagaaagaagaaaatacctatccttgtgctaggccaggcattgagggagggacagaggcctggctgcatcaaggtgtcctgacctgccttggagctggacagtagctgggcttgaagatgaccgcaaactgctgcctgtcccccttccagggaggacgctaccatgggatggattagacaggggaaaaagcatcagaagtcagatgagagaccttgtctttgttcctctgtttcctgacagcagcaaagattttgatcagaggtggtttttgtggaggtataatagcaaaaattaaagaaccacatctgacttgggaaggggcatattatatgggaagtgagagagagggagtgatgggggatagagagagatgggaggaagagaggagcagagagagaggaagaaagagagagacagggagctggaactgctttagctaaggtggcttggtggagtttttcttgcttgtataattatggtgattattaatttaaagcttgtccttcccaagtgatgcaagtacctgctcctgggccatcctgtgctaaggttgcattgctgaacggatgacagggtgggtggtgtatgtccctaaggccaccagagatggtttactcaattcayatgcttcctccacctgggatgaaagcggttaattaatgtttgattctaagaagtcaggtgatgtgattcagattagttatggggttgtgctgaagcgcgggtggaccctaggaggtgattttaacggaagtctcaaaatagcagccttggaactagttggactagttatttttaaaaataatgagaaatgttataaagtcggctgaaggtattgatttacctttcaggttgttcagaaacagaatcttgagaaatagcctgctacacagttgtaagggggataataaagagatcccccttctctaaaaaacgtttacaacccaatctttgggcagccgagatttttagcagccgagaagggttcccaggggccacaggttgtcttagaccatctccatcagttcctagaaatcgtgcaaagggtttcttcaggggtttctgaggcctgtaaccatggtattaaaatctgactctagaattctttgacatttcttgcattgaggggtgagacccatgttctctgtccttgaatctgggtggctttgtttgggactgttggatccaataggggacagcccgagtgacctcgggtgacttccaaggctgagtgagagaaggtgacacagctgccacctcatttgctggaacccttgtcctgggcacctgagtcatgggggaacaaatgtggttccatgctgtgaggccgccatgctgcatggagaggccatgtataggcgctgtggccagcagtcccggccttcccagccaaggccccggttattgtggagcagagacgagcctgccttgctgtgttccatctggatttctaaccgaggaatctgtgagcatcagcaaatggtgttttggcccctgggcgctagggcagtttgtgacccagcagaggtacctgcagcagcagcagcacctcctctctccctccagctcatgctctttgcagaactcaccacacacatttcctcagttccctcaccgcttttgtggttgtggggatgtctttagcacccgtgctgtgctgcgctgatggctgctgaggactggacgccagtacctaagctcggctcgtgagaacctccgtgcaggaaggggcccctagagccagaacagaggctcttccttctgcttccagccttgggtaaaaacacacgccaggcgtcattgacatcattgtcatcatcatcaccatcattcactgttggtcttttccatctgtccgctgtcattttagcctcagccatgacatttcttagtccgtgaaatgctactgagattgtactgttatttgaggtagttcttttggattttattaaccccagtatatctgttgcttacaaaataacgagccacatgctcatacaatggcagtgaaggttctatatctggcagcctcatgtgaattcaggagccggcagggaatttaggggagaagtaaggcaagctctcaagttttccaagccgcatgggctgcttggatctcacaagtaatgcctggatttaaatcactggggaaggcagccttctgctcctgtatagtagaaatgggtcccagtcttgagaggctgcaagtttaagcttttcttagtcaccttgttcttacacttttttttggtacaaatgtatttgtacacagagagacttttgcattttaagcataaaagaaaggatgacctcagaaagtgagttccatctgggactattattatttcagcacttactttatcaaagaggaaattgttttatgtagactcctacagtgggacagccatgtgccaaaaattaaaagtggattaacacattatataaaaattaactcaacagattatagatctagatgtaaaacataaagctgtaaaacgtttagaagaggacatgggatttgtgggttgggattaggcaagagttcatagacatgagaacagacaacaaattgataaagtggacttcatcaaaatgaaaaatttcctgtgtgaargacacttaaaagaatgaaatgtcaaaggacaaatacagactgagagaaaatattttcaaatcacatacctgacaaagctcttgttgtatctagaataaaatggactcttaaaactcaacaggaaggaaaaataatccaattacaaatggagaaaagacttaaaaagacacttcaccaaagaagatatacagatggcaaataagcagatgcaaagatgtcggtattatttgcattagagaattgcaaattagagccacagtcaatattactacacacctattataattagtaacataaaaaactgacaatatcaagtgtcgacaaaggatgtggaggcactggaactcttgtatgttgctagtggtgtgatcccatgcaaaatgggaaagccaattgggaaaacagtttggcagttcttacaactttaaacatacacccaccatacaacccagcaattgtactcctgggtatttaaccttgagagatgaaaacttaygttcacataaaacctgggtaagatgtttatagcagccctattcatagttgccagaaagtggaaacagcccaggtgtctttaagcagtgaatggacaaatgacaaacagattcattcaggtaatgaaactggctcagcaaaaaagttgaaagaactattgatacaaccatggagaataatcttgaaggcatcatgctgggggcaaaatactagtctcaaaggttgcatgctgttagattccatttatatgacgttcttttttttttttttttgagttagagtctcgctctgtctcccaggctggagtgcagtggcatgatctcagctcactgtaacctccatctcctgacttcaagtgtttctcctacctcagcctcctgagtagctgggattacaggcacacgctaccacacccagctaatttttgtatttttagtagagacagagtttcaccatgttggccaggctggccttgaactcctgacctcaagtgatctgcccaccttggcctcccaaagtgctaggattacagggcaaaactttagatcagtagttgccccgggggttgaggtggaggaaggatgtgactgtgaagataaacagaaggagggatttttttttcggggtgatgaaactgtatcctgatggtggtggtgggaatggaaatctatacatgtgtaaaattcataaaactatatacctaagacaggtcaactttattgtgtaatagaaacaaaaaaattaaacaatcttattattttgttgttgttgtggatacgagagaggaatagggagaacttttttttttttttttttcaaggaagacctggtttcccccagtggtctggtggcccaaattagagtgacatgaagggaagcactgggggcaaaagtccctcgtatgaaggacagcagggaggagacgatgcttttcatggtagtccgcagggcatggcgacatccctatgtttgtcttttatttacggtgactttcctaaaatayattacccaaagaattgcatggagaaattactgtgcaacccctttccccaaggggaacaccaaaagggaatctagttcggttttaagagcagctttggaagcaaaagagcggttgctttgggaccaggaaacaaaggcttgacttgaaatgatgagaaagagccagagatttgaggttttcgttttccagtgaactttttagagagttaactgcacagctcaaaacggaggctaatcagaggtgcacaattaaattaccatgcaccacttagaaaattaaagggtaactcgatagtctgtgtgatttcgaggattaattttgagacaatgtaaatggctattattagtatttgtattactgataatctttacatgggatgccagacgtgttgtgggtctttggaacagtagctgtctaagctgatttcagagacgaatacagagccgaggctattaaacaagatggcctggtgatctccagggtctgcttttgcagcttaggagctttggggaatgtgcgggggagttattgatgggcaggtgccgctggcatttcctgggcaggggctaaggatgtcaaatgtccctcagcgcctggaagagccccatacaatgaataattgttcctggtgatcttgaaatgttctgccagacacaaaggtgaaattatgtgtgcagtgaatggagcttggaacctaattccagctctaagttgtttatatatggtttgtatagttttaaaatagtctgaatttttcaagaatacagctgcctggtaagtccaatgaagatggctcttttgtttggaagcttaacaagagttgtttactcttagaaaatcagggactacaatatccctgttgatatttcaatccaggcaacacatacatatcagtgtacatttattttttctggttgcatactggacaattttacgtatgactattcttgtgctgcattcaaaatactgcatagaaaagaatgccaacaatattcagtttaatactgttttcttttaatttttaacatatttattgagatataatttacatactatgcaattcacccacttaaagtgtacaattcaatggttttagtatattcagagttttgcaaccaccaccaaaacattagaacattttcatcatcccaaagagtaaaccgttacccgatagcagccacttccatccccaccctgatactatcttctgtcagatccccacttatttattgttaagtagataaaagatttgaccgccacgttgtaccttctggtagagttgtacctgagcctgtacctactgaagtgtgctttattttcttacgaattactttccactattttttctctctcaagattgggcattttgtgactttaaaatagttatatgtgagggtaggttttgttacctctgaatatgtatttagaagaagagaagtccttggctctgactggattgagaagacatccatgggtcttccttacacagaggtgatgactaagcagcagcacagcagataccttgtgataatagaaggattttaaacttctctgagtacagctttattatttcatttattctctacctttaatattggttatggcctgaacgtttgtgaactccccaaattcctatgttgaagcccccgcagtgtggctgtgtttgaaagtggggccttgggtgggggcgcggtggctcaggcgtgtaatcccagcattttgggaggctaaggcgggtggatcacctgaggtcaggagtttgagagcagtctggccaacatggtgaaaccccgtctctactaaaaatacaaaaattagccggacgtggtggcgggcacctgtaatcccagctactcgagaggctgaggcaagagaatggcatgaacctgggaggtggaggttgtagtgagccgagatcgtgccattgcactccagcctgggcaacagagcgagactccgtctcaaaaaaaaaaaaaaaaaaaaaaaagtggggcctctaaggaagtaattaaggctcagtgaggacataaggctgggtccttaatcctttaggattactgtccttaaaagaagaggcacctgagagcttatgcactctccctccgcctcccttctctgcctgagcacacaaagaggtcatgtgaacacgtagcaagatggcggccacctacaaaccaggaggagaggcctccgagtgaaactgaccatgctgcccccttgatctggggcttcccagcctccagaactgtgagatacgtttctgtttaagacacccagtctatgcttttctgatggagtagcccaagcaaactaatacaagtttcttctagctggtaagaacaaccattcccttgggaccatagtggaagtgagtacagccatatctgcctttgagtaaactctgactatgaggagtaactcagggaactcagattggggtggagttcacaagatcctcggctgcagtttgggctctacctcttggtttttggagctccccygcctggtctcctccgcgtcttctctttttacttctggctcttcactctgcaccatcacctcttactccttattccattatttttcaacgttgcattgttgctgaaccgcagtgtttagcaaacctttattttctcataagctgaatatgcggtggagagaagggtttcccacaaacatactagaaaaaatgtgtgtgtgtgtgattatagtaattattcacacttatagcaaaacattcatttgattcaggaaaggacaaaaggtaaataaagtgttcagaaatctcactattgtagagctagaatcattttgggactacctagacaactttgtgtgtgcataggcaatatatttacacaggcatgtacttttacattcatagagtcctactatattcactaaactgctttataacagtttttgttgatgtttttggcaataaatacagatgaaatataacattttaaatagccatatagaattccattttatgtatgtattatgatggttgtaacttgagggtctttgggatatatctctgtctctgcctatgtctctgtctctataactctatcatctgtatcatttccctaatattacataatataaaatgcaaattttgttaaaaagaaacctttttaagcaaagttctttgtacttctgattatctctgtactatacattgttccaaggaactttttatcaatatgtactttcttttcttaaagatgttgaaacaaactttatttttggacatatcaaacctaaagaaaaagtacagaggttaaaattaaaaaaatctgcacagcacctgtggggctttatcaaattctaacatttcaacatacttcagattgaaaaaaccactatagttgaaaccccatgtaatattggggctcctttccaacaccttttgtcttctatggcaactgctgtcctgaatttggtgtttattttcctcattttttttttttttggttttttttttttttttttgagatggagtcttgctctgttgcccaggatggagtgcagtggcatgatcttggctcactgcaacctccgcctcctgggttcaagcaattatcctgtctcagcctccccattagctgggactataggcacctgccaccatacctggctaactttttgtatttttagtagagacggagtttcaccatattggtcatgctgcaaactcccaaactcaggtgaycaacccgcctcagcctcccaaagtgctgggattataggcgtgaaccaccgcgcccagctccatttatgttttatattgcatgtatatttcaccataaatcatagttagtattgtttttacctgttttcagactttccataaatggtatcaatataaataatttttcaatttgctttctctgcttattccacaacttctctgttttcttcatgttagacatttaggttgtcttttgcacatttttactgttaacaaacagagctatgaagaatactcttgggtgaatgttctggtttacaaatgagagcatttctctgatgataatgagacagtcattttccacagtggttatcatctagccagcagcatgcagtaatccaagttttcccatgccctggtcaaagcttcatttttggccttgggctagatgtgaaatcctgtctttctgtggttttcatccattttctgtgattgctagtatggttttgtgtcttttcctagacatgagggtttcctttgtccattcgcctccccactgtcccctcttccatttcaacataccctgtttattagaccttacttttgtgctgtgctgtgtatgtgtgtgtgtgtgtgtgtgtgtgtcttccataagttttcatttcaaattcttaaaaattttcttgtatattccttctaraatttctaaaaagtaaagatctttaatccatctggaatcgatgcctgtatatagggcagtcattgttcagggccagtcagtttcagctgggagcgccctttttcatcacaggtgtgagtacaaacaggatcattttccttgtgtactgtgtcagtccactttcatactgttatgaagaaatatccaagacggggtaatttataaataaataagaggtttaatgaactcagagtttcacatggctggggaggcctcacaatcatggcagaaggtgaaggaggagcaaaggcacatcttacatggtggcaggcaagagagcttgtgcatgggaactcccatgtataaaaccatcagatttagtgagactcattcaccatcagtagaacagaataggaaaaacccacccccatgattcaattcccccctagtgggtccctcccatgggacacgtgggaattatttacaattcaaggtgagatttgagtggggacacagagccaaacaatatcatgtaccgtgatgtgaaaaagtttgggaagtgctggtcctatttgtcattttatgacattctgcatacatttagaggtcaaatttgtcaagttccctaaaaaaacctccaatggaattttgattggagttgcataaaacttattaatggaggaattgaaattattatgatttcagtttgcattttctaacaaatgcattgcaaatgtaagaaattatattttaatggatggactcagtgctgagtgctgacaagcatcccaggtgagtaataaacccctgccttcaagtagttcatagcttaaagctatatgcttggaaatggacaagggagagttacaaaatatggaggtattaatgggacattttgactatactaagaaatatacaaactctcgtgttaaagaattcaaagggagaagagaccatatcagtgtgtcagttttcttaatgatttggtgagtacctacattgtgcaccttaagatgggatattttatccctgacgttattttaccctgaatcactgttaagatgctcataaatgccgggcayggtggctcacgcctgtaatcccagcactttgggaggctgaggagggcagatcacaaggtcaggagatcgagaccatcctggctaacacagtgaaaccccatctctactaagaacacaaaaaattagccgggcgtgttggcgggcgcctgtagtcccagctactcaggaggctgaggcaggagaatggcatgaacccgggaggcggagcttgccgtgagccgagattgtgccactgcactccagcctgggcaacagagtgagactctgtctcaaaaaaaaaaaaaaaaaaggatgctcataaatgcctcagtgaaacttagggttaccctctccttttcaaagaagagatccaccttttcttttttaactgagagccttcctcctcttcccttgcagaaagattgttaatttgttttatataggaggaatcctgtaataaaccatgtcattattaattaaaaataacacatgctgggtcctgagggaactcaacatggagaaaagcagccactgaaattttaacaggagtgttttttttagacgatttatttaattatctttactattccgagcagtggaggaactgggccgttggcaggcccttatgcgcttggatgggagttgctctctcttaacaggcagtttagagctacagagtcagtaattttaatctcccagtgaaaaatggcatttggaattggccttgaatagtggaggatgtgggtcatggagggtctgaaagaccctgggccttgaatctccatgtcagcccgcaaaacactgaggttagactctttaaactttactttcttcatctgaaaaatgaaaagtgcttcctattacttaacctcccagaatggtggtaagaatgaaaaggaattccatatattggctctcagcaggtgtgactttactgttctctgcaattgttgatcttacttcctatagtgaaatggttcctttcataagaaaatactccagtgattctccaggaaaaaaatagaaggaaagaagatttcaaaggataagctcattttttccaatcctagagaatcagcatctctgccctggttctcttgtctgaattggagaacaagtggctgtaaccctctgaccctccggcttgtttcatttataccgcggggcaagatggtagagaacacttaccacatgattggaagtactttgaggaagaactagataaaagtgagtcattaattaattgttaagagtcagcagctgcacactcaggcgtctcgtttgatgggaaagggaagcaacttgagtgaatttaaatcacttcgcatgtatgacagtgtattaaagtaatgagccatgcatctggccaagttggcgttgtcaagctttgactttctctgtctgtctctctctctctgtctctgtctctctctgtctctatgtctctctctctgtctctgtctgtctttgtctctctctttctctttctgtctctctccttctctgtctccctctctgtctctctctctgtgtctctctgtcttcatctctctctgtctctctcagtctctgtgtctctctcagtctctctgtctctctctcttagtctctctctgtctctctgtctctctccctctctgtctccctctgtgtctctctctgtctctctgtcttcctctctgtctctctctgtctctctctcagtctctgtctgtctgtctctccctctctctctctctgtgtctctctctgtctctctctctctgtctctctatcttcctctctctctgtctctttcagtctatctctgtctctcagtctctcagtctttgtctctctctgtctctctctctctctctgtctctctctttggtagcacctagtttaattcctgtagcttacatgctacaaaaagattttacaaaatccagcaataaacaaaatgaaacttcctgatataccataactgatacctgtgactctgggaatttcttaagacatccggaaataagtgtacctttgtacgtgaaggacgtttgttttccccaagatctaggtcaaattaagaacagacttgtgtcccatccagtttgagataggctggttggctttctcagggaccttgtgtttgcagctctgtgacagtattcagttttaaactttggatttctttctcctgaatgagcaaaagtaatgcttttgcagaacgccggggaattaattgctgctaagatttgaagaaagacatgtgcacagttcctagctctgtatttttaccccaggagtactgcgaacttgatgattttggtttagtgacttccttgccagcggacttacgttttttgtttgcatgttgactgctttgcctagaagttctgagggacatagtttaaagatgtcttgcagtgcacctggttaatgaatccacccacggaaactctgcctccgtgtctctgactttgtcttctgcgatccctcgtgtggccctgctccagtgggcttggcttccttcccttttgtcagagatgccaagttggtttatggcccggggcctttgtacaggcggcactctctgcctggaacacccttccctcagataattgcatggtttactctcaattcctttaagtctctgctaaaatgtcatttttttcatgaggatttgaggaattgtgtacaaataaaatcagccccaccctggcagatttatttccctttttagcatttttattgtctgataacatatttgccacttgaccattcgtctgtcctagcccagaatagaagacgcggagacgcgaacctttattattttctcgctccagttccctcagcatttgggctgtgtatttactgaaggattgagtggatattcttctatcagtatgactgatgtgtcatattgtggctcaaggcatatttaacagagccactgtgttacattcctgctaatgaaaggtaaatgttatttcactcattcaagtcataagattcttgattgagcccaggtgccaggtacaagtccaagtacttgggcattggctgacctggaattcaggtcatgtatttctaagtggggacaatatcacctccaaagaggtgaaaaaaaaatcatgcttttaaaatgtgccaagcacagatgtcagtataacacataaaaagatatgaaggatatctgtggttttacaatttcatgaggaggaggtgtttagaacaaatatctaaaagggcttcttaggggcatgataatgagagaaaaaaaggttgtgaaaccgtggtctttagggcagagaatatcagtgagaacaggcaagaaggttctggcagaatgcctcctgtgtccccatgaatttgccactttctcttcttcccagcattagccagaatttcatggtcagacctacaagtaccagctccagtggacacttctgtgttgcagttaattcttctccattcaatattccttagagttctcagaaaatcatttcttccttaagatggtgcatatctttgtggtttgcagccaccgtcttagactgtcccaagttgtggttaggataatactgaattgtggtgttctatgacttgctgattttttggaatttataacgaagtcaaatatctttttcatccagagatacaattttgtcttccaaatgacgcccaccaggggtttttgtgcatttccttggtggtttaatagaatttgaaacctaatatttcatgtcattttgttacataaattagtgttttccttacgcaggttcacacaaggatctgactcagatcttttaccttctcctctgtggaccaggtcagcgtggccagaagctatgatattgctgatgtgtactttttttttttttttttttttgagacggagttttgttcttgttgcccaggctcgagtgcagtggcatgatcttcgctcaccgcaacctccgcctcctgagttcaagtggttctcctccctcagcctcctgagtagctgggattacaggcatgcgccaccacgcctggctaattttgtattttcagtagagatggggtttctccatgttagtyggctggtcttgaactcctggcctcaggtgatctgcccgctttggcctcccaaagtgctgcgattacaggtgtgagccaccacgctggccatgatatgtcttcgcttggaattgagagcagatgcttttattaaaaataaggatcttaaattctgtaggatttttttttttccattaagctgcctctattttcgaatgatgagaggaataaaaccatgtggcttcccacagctgcccacatgggtcctgcccatggatttagtgtgggccagtcctctgagtaggctcacacactcaggacatgaccctgggggagggggcacgaggacaaagccctctcctgaaggagcagtgctttccaagccctgcaaagactgcaactgatgagggggacacgaccagaattttagaaggaagtatgtgctcatttagtacacggttgtgagctctgccacacactagatatcacatttatcaatagagaaacaaataggcatagtccctgagtttaaggacttcataggcatgcacatatgtatgtgtggtttgcatgtgtgtgtgtgtgtgtttatgtgtggggagggaggttatcatgttcaccagcctacatactatggctatgtaatatcaagaggttcatggagagtccaataggggatctttttcagaggagttgatcctggagaaatcctcgaagtgagcaggcatgctagaccatcttggcaggccagaaaggggaacctcttcatttacaggcacgatgctagtgactttgagacttctcttcatattttgtgtggaatgaaagagagctgaacagagggcttgagtgacttgtcctgtgcatggtggatccaggttttaaactcagttgcatgggagaagaatgtcctccaggtcgcaggcttccttggggaccccgtggctggcctgtcgtcccctgcatagttcattccaaccttgctctcatctgagtgttccttgtgctgctttccagcctggcggggcccatcactgacccattggcgcttccctttcctgggtgtgctgggcccaccagcctccacccagcccctcacctgcctgctcatatggctttggggtacgctcactgccttttctagcccagctggctggatcccttggccgtagcatcttttctgctgggctctgctctcagtgctgtttctggtctgcactgctctgagcctttctaactgccctagcccagctgtaaacattgctgtttttcttgccattctgataaaaatccaacacaacccattcactaattagaacattgcataaacatgagtcctgttgagggaggtcatgcgttttggctcttcaaggttcaccatctgttctcagcatggtctttgtatctcttccctctgtgatgaagtagaccaagttcagcttccaattgttccaggaactcagaaattctagtgttcctgacacttccagttttccctgtgttgtatagattagccttaatctgtgtacttctatgcctgaacatcttcttaataacagcaaatattaagagggctgactatgtctcaggtgctgttgtacaggttttacattaagacttctagcaagcctgtgaggtggggactgttcttgtccctgtggaaaccgaggatcagagaggaaaagtaacttgctgaaggtcatacagctcttaactggtgtatctgggacttgaataatctgggttagtagcagattgaaattatttggcatatggactagtcagggttctccaggaacacaaaacctgtaggatggtgatattgagagatttgttccaaggagttggctcctgtgatgatggaggctgacaagtccctagatctgcagttggcaggctggagatccaggagagctgatggtggaagatggtgtaatttccagtcctagcctgaggcctgagaactggaactggtggaatagttcttgtctgaaggcctccaagctcgagacccaggaagagccaatatttcagatagagtyggaaggtgggaaaaagccatcatcccccaaaggcagtgaggcaggagggattctccctcacttgggggtggatcagactcttgttctatacaggcctgcgatggatrggatgtggcccacccatagcatctgctctactcaatctgctgattcaaatgctaatgtcmgccagaaacaccccaagaaacacccagaataatgtttgaccaaatatctgagcatcatggccaggcacattgacacacacaatggaccctcacaggggatcgtgacgttttactcttgtgctgccggattggctggcttgcttgcttgcttttctttctttctttctttctttctttctttctttctttctttctttctttctttctttctttctttctttctttctctttctttctttctctctcttttctttctttctttcttttctttctttctttctctttctccctctctctctctctcttttctttctctctttctctttctctctctctctctttctgtttctctttctctttctctctttctcactctgttgcccaggctgaagtgcagtgacacgatctcggctcactgcaacctctgcctcttgagttcaaaaggttctcttgcctcagcctcccaggtagctgggaatactggggcctgctaccatgcccagctaatttttgtatttttagtagatacagggtttcaccatgttggccaggctggtctcgaactcctgacctcaggtgactcccctgcctcagcctcccaaagtgctgggattataggtgtgagccaatgtgcccagccgggtctggttttttatgcatgttttagctgtaatgcccttgtccttccaaagagctatagtcacagaaaggctgggataataacccaacatcttacaccaagtgtggttgagatagaaatcccagagatcatgtgatcgttaagaaatgttacaggtagtgcttgttcattcttccgggtatctcttgtgtggtttgcatagctgcctagcagttcaacatttggatttgccattatgtagcaataatgcagtggtaggctccttgctgttaatgctttgtggatttttctgtaacttgtaaataagttagcagatttagtcattttgcgaggcagcaagtggaaacaactaaaactgtttggtgtcccattttgattagcgctgtgtcatctgcctcccacttaaggggttgtccctcttttctctattgaaggaaaatgctagtttggatataagagtaaatcctaacgtgcaatgattctaaattagactcttactaaatgttctaactaggacatgtttgaatcagtgataatttcaataggggttcatgctatttttccattactttttaaaaaatgacaaaagtaacttggaaatgaaaatagcatgtagataaatatataaagtaaaatgtgaaagtcctccttcctctccccccttcaaactcacttcccagaaataactgcagaaaagctgtgcatgtatctagatattttcctgtttctataaagatactcttatgaaggtattttacattagaaatttagatgagaaaagtggtgtcttgccaaacacacagttctgagacatgttggtttcactcaaccatcttacaacctggctggacatggtggctcacacctgtaatcccagcactttgggagccaaggcgagaggatcactcaagccaaggagttcaagaccagcccgggcaacaaagtgagacccccatctctaaacaaaacaaaacagcaaaaacaaaaacaaaaacaaaaaaccccaatcgtttgtttggctgggtgcggtagctcatgcctgtaatctcagcactttggaaggccagatcacttgaacccaggagttggagaccagcctaggcaacatggcgaaactctgtctgtagagaaaacacaaaaactatcgaagattggtggcattcacctgtactcccagctacttgggaggctgaggtgggcagattgcttgagcctaggaggtcaaggctgcagtgagctgcaatcgtgccatcttatttcactccattgcttctgtgcagtatggatatgtcacataactttttagtcaatgttgaatattatattcgcccctctaggtttttaccatacacagtgcaattgcgttgtagaacaatacaattgagaacaattgtattatatttattatataaataatgttatatgttattatatataatatatattattatgtataacaattgtattattctctctgtattttaaaatttattttcttcatgacttatgggatgtacaggctctgggctcagcatcttgcacggaggtggtggatgctatgaggataacgctgctgggaatactggctgcaggtcatatctgagagcagaactcagtgttttatttagtttatttctcccgaggtggatggagcaccccaatcctctcattacagtcctttggcagagccaaacctggaagcatccccaatcccagaaaatctgtctagtttttactttgaaatgctgtccctctccttctggaattaggttatattgtctgtttacctggtaagtaattaaaatctcagtttcagcactttataattaactaaagggaaaaaataactccagcatgactttctattctggggggttcagtaaacaccattgtgattcgctaacgccccttaggaagatcactaatagctataaacgaaacagaccattaagctgagaacagaggtctccgggcagttgcagtctactgatttgctgattattgctggatgtttatgtgactatgtgcagttcaaacccctgtgagtgggtgaaacatgaggctgtctccggccggttgtccaggatgtgggttctaaggcaaaatttctggattctcgtcattctcttttcctctattttattctgtattttacttctggcctcagcattcctgttcccccaaatctgtgctgctcccttgtgctttacttctgtcttgtgaagatgtggataatggtctgctggactcatcacgtgctcgtgctgttcacccgttggtagtttggctgcgttgggtggtggcctcggctccctcggacctctagagccctgttgatgccgttactactcctacaagcctatggcttatgccttagggtggtgcaattttttttttaaattatactttacgttctagggtacatgtgcacaatgtgcaggtttgttacatatgtatacatgtgccatgctggtgtgctgcacccattaactcatcattaacattaggtatttctcctaatgctatccctcctccctccccccactccacgacaggcccctgtgtgtgatgttccccatcctgtgtccaagcgttctcattgttcaattcccacctatgagtgagaacatgcrgtgtttggttttctgtattttttgtaagtgcttcgtaaaaacattctgggccagggaaatgaagagatttttagtttgcgacttgtagagtgaaaagaaagaatttgaatgagttacaaatgaccttttcaggaattgttgcccgggcctttcttcaactgcccactaactccggcacttcaataaacccccttttttagaggcatttagaagggctgtgacaagtgtatttacagcagataaatttagctcatgtattttatctacataatctgattgtaatttatatatcttcagcctagataaaggaaatctatttcttattaccaaatttttctttttgtcaacatgacgtgagtaggatattgactttaactgaagggtggtgattaatcatagcagcttgcagggagatcatttattgctctgtgtagctgagcgactgctggcagagttgtaagtcaatcaagataaacccaagtgggttagtcactcttggatgacgatggaggatgtgatagatttattagccaagttctcctttaaaaatcactttacattcttagcaggtgaatttgcagatagaaaaataccgagtcgccgtcaatggaagaatctgttagtttgcaaagtagagtatagctgttgaaatgtcacaatgaaagatggactacctagagatagccattggaaatgtttagctctagattaatcttgttaagttcaaagagggcaattatgttcttagtaattcaggtgctcsatagactgggaagaagagatttgttctgtgtacaattacatggattgtataatgggacrtcttaagatttagaatgaaacagtttgttttttttttaggggaaactttgtaattgtaaccctggctgacagtttagtttgttttgttttattttgtttttgttttgttttttttttttttttttgagatggagtttctcttgttgcctaggctagagtgcaatagcacgatcttggctcactgcaacctctgcctcccgggttcaagcgattctcctgcctcagcctcctgagtagctgggattacaggcgtccgccaccatgcccagttaattttttgtatttttagtagagatggggtttcaccaggttggccaggctggtctcgaactcctgacctcaggcgatccgcccaccttggcctcccagagtgctgggattacaagcatgagccaccgcgtctagccctggctgacattttttgcacacgaagcctttttttcaaacctgcctgtttcctctatggagctagcatgtagtcagaaaatgcacagcarcttcatatgagccttagcaaaagaaaattctgaagaagatccatttaggaagaggaaaaatcagacagactttgccaaaagtaaatgtcagtgattcctgagttacccacccctttcatcaatttcatcactgtttttcctcattagaacagatagagaatggactactgtattaaaatgtttagatgtaccctttatcactgtctgtttctttcattgcttgaggaggtaggacagaaacaaagttcacctttcagctcaggaaggtaagtgccttgggcacggggtgcactaaccgtggcatgagatcccagcagttggaatcggcatcttgggacatggagttctcagcgcctggcattcatgcccggttttgcaccttgttctggtttgggcatttcccctctggcgtgggacagcatgatgtgtccttgtcggagaggtctttctgtgtaccgaatcaacatgtgacatttggctagacagcatcaagttaatatagatgtttgaaactgttcaccaggtgctctctctaaaccagtggttcccaactaaggaggattttgttccccaggttatatttggcaatatctggagacaagttttgttgccacaactggaggcagtattattggcattagtgtgtaggacccggggtactgctaaacatctgcagaatacagcgctgtcccctacaacacagagtgatgtggtccagagtgtcaatagtgctgatactattaaaaaaccctggtctagactggagccatctctgggcttactaagggcatatttaggtcttttggtctttactggtttttctggctgaattgtctttggtttttcattgttacagacacccacctcctcctcctcctttcttgaaaggattattatggatgtaagaggctatgcgtaggacatttactgaattactattttaacatgagagtaaggcgagcatatatgttcccttataaaaatgtagtagggtaagtaacaagggcaggttcagggtgcctcagtagctgctgcgacaggtcagcacatctcagggcctgatgctgtgatgtttaattttgttgatcctgtcacagtccaatgtgagggacagacagcttttcctatacacccccgttccatgtgccagctatcttctatcctggggccctgccatctttgtcaggcctcgtcctcctctgcattcagctggagataggaaagaaagagcttggagaaagcacagcttcacttttcacgggtgagaatcagccctgtggctttaactgagaggcagcagacctggacaatgtgtacctggctgatgagaccatcaatctctgacatggattatgtgaacagatattggtcagtccacaaatgtttacacagccgcttcataacagtgacaaagaccgacgtcttgctccagcattcaggcaggagaaggtcccccttccttgcaggaataaggttagccctttgttctatgcagttcttcaactgattagatgaggtctatccacatgacggagggctgtccactttactcagtctacaatttcaaatgttagcctctttcggaaacaccctcgcggatgcacccagaataatgtttggccaaatatctgggcacctcgtggtccagtcaagttgacacataaaattaactgtcatgaccattgaacttgaggatcctttcacatgttttctagccatttggatatccatttctgggaagtgcgtaagtgtctttgctcatttttcttctttctactggtctgtagttctttattgatccggcattagttatgtgttgcagaatcagttgattgtttactgtgcaggcttctgtagtgtgagagagttcatgtgtaactggtaagtacagcattcatgtctgcataatgtaaaagtgggcccactttcccggtagcttccccagcacgttaatgttttacatcaagtaatagccgctgatcaccagctaccttagcacagctgaaatgagagagctgcaggggagccaggactatcacattgccattcaccttacattctttctgttggtgaccttgggtcatgtgctttttcttggaagttttatgtccccatctccagcatccttggacatttgtccttggccccattaatgtagcattttcaacccttccttatatttctctccatcaagtgacctccacctttcaattttttttttaaggaaaaggtctaaatttattgtagtatttattaggtatgtaacatgccttttaataggtgctaaatttttgttgttgtttgtttgttttttgagatggggtctctctctccatcgctctggagagtgcagtggtgcaattatagctcattgcagcctctacttcctgggctgaaaatgatcctatggcatcagcctctcaagaagctgggactagaggcgtgtaccaccaggcctggctaatttaaaaaaaatgtttttatagagatggagtcttgctctgttgcctgggctggtctcaaactcctggactgaaggagtccttctgcttcagcctcctgagtctcaggcactataggcacgagctgctgcacctggcttacatgctaatgttatggtgaggatgttaggattattactatttttgtaagttatgtggctttgagaattcttccctaaacyttagttttmataagctgtcttattttcagcactcatatttgcaaaatgggacacttttcaggaacagatatgtgatattatagcagaaattcttgcttttaatagtttgtggcttgtagttttctttttaatgacttcttagtggatggaaattcttaattttactaagctgattttattgatcttttatgctttctgtgtctccagtaagaaatcttttcctcttccacatggatagcaaaaatgtattctatattcttgttctccaacagctttgtagttttgcctttcccatgtaagtccttagttcaactggaattgattttcaggcagtgcatatagcagaagactaatttcttttttctccatacggataaaccagttgtcctagaactatttatcagagagtctgttctccccctactgatgtatggagccagttctaaccattaattggatttgtctatttgtttgacttctctatttcatttcactagtttgtctagtctctttatctatactgtatctttaaagttgtttatgtatgactgcttttgtcatctgtatggcagggtccctagtttgttggtgttcttgaagagtgttttggctctccttgggacactttacttccatataatttttagaattgggttatctagttctacaaaagaaatctgttgggatttggattggaatagggtcgactaaatcgttttaaggaaaatgtacatctttataatactgagttctctaatccatgaacatggtatgtatttcctttgtttacatcttcttttatgtatttttataaaacattgtagttttctgtgtaatagttttctaccttttagaagatttattcttatatattctatgtgttttgaagcttatgtaaatggtatcttttaaaatttatatttttctaagtgctgtttgcatgaatatttttgtatcaatagtgagacttaaaggacattttgccctaaggtatgccatattttctaccccatggttatcagggatgctttggcatgaggatggtggcttggtaattttagctgtttcctctctccccatatgcaatgtaaatgacatgcatttttaacttcagccagtatagtaacacacttattgataatctagaagttgctagcattgcacagagcatcctggagtagggacaatgttttctcttttcctctttgtcatttgtcatatcattttctctttccttcctcttttttttycccccttttcttggcttcatcttctgtatcattttttttttagttgctatttgtggcatatattatatttgtagatgattattattaattcttttaaagcatccttgatttgatgaattatagatattatctgatccattgtatcctactcttagaatacctgcttcttctggaaactctacagcgggggttagcgaactttttctgtaaaaggccacagagtaaatattttgggctttgtgggccatctggttcctgttgccgctactcagttcactgttgtggcacgagagcagccgtgagcaatacataaatgaatgacgtggctgtgctccaataaactttatttacggacacaaaaatttgaatttcatataattttcatatgtcatgaaatattgacttttccaaccatttaaaaatgtgaaaaacactcttggcttctgagccttgcaaacacaggcaagtgccgggggtgggtggagtttggcctgaaagccacgcacagttcactgaagcctgccggagagcactctgtgtgtgcctctaactgaagactgactccacacacttgtcattgactggggcatggttaatggcttctttttgacccctatgaacataaattgaatctttgcaacattaaggtacaggtatggcttaatgaaaggctgcctttctaagtcagttggaaaacgagtccattttaagttgatctgaaatacttagagtttagtaaataaatgagctatatcaaatatgtgtaacactgaaggctaatttctttcagactctgctttgaatcgtgttccagtaattggggcaacccatagagatggttttgttttacttccccacactgttcctgctgtgttctgaatgaggaaagagggatttggaaaggttaagtgatttcactggagtcacaaaacgtgcagaaattggaacataaccagttcagtccagtgccatttctacttttgtcgccttgcctctcctgcattcttctagaaaatttgagtctcccgaaagggtagacctktgctaagtcaatggtgcagtattgataaggctgccccagactgccagttaggtatctggttttcccgttgatttcactctgtctggatgatcttccttcctggctagacagggatcaattttcctgtttccttgcatcatgcctaccataatggtgcaatttattttcttgttcaatgcttgctgaatactacgcaagtcagagacagcttgctagggggctggaggtgggcccaataaaatatcatccctgtttctcacaggagtttataatatagtggaggacccacaggtacttaattaatgacaggatacaggaactcggggagggagacactgctgagttattgttcatgtatggaaaaagcttctgtaaaagaacctaaatatcatttatagaatctagcacactggcttcaatgctgatagcctgtcatttaatcatcatgccaagtactttgcacgtggaaagaagacgattgcaggtgatgtcgcctccctaattgtaggttgatccttgaaggtttatttttgagattcagtaattacccgagtaagcagcatgggtagaatttttttgcaatgccttttttcacagttttgctaaaagaacttccactttaatactttactaatgaacacaggcgctctttctgtagaaggagagggactctgagctaggagctgatgctcctgttgtcactcctgaaaagaaaagggaggaagataactctgttggtcctcctgccatgctgtttctggagcctgtcctcccaggggtgcaactgtcctgtttcttctcacgtaattaggaggtgactgacatggagagctgtctcctttaggcacagggtgggacctgtcttattccaaatgtagatttagtagtactttggtacccggtggtgtttgtccctcttctctgtccagacaagagatttccttctcctttcctgaatttgtttttgacatgaatctttggagttagaatttctctctctgatggacggcatcgataggatatttaggcatagttaaatcgtattcagtatatttcatatctgtaaagtctaagggcctggacagccattcctcactgagctattgctgttactcaaatgagtttgggagttctgacactgatttgttaaaggtcccttggaacataacccgtttgttaagttagggactccttgtaaccatattgagaaaaccaagccccttagtacgtgtattagtccattttcactctgctatgaagaaagacccaagactgggtaatttgtatataaaaaaagaggtttaatggactcacagttccacatggctggggaggcctcacaatcatggcggaagtcaaaggggaacaaaggtatgtcttgtatggtgacgggcaagagagtgtgtgcaggggaactcccctttatgaaaccatcagatctggtgagacttactccctgtcacaagaacagcatgggaaagacccaccccacgattcagttacctcccrgtgggtccctcccaagacacaagtgaattgtgggagctacagttcaagatgagatttgggtggggacatagccaaaccatgtcagtgagtgatttgcttgggttcattctgtttctctgctccctgtgctgaagacccatctccgtggcccacctcgcccatgcagagagcacttcatttatcgtgggctcctgcctttcggccagcaccttctgtcgggtgtcgcaggatccttagtaacatgcaggaagggaaatgagaggaaagaacaatgaaataatctttgatcttctccactccatgtaacctaactttttatgtggtcaagcaagataagctcctatctggcataaatatgtgtgactacatttatatccctgcttacaaaatcattctaaaatggtaatgaaatattgcttctccctttctcttccggcagaaaatattctaaagaaataagaattttgatgaggagtggttattgaaaggggcatttcggactggttttaaatctcagtaatttattttattggggttattgaaatactggatatactgacagaaatcatcaagagcttatggttattggataagtgaactctaggttgtggttatatttagtgtctaaataaggccctattttattacaccaccctttctttctctttttctgtctctctgtctctctctctctctctttttagtctcrgattaccccatctttccgtggtggaaagaataatggttgcaaagtgagtaggaaatttatttctctgtactcatctggcatgaattgtttgctctacataaattgatgaattactgcttctaaggctgacataatagtttttgttttgttaaacaactataaatttcatctaatacagtcttagtgttaacaggaagaaaaccataagttaatatctgctacatttcattgcttaaaaataattgctagtagtaaagcttcatttttcacaaacataatttgatctcaggtaattgatagaagaagaattcagggaatttgttcagggtctgtttacaactgactttttcaagaactgccacatgcaataatccaaatgcattctggttatgaaataaagcaggcagaacttacagtcagcctcagaatgacttattgacagctacaggtgcagcatttttttttttaacattgtaacccttttgcaaagtttttattgaaatgttttatgatatagtgtttttgatttgtctatttgaagaatcatagaagacaaaaccttaggaactttacttattctaaatttcctgttctgttattgataagaaagaaaaagagagagagagtgagggagtcagttattcaaatacacctcctttcattcctactggtgcttacaaaccaaatgcagcttgtattttaggcgcggggactcctcagctccacctaaactgaggagggaaaggtatgtcataatttttgttctttctcaacagttttcctttaataacaacctgatttatgatgttgaatcatgatcctcgcactttggaatgctccttgtaatcaatcacttttactagaccttctttctcataaaaacaagaatcaagccagttaattgcccaggcatgcatctctgcttacagaatagtcatggaaaccctggcttgtcatgtttaggaacttcccctgggttatgccaagggtcaagggttgatgtcacagccacgtttggagctgtgagctcccactctgctcctcagcatgtggagtgacatttattctctttgtggctaactagttaatgtgaatccccacagcattgctattgaagcaaataccatgactggggtaatagtaacattttgaagatgaattcagactataagaactgagtttgttgctgaaatatttcaactacatgagagaagagggagggtgccttgtcttattagcaaacaagtaactatctggttgtaggttgtacagggactttggcaaaaaaggagggaagctgaggacacaggcacgaagatttaggttggaattaagagggcattttccgcaagtggagaaaggaaagcgagttatcaaggtaggtcatggaattaccttgccagaggatttgtgttgttttctggtagttttctgttgttatctggttggaattgtggacctatgactgggaccatattgaggcttatgacggtctctgtgcttcccccagtccacacctcccctgtcccttggggtcagtggaggttctagtctgcataactatgctggattagctcctgaggtctcccagcccaaaacggttttttaaaaaattctacaccagtggttttttttccccttcgatagtctagagccacgcagttctcctcccttttctttcagcagcaccaggaaaggctggaatggggactcctagcatctgtagagaggcgtggctctcatactaggtgacttctggggagcccatgtcaagaaataccagtttctgcgtttcagaatagtaaatggcccaacttggagctgcagctcctccctctcattgcagtctctggtttgtcctgtggaggcagcggagatgcccctggctggtgttccgcgaatttgccggccccggggacctgcccccactgtctcagtggaaagtgtgccactaactgccgatggctgagtgtgcagatacagcccaggccccttcaggcctgtgggcctccgtgcctggactttgttctagtccctcccgggtttcctccgctgtctcatgagttcgggctttcttcattcctcacttgatgattggaagagctgcttgacccatcagcgtttctgtggcatctctcctttcaaaacgatccctgtagagggactggcaactagtccatagtgtcttgctagttactagtgtctcacgctgatttgcacatgacataaagacgctaataactgcctcatgctgatttgcacatgacgttctttatgctgactattcccttccccgagactttcagtgaaggaacttctgttcgttgcaggcatggttctcaactgcctccatcgggaagcatcctggccctggtgccagggcttccacggtatctggggtttactccttccttcactgagttacctgcttacattcctgttttccatatgaaactccttgaacataaggactgtgtcttaatgatctttattttctctccaatatctggacttttgtacgacacaaaggaaaacagtcagcctgtgtgttttcagtagaagcaatttatcatctttctaactgtataatgctaaattccaaacagtctaagcagctctcttggagtttgcagctaatgacagaaatagtacagaaagtcatttaacctttaatccagtgctctaactcactaaatataaaacattcttaaaaatacatttgtgcatttgccaattgtttattagatttctgctcagtgccagagacgatgctgggcctggaggagaaagtttgaacaagagtaatgcttttccatcctcacagaatgcagtgggctgtcagaagcggtagggaacagctgggcagatactgtgatgtgtgacatacaccacatgggagggaaattcccgggctgggtgggcaggggttgaggaggatgttctaaagtatgtgtgaagggggcagtgtgaactgcaggcacactgaatgagaagcctgagggttgaccaggaatgttgtcaaaagactaccttggaagttggagtgaacgactcagccccatgaaatgagagtgggagtctgtcatccatctgtggcagatactccctaggatatttgttactcagtgtgagtgtagcctgcttagtctcttttaatttttatttgttctttatttcttaaaaaaaaaaaaagctggatacatgtgcagaacgtgcaggtttgttacataggttatgtgtgccatggtggtttgctgtacctgttgacctgtcctcttaagtttcctccgttccccctccactccccatcccccagcaggccctggtgtgtgatgttctcctctctgtgtccatgtgttctcaatcttcaactcccacttacgagtgagaacatgtgatgtttggttttctgtttctgtgttagttttctgaggatgatgacttccagcttcatccatgtccctgcaaaggatatgatcttattccttttcatggctgcatagtattcattcctttttatggctgcatggtgtatatgtgccacattttccttattgagtctaccattgatgggtatttgggttggctccatgtcttcgctatagtaaatactgctgcaataaacatatgtgtgcatgtgtctttaaagtagaatgatttatattccttagtagaatgatttatattcctttgggtatataaatcattctactataaagacacatgcacacatatgtttaatatataaataaatgggattgctgggtcaaatgatatttctggttctagatctttgaggaatcgccatactgtcttccacaatggttgaactaatttacactcccaccaacagcgtaaaagcgttcctgtttctccacagcctcgccagcatctattgtttcctgactttttaataatcaccattctgactggcatgagatggtatctcattatggttttgatttgcatttctctgatgatcagcgatgttgagcttttttaaatatctttgttggccacgtaaatgtctgcttttgagaagtgtctgttcatatcctttgccaactttttgatggggttgtttttttcttgtaaatatgtttacgttccttataaattctggatattagccctttgtcagacgggtagattgcaaaaattttctcccattttgtaggttgcctctttactcttatgatagtttattttgctgtgcagaagctctttagtttaattagaacctatttgtcaattttggctttcgttgcaattgcttttggctttttygtcatgaagtccttgcccatacctgtgtcttgaatagtattgcctaggttttcttccggggtttttatggttttagaataagtgtcatgtggcactgagaagaatgtatattctgttgatttgggctaatttttgtattttgtagtagagatggggtttcgccatgttggccaggctgctttcgaattcttgaactcaggtaatccacccgccttggcctcccaaagtgctggggttacagatgtgagccaccatgascagcccaaagctacattttaatgtaataatattttctatgcagtagttgttcgtaatcctttcagggtcatggtgctctttgagaatttgatgaatccaatgaagcttcttggaagaggtcttagacccacacacacagacacacatatacacacacacacacgaacacacacatatgcacacacacatatacacatacatacatacacacatacatacgcacatatgcacacacatatgcaagtacacgtatacacatgcacatacgcacatacatacacacatatacatacacatgcatgcacatagacgcacatacagacatatgcatacacactcacacatatttcacagccttgtatttcattgtatgggctcataatccctggggygtccatcccagacctgttgatgagttaagaacctttggtttagaggaggcaataactggtcagactgagacttcaggaataggcctgtccggagctagggaactggcctggctgttgggcttttgggtaagtgacattccagcagttcacatgtggtgacccaggatggagagtctgagcatcagttggactagatcacgtgcacagggtggaggtctcagtctgtctagggggtgctcagtacagtgagtggacgtcatggtcagggtttggagcgagactcgaaggagaagctgcaagtacagagtgtgttgaccattcttctgctccctggacataccctgcagaggctggctgttaggggaatcccaagagacaggatctctccagttgcttggaattccaattattttctgatccaaaaatctagcactcattggtgaaggacaagctgcgagggcctctgggtgctgggcgagcagccaacagcagcacgaccacctccaggcctcacctgcgagccccagtgatggtggattctgcctttgggcaaaagtgagagccccctgagtggagaatgtgcatcagcccgtggtgctcccactgtggaggtggtgggggtgctgataacagggagggcgtgggaggcagacacggattgcagatactatcctcaggtatacaggtgtcgaggccacattttcacccaggtcacactcttgcgtgtgctgaatgtgtgtgtcgtcgtgaagtgaaaatttatagcgaatttataatttaacactgaattcagttttctcttcctatttgaagcaattacatgactttgataactgtttagcttttgtttcaaaattttaaaatgtagcattaaggaaaatctctccaactagttttttaaattgccttgtttctctgcagtagctcatcagagtggttggggtcattttacccccacccgtgatggcctcctcatcctcctcctgcttctcctccccctcccattcgccctttccctccttttctctctccctcttttcctttatttagctctgagcccctgcccagccctgtgctgagaaccttcttgtgcatggttatttcacttagtgttcaggaggccctaccaggtggtccagctagtaggcttgttttacaagtgaggaaacacacctggagaggttaggcagcttttctgatgtcacacagccaatgtggttgtagctgggactccaacccaggtagtgccatctggagcctgccatttcctgtgttttgcagctttctcagtgagtgcaaggccagctcagtcttccttctgtgcactctcaaaggcatggcctgcaagagctgtctgatgactgattcattgctgttttcccttttctaggagtgtttttattctttttgcctgctgaacctttagaaaagtaacggtagggcaatgtgttaggattctccaaagaagtagaaccaatagaatgtgtgtatatatagatactctcatgactgtggaggtgtggtgagtctgagctctgactgggcaggccagcaggcaggggactcagggaagagttgcagttccagtccaaggccgtctgctttagacccaggaagagccgctgctgtgatggaacctgcaggccgcctgctggaggattccctcttgctcaggggaggtcagtcttttgttgtagccaggccttcaactgattgggtgaggcccacccacgtcagggaggacggcctgctttactcaaagcccagcaattaaaatgttaatctcacccaaaatcaccctyccagaaaaatccgragtcgcattcaaccacatatctgggcactgtggcccaggcaaggtgacataaaattaaccatcacagacagcaacctaaatactgttgaacaagaggccaactcattttgtcagatacctaagggcatgttaatgtaaactttctgcaagtttgtctctttctcatagacctaacgggaatattgggaaaaatttgaatggaagttcttttgcttcaggaaagaaagtaactttacaggaagaagcaagtcaagtatgaaaaatagagtgagacctaggagaataaaatctttaacaagcaagtgtcttattccattgaacttagagccctggacctgtgtgatatgtcaattcagtcttgacagtttttctgcagagggagctaataaaaagaactgtaagaattagttttttttctttttagtggagaatggaagaaaagtggctgactctttggaaggtaattctttaaaagcaggaaaatgtttaaagcaggagcagtaacatctgtgaaagtgagctattggcagctagagaaggactggagaaaatgggcaagaatgagagattccatattttattgggtaaaattctttagccagtgaacagtgacaaggtgttaaatttcatctgatagttttagaggttatttatcttgtagacttttaaagataccttgcagagtggtgtgagttgtgtgctttgagaaagtcgtaaatggtttccatctctgtggcatttctttagcaaatcctggttgtttctagtgctaagatcttcttgggaacttcagagaaagcgttaggtcttttgggattaaagtcctgttgtgtagtacctgaattttctttcatctctgagtgtttcccttgtctgaaatgaacagtattggtgttacctaaggggctaatcatacagcagagaactccagaaaaatattaactgagtgtctttaccacacaagatactaagtgccaaaacacttaaatggactgatacctggctttctaggttacacatgctgaaacgaacactgaaagtgataattcacttatgtaagcagttacaaactatgcaaatacaaaaaaataaaaaataaaaagaaatggcagtacatttgtgaatgcttgtggtgtgctgttagttgtattttagtgaaaggtctgtgcaatgaatattatggtaacagtcgctcttaatctgaattcagcaagttgtatgtcatcaaaagattagtgaaacagacacaattcctaaagccgtctaagtctgccagtctttccttcctgtgacacaagttcgtctgtggcctacaagttgttggaggtgtaacctattatttgttggccagttgttggaggtgttgggtgtgtggttttggacacagtgggcatgggtggtcccagtctcctggagtggacagccagacgaataccgtagacacaggaacacaaacatgttggagcgttcgtcgtatttctgggggttgcagctttgtctcagtttgctgtggctgaaccaaggaaaaaggcagatgcagacttctacaagaattataattctatggaagattttgaggagatgaggaaggctagcatctttcaggatgcaatgtaattttggaatataaggaatttatttgggttgaattacctagaagtttgtcactgacctgtgtttctgaaccatgaagcatagatatgtgggctaacaaatagtttctcttgataaataaactgttaacaagtatatataaaaaagagtctatagagaaatgtatacaggggatgtgaatagggagttcccagaagggaaacctgaattgtcatagtgtaatgatactaaacagcactgatgatgagtaaaacaaaaaagcaaaggaaaaagacagtttcatatgcttcagattagtgaaaatttaagaagtctgattatataaaatgctcccaaggacggagagcactggggatgatgaggttgtaagaatgactttggagagcagtttgccaataactaggaagtcctttgctgttctgcacctaggaattaattttagagtaacaatattacaaaaattaaccatcagaattaattttagagtaacagtgttacaaaaattaaccatcagaattaattttatagtaacagtgttagaaaaattaggagtctcatgtcagatttcacctcacttgtcctatcagcagcatttgacaagattgattattccttccttcttgaaatatttgtattacttggaaatagatgtagctgggcacatggctgtccagatagagtctagatacttgtacaatgcaaggtgggttctgcccagtcctactgttacatgctagggtcagagataaattctacaacatcatatattacaggtttaggatgaggtttcactggaggaaggtgagatgtacatggaccaagggtttacgtctcatccttttatcccatacagatgcactgggtgagttggcgtgctttttattggaaggatccttccattttgtgggtttcctttcttgtaagcatagaaaacagccatgatattaggggataagcagtaattacagtaccttcccccaccctagcagtggggaagtacatatttcatggggaacctgaatgaatgtgggttcagtacctccagctgggctctgtcctagctcactgctccagaggactcctggggtccctttgggacgtacctcctattgtactatgagatgtggccatgtccagcgaggaagtgatgtctgtgatatacatcactgatacacatcagcgtaactgatgagatggaaattgttcatctttgcttacgttctttccctctttccatgggctgggatgtgctgaaccatctgtttccctgccctcacttagagcagagtgacaggattgaaagaccctgggttcctaacatatcttgggaagcagagctctgtgtcaccctatatcacctgccttggatgagagagagagagagggagagaaagagagagagagaaagagaaagagagaggaactttgactgtgcttgcacctctgtggctgtgttttkgggtctctttattatgcagtctagctgtgatgcagtatctcatagtcatcttaatgatcttaacgactatgagggccagtggagcttgcccttggtatttgcatcccttgaatctgcctcatctcagtaaagggcaactccattcttcaagtgcttgggccagaaagcctcagggacatttctgtgttctacttctcttgtagcccatcagcgaatcccattagctttaccttcacattaaaaaaaaatactttgaccaggcacagtggctcacacttgtaatcccagcactttgggaggccgaggcaggcagatcacctgaagtcaggagttcaagaccagcctggccaacatggtgaaacccggtgtcttctaaaaatacaaaaattagctggatgtggtagggcgtgcctgtagtcccagctactcgggaagctgaggctggagatggtggtgggtgcctgtaatcccagctgcttgggaggctgaggtaggagaatcgcttgaacccaggaggtggaggttgcagtgagtcgagatcgcgccactgcattccagacagagtgagactcctttcaccctaatgtcatcactgtgatagggctgtgtcatttgcttccaagaattcttagataatgtctttgttaaatcctattctttttttttgagacggagccttgctctgtcacccagcctggagtacagtggcacgatctcggctcactgcatccttccaggttcaagcaattctcctgcctcagccttcctagtagctggtactacaggcacctgccaccatgcccggctaatttttctatttttagtagagacgggtcttgaactcctggccttaggtgatccgcccgcctcagcctcctaaagtgctgggattacaggcatgagccatcgcaccccacctaaatcttattctttacaacaaaatgatactatttcttttcttaatcatagaagtgtatttttacaactgaaagagtctttgaaaggttgaaatgaaacttgtcctccaacaatctttatatgacaggtactaagggatgtgtgtgtgtgtaagtgtaatttttctgacattctttacaagttatatcttcatctgggttacattcattattaaagacagcaatacttttatctatgtgtttgaacctcagtagtaggtagcactaggaacttgtcaatcctgttgaatcattttatgatctatctttttgtttgtaggaacaatctaatttgaaccttatatgaaaaattaatgtaggttctcctttacaaatctccaagggaaagaactctgtcatctttttttcttaatagtaagagcaggtgcttccatttatcattcaaggtgtactgttgcctccttttttctttagcaaagtcagtgttaaaaaaggcttcccctgagaagtcaaaggctgctacctgacatctggttgagaaggctcggttctcttgtgagctgggaggagtttcagtggattaagcactcttatttayctctttttcctccagagaccccattaaaatggtagggaaaaataaaaagtacatatatcaacaacacaaagaacttaaaggccaccagcatggaaaagggattttacaatgtttctggcagcctgcaagctgataaggctatgtgactactaaattagtgtgggggctgcagctggggaggctcaccttggagactgaatgctgggtgggtaggagtcccacgtggggctgaaaatcacagggttccatgggatgcctatagtcagatcacttcacggattctctccttcttccacccctgccgtgggtacaaccaaggactagaaaccatatatttatccctctgcctcatctctgaagaaatggactgaattgtctggggagaacccctgttgctagtttggaaggcggcttcttagaaggggaattactcccatgcccactctctgagtcagacccgtctgcccaggacaccagcctctccaaggtttctgttgtttcatatttaagtatgatgcatgagcattgttggccagatattccaggaaagcttctgatcaaagagggcaggatgagatgaagaaacaacaaaacagcccccaggaatcagagaggacccggggaataggggaggagaaccctattccgtaatgagaggttttgaaaaggtcatcttgttaaagaaaacgttttagaaggaaggaactaccaaaagcaagaaagaaacattgcaaacgaaaactgtgacccatggaatgaattcaaagaagcattgattggaagtaagttcagaaaattgcccagaaagacaacaaaaaatgaaataccctgtgtgtttaaatgctagcacatagggatgggactcaaactcccttcctgtgggctagagtgtgagtgaaaatggcctttctcttcattgtaattactctccccatctctcagagaatgggtaggcctggggcagctggtctcagcagacctgtctgttctcctgtgatgtgggaaggcattgaggagcctaggctgacagtgcttgtcctcctgaccccagcatgggtctccttgttcatcatctgcctgcatgggcagccctgaccaagggctttatactcacagcccggtctacacaggtcacgtccctgagaggtgacccggctttggactctatgtggatgtgcacttgatggggcttgaaatccaacattagtggtattttcccaaattctgaaaaagtgatgctaatcttctgcctttatatgggactcaatttgtagatagcttgctttctttttctttttttacagacatggtcttactctgttacccaggctggagtgtagtggtgtgatcatagcccactgcagcttcgaactcctgggctcacaccattctcctgcctcagcctcccaagcagctgggactacagccacccactaccatgcccagctaagttaaaaaaaaaattgtagagatggggtcttgctgtgttacccaggatggtcttgaacttctggcctcaagagatcctcctgcctcagcctcccaaagtgttgggattacaggtgtgagccaccatgtccagctcggcagctttataatcctaataaagcatttgtgggatttgggtccatctttaaatgtcctcaagaagcatatgtgtgtgtaactcaaactcagaacttgagttctgaaacccaagttcatgattccttccttcactgtgatgtgggcacttctccaaagtgaggtattagtggaatggaacttggatttttaaaaggtgtagtggaatgcttatataatattataactaagtaaaaccttgaaaaaatgttcatgagaatgtggtagaagtttctttcttttttttttttttgtttcttatgactttctaggagtttgccttaatgagttgaaagcatgagcgatgattaccaagttgtgtgtaaaccttcctccacctgaaattgcagagtgtttttctccctgatcatttctttcctgtcgtagcgttcatctttgatgccgtagttgggcgcagggcaggttttgagtttcctgatgtttcatgtgtggattggtccttcaatttgaagaataagataatgatcatagacaaggatttggcttacagctgagagtgctgagttggagtcttggaagagagacgtgctgcagaataaagtttatagttttaaaatttctagttagaagtttaaatggtcacactgagcaatgccaattagcttccattgcagtgaattctaaggacttgcaaggcaacttttatttaccagaatttaactgaattaatcagtggttaaggtaactccatggtctaggaattgtaaattggttatacttagtttttattttatagcaatatttattgtaataggtttatggtacatttgaatattagagctttgagagctaaatgttaactgatatagtttttcttataaaattagcaagattcttgagaacgtttcttttctactttttaacctaaagtggtctgtatacgtttatggctttatagatacgtctaccatggagagcaattcatttaggtagtctgtggctcataaaagattgcttgagtcttgtgcagacacatataaaggaaagctataggacctctgggaacttgaggctcgcaagatgtaaatgtcagagccgtccctagagctcccttgctatgactttgaccgtttaaatttcagcattgtgcagtgacttcatagggtgcttgcatattttaaaaattttcacttaactgttaacttggattatacgcatgttagaaacaaccctgtggaaaatagagctttcttcccgtagtggatatagacgtctgtgttaggcacaggaccatttatcgctggattataataattgttcttcttttgtaatgggataggaaatgcatatttatggggtacagttgtatattttgtcctaatcttgaaacttatgtgagtcattttcatattatctccatcatgcctgcattttaaattactgatttatctgtttgcaaaagctttggagaatcagagaatctactggaaagactccatgtgagattgggctctgaacacctgggggcttgaggctgtttctagtttttttttttttttctgagacagtgtctcgctctgtcgcccaggctagagtgcagtggcacgatttcggctcagcctcccgagtagctgggatcacagatagctgccaccacacctggctcatttttctatttctagtggagatgggggggggggtttcaccatattggccaggctgatcttgaactcctgaccttgtgatccacccgccttggcctcccaaagtgctgggattgcaggtgtgagccaccgcacctggccgctgtttctaatttttttccgtgaacttggtcaagagttaatgacgaagaagcacctgttagcatagttaggaggaacaaaacagggtgaatgaaaggtctttgtaaagcataaaatgagtccagattttagttcatttggcttgtatatcttgttttcgtctcagtgaccctagacatgcaagagggccacttttaaaaagggtgtagcctttgaagaatgatgactacatctataacgaaggaagagaacacaagaacacagttttatgctcagcctcccaacgtgctgagcgtacaatatttttgtgtttgtatttccatgtgagtatgtataaaataaggaaggtgacattttgtttgagaaaaaatctagtgataaaagtggacaaacagatgagttattctttattataagcggggtgaggctgggacgttgccatataaggtaaagctggactcggccttgtttgcctgagttccgtgcatgttggttttgctcttggtgtgatgatcatccttgtgcgtgggcggatgttgactgagaggcacgttagtgatgaagcagcaggtccggccactgcttggcttgtatcttggtctccattctactggctgttctgtgaaagctcattggaagtttcaatctagaagtcatgggtatgaataatcaataaccagcagattaaaaagatatatgtaataatttagtatgtttataataaaacaagagctaatattaattggttggtgtgtacctgggttggttatattttatttgcatatgtctgtcctttagtccttagaacaccccttataagcaaaatatcattagcaacctggcaccctttgattggctagaaaagagtctaagagaaattgagtaaattattcaaagtcatgcatccagtgatggtggatcccccgttggggcccagatctgccccacacccttatggccaacttcccttttgtagtaattccactgctttaggtttgagccggaagggttgcatcaagcctttgaagaacctaaacaatgcacaaactacttgggtcttggaccttaaatgggggctgagtgaagtcctgggtggagcccgggctgcccacgtggagggctggctgtgatgggtggttcatctggggctagggtcttgctgtcatttatgctgactttgcacatccatctcttggtgccctgggaaggctcaggtccctcagggatgcaggtgtagcccagtggggcctttgaagatctgtagcttgggagacatgccaaagagatatgctttcctcaggtcttgggttctaagcacttgtagaatgttgccctccacagtctgatacttctttttcaaaagatgccttggccgggtgcggtggctcacgcctgtaatcccagcactttgggaggccgaggcgggtggatcacgaggtcaggagatcgagaccatcttggctaacacggtgaaaccccgtctctactaaaaatacaaaaaattagccgggcatggtggcgggtgcctgtagtcccagctactcgggaggctgaggcaggagaatggcgtgaacctgggaggcggagcttgcagtgagctgagatccgccactgcctccagcctgggtgaaagagcgagactctgtctcaaaaaaaaaaaaaaaaaaaaaagatgcctcaaatacattccttccttgttcagagggctgtcacccctattttgagtcctatcacttttctacttggataactgaaacagcctcagtttccctgcttttagactcttttctttccattcaaacccttatactgttgccagattcattttatacagagatgtcccatttgttaagcgtctatgttgacttcctgggtgtccatagtttattcctaccactcagtattatttcccagtgctgtgcgcttggagtgtgccctagtgtgaccatttgcagtgcagtcgtcccttgagatctgttgggggattggctccaggacccccaaggataccaaaatttgcagatgatcaagtctcgaacagaaaatagtatagttcacacataacctatgtacatctttctgcagaccttaaatcatctctggattacttatagtacctactacaatgtagatactatgtaaatagttgttacattggagtttttagggaataataagaaaaaaaagtgtacatgttcagtaaagatgcattttatttcatatatttttgatgctcagttgaattgaacccagggatggggaacccatggatatggaggggactacttattctccccatttctctatttctccatttcaccttcagtccacccctcttgttattttgtgcccatttctctgcaaattccttcttcttctgaaactgtataaactgttcatgtaattcggggcctggtttgattttcccacctggaaagcctttctctgatttccctagcctcactggtttctctctccttggaacctcctgaattgtacactttataatttctttgtggtttgtgaaaagtttctaaataggctgtaagacttcggattctttcatctccttggtgcccaagcatgtggtatgtgtcargttgctacttagagacacattttcagtctcagttttagtatttacttaagcatggtgatgaaagttaagaaaaacattgaaatcaaacctmcatggagaaaactgctgtgattttaagttgattggatactttgctgctgtgttgaagtgttttttttgttttgttttgtttttctttctcctttgtcttgccagcaatcaaagagaagtacacagactggacagaatttctcatacgtgacttgactggttcgaggacagcacccgccaacctcctggaaggtgtatgtattgttgttatacatctaatgtatctctgaagcaccccagttacgtgagctcagacctgacagcacctttgcatatatccttcagcagatgcgtgctttctgcagacactgccatccaaatagcctcccttcctcttttgtcctgaattacttaggtgactgatttgaatggcattgatgaaacttcccctgtgatgcaatcagcaaatggaaaatttgctctatgtgaatccaatttttaaatcacaatatgctaggatgtcttcctactgtcctatatctttaagcctctttcctatgtgagtgaatataaatcaaatcctgtagaatcactgttttgaacaggtgacaagatcatgtatgtgctaatatagtctcttggagtacattgataagtcgttccattaaatgttctattttgacgcataaccccaagatttgaacatacacacgttaaccaataattgaattaacttctcttgtaaaaacaagaggagaaatggcagatcgtatttcagtgtagccaaggaaattttaatgtattgaagaaaacatagtttaatctgaaatcttgatggtttatttgaaaataattttatgttgaaacatcttagtatgtatatgtagtatttgtatttgtataatggaacaggaagagaaaggcactgtgtcataagtaattattgaattacctagtctgtttttcttaagaatgcccctaaaaaggggaaaacttaatgaataacaagtaataaggtgtggattttgacagtatcatattctcttaaccttaaactttccctcttttcataaatgatattgacattttagaacgtcatagtctaatatagttaacgggttttgttttgtgaagattttgcctgatgtatttgttatatatcattagagatactattttaattgttcattaacaaatcaaaatgatgatagttcatcctttcaaaaggacaaattgtctcactatgttaattttctaaaacatatttgcctacaaagctggctgaacaaacacccttttcatatgctatcataggctaagaaggtttcttagaaggggcagtaattatacattctgtaaaccaattaccagcttaagtgtagaaataattttacatagtagtctaatttagctgatcattactgtgtgttagacatgtcattgacacacactcatgccttcgtcacataatcaaagtatgagagcattttggtcattagagtagcggccagtagagtaagatgaatgtctgggaaaccgtcatggtgtaaattgaatgctctgtattagaattatctgtctgttggaaaagtagaccgtttgctaccacgttttctaggtccaggcaaatttgggtagaactcttcttaaaagcatactgattgttaacaaaagcaattttatctgggaagggtgatttgtttggtgagaacttagcacaaactgttattttctattgacttgtgatttttttgttgttggatacggaatggggtacatggatgtgtgggagggaggaaagggaaggggtggggcatgggctgggcaaggatggggtggagggaacgccagactgttcgccagtaccttggatgatggtgtgaaaaaatattatcttctgctgtcatctgtttccatgagaaccttaaaataaagtttaaaataaggagttttgcttctgtttaaacagcctctgcgagggaaaggccctatagacctcattacagttggttccttaatagaacttcaggattcccagaacccttttcagtactggatagttagtgtgattgaaaatgttggaggaagattacgccttcgctatgtgggattggaggacactgaatcctatgaccagtggttgttttacttggattacagacttcgaccagttggttggtktcaagagaataaatacagaatggacccaccttcaggtaagggccaaagcttttgctgctgtaaagtattttagaaaaagatgtgatattttcctggatgtgtttctagaaaatgtatgagctttctggtatcttttatatctgagtatgtgaatattaagcactttaacttcacartgctttccatagagactaaaacctaagacctcaatcaatagtgttctcaaaggagaaagcaatgttagaggccttagggaaattgatctagttccttgggaatcactggttcagaaaggaaagacacagtagattgagacttgaggatattctccacgtttttctttaggaattttgatagtcttgtaagtaggttccgaaatctctggccatctgtgtacccatctctcagtctgtccattcaccaatccatccacctactcatccacccatctatccatttatctattcatccatccattcatccacctatccatccagcattcatctatttatctgaccatccattcatccatccatctaaatatccaaaccacaatccagtctgaccaagaagcagcattgagtagatagaccatcatgttttctcctggcatgtaagattttagttagcttcaaatgcactgtcaaatggctttgcagaggcttaattggaaagaatcctgccttatgctctctgtcatacctacctagttaaaaatcagcgtatttacaaaataaccattcttgaatgtttactatgtgccaggtgattttacatctggtacattgtttgttttgattctaaaaaaatgctgcatgtttgttgtgaatttcatttcacagtagagaaaattgagactggagttcagctagttgtccaaggtcccctgttttaagggacaggcagtgcaattcagattcccaggtgctgggcccctcccacccctcttaccggcctcctcttaccggcctttgaatgggaaacctcagaacagaaatactggattcttgtagaattagagatgccaaggaggaagtacgtattttttcagaaattggtgaatcttcattccggtgagttttgtagctgtatttggaataaggacatggctctttgctttattaaaatcaccagagaatttcctcccatattagttgccgatgttagtgttgagtacatgaaggagaggagttatatttatcttttctgtcactcagaggctctaattgaaaacacttcctggtcctgtgtcccgtgtgtttgcatttgcattaagtttgacaggcttagagacgcgtaatgtggtattttattagtattattgctgtcaaaatgttgagaagcagccaacacctccatctctatcctgagtaatttttgactctgatgacaaacaaagagcctgtcgtgttgtgaagaaggatgtaagcccgggtttgccctgggattcataacccagcaggaaaaatttactttgtgcgtaaagttgtgtgtatacatctctgcttagtatctaattgctttataaattttaggagcaatatctacttgccagtgtacaaatttacagcaaagcaaaggatgactagtggcttcttatgttctctgtgatgtttctttcctgggaagttatgggactcacrctcacgagcaggaatggaacatgcctccgtggaagcttaggaaatactcgcttatgagctgtctccctctttagataatttggggtctttataatatatgaataaattgtgtttacttgtcttagcattttctggaaatgagttgttcatttaactgaagacttcttgggggcccctgaagattctggaacaggcagggcatgatggctcacgcctgagctcaggagttggagaccagctggggcaatatggtgaaaccctgtctctgaaaaaaatagaaaaaactggctaggcatggtggcatgcacctgtagtcccagctacttagggggctgaggtgggaggatcgcttgatcacaggagaggaggctgcagtgagccaagattgctctgctgcactccagcctgggtgacagagtgagactctgtgaaaacaaacaaacaaaaaaaagattctggaaaagacattcatcatcaagaacttacttccccgatatttaaatcatcaacaggaaaggttatgtacaggaagaagaaactaaaaagtgacaagacactccaaaagtgtgattttgagttcctcagatccagtagtttcaagatggaaactggattctgctacatcattcagcagaacagcatccctgggaagagaggctgtactacccctgttgtacacatggggacagattctagtactttgtatttgtataaattgatttcaagtcccacggtgacttgtgtgacttacgtggtagcaccacttccttaactggaatctaggcgagaataaaacttcatacctgcatagaaaatactaggccgattttctcgttttcccaaacactatgaaggcactggaaagtgttctgcttccatgaccgatggggagaagtccagtgggaggggggtgtgcaggggagaagagcatactccccacgagctcttccctgctgccgggaccatctgctctgcactcccactaacaccaccaccattgttaaaaataatcatcctttagttttacttactatttatttatttatttttgagacagggtctcactctgtctcccaggctggagtgcagtggcatgatctcggctcattgcagcctcaacctcccaggttcaagtgatcttcccatcgcagcytcccaagtggctggaactacaggcatgtgccaccatccctggctaattttttaatctcttattttgtagagatgggatctcactatgttgctcaggctgggcttgaactcctgagctcaggtgacctgcccacctcagccttccaaagtgctgggcttacaggcatgaaccactccacgtggcccttgttttactctttaaagggtacagtatttctcaactgttcagcaaaatagaagagaaatgggtcatagaaagtagctaggaagttagccttcaaaaacctgggaaaaggaactagattttatactctccacctctgagaaacacagggccattgagcctttctctttttgccctgaatcagaggaaatagcattctggtgcttggggaaggaggaggggaaagaaaccaccttaccctgtaccatggggataaggatatcttgctgggctgctgagtggtgtaatgtatatcaagagattggccttttctagacatttaatctgtgatcagagtcttaaggttgtactttgattttccaaggaatgtaagtacgtcattgaggttagggtcgtttaagaagcccacctgctctcctatttctggatgtttagaaaataagatagacttttagatattcttgcagatgctaaggagatgaaactttttgagtttctttttctttctctatttctagaatttattcccttgtttttttccttcaaaattattttatcaccccctccccccatttttttagtgcttgttttagatcttggagtcaggaagtttctgaatccaacttaaatactttctgcctgaactattacttagtccaaaagtgagttggactacattaatctgttcaagctgccataacaaaatgccacaggctttatggcttaaacaacaaacatttacttctcagagatctggaggctggaagtgtgagatcagggtgccagtgtagttgaggtcccaggagggctcgcttcctggtttgcagacagccgccttctgactgtgtcctcacatagtagatcaagagagaactctggtgtctcttataaggacacagatctcatttgaggaccccaccctcataactccatctaactctaatcatctcccaaaggcatccctttggggttagggcttcaagtaagaattgtgrggagaaacatttagtccataacactttctctgacgtttactatcttttaacaacatagattcatctttcttcactggrtaggacctggaggagcagaaggacatagaagttttttggagggaggtggataaaagaagagttgtttctctaggtctttgtttattgatgattatgttatgcattactgcttcctgtggcacttattaggaaatgccccatcaaacccttgcacaaaaggagattgcctcgtttttcttgtaggcttctagtttcagaggaatcgggacatgttttaattgctcacgaccttcccagaaacagaaactggcatgatttactttattcagttacctgcaacacgatcattttaagaaaatggtcgatgttctttgaatggtactatttattgtccattaacttgctagtataaccagcatgactccatctcayggaatgcacatggggactgttgttctctgctggttgtgtcaggctgtcaaaactgcagttgattttcaccttttcatgaaagaagtctgccttgctgtgggctgggttcattccaggatttaacaccattggaaagaaaacagagaatcttcaggttgtaggacagaggcaggacccacctggcacctgggcttcttgttacctttgtctctggtgtggaggaggagagatggcatccagtggacagaggagttcatttttcagggatgacttggttggtctgccttcctgggccagcgtgcaggcaaccccactggggccagagcatcctctccgtgagttctcatagcttggatctaaccctggtcatgttggatttccattcctcctggccttaagttttttttttcttgtttgtttggtttttttttttggagatgaagtgcagtgcagtggcacaatctcagctcactgcaacctccgcctccagggttcaagcgattctcctgcctcagcctcccgagtagctggtattacagacgcctgccaccgcacccagctaatttttgtttttgttttgttttgtttttttaaattttattagaagtgaggtttcaccatgttggcctggctggtcttgaactcctgacctcaagtgatccacccacctcagcctcccaatgaaggtgttttttgaccattcttataccttctcttctgtctcagggcatccctcccccattcagagaccaccatcaagggtcaagggtataactagtcctgattcccaagcaaggggccaaaggtgtcagccaggtagatcatgcttttcctttttgcacctgttgggtcttcaaattctttctttggtaatccccattgttttctgtgagctggtccttttcctaccatgcccaggttgaactctccatctgcctgcccagcttgctggaaaggggcatgtgtttatggtccctgtcccatcaggagctccagcctgttggcaatttctctcctgatcctgcgttggcgtcctcagggctttgctccccggggtcccctgagtggccttctgtctctccgtggtttggatgcagtgcccacgagcttgcctgagtgcacaggtatccctctcgctctcatggagcagcttgcagggggctctgtgaactggtccctgtgcctacttttggggatcctgtgataagcagtgtcttcctgagtgcccccttctcactgtggacatcagaggccccattctttcagtctccacagaagtgtgtgttgaggcccattgagtgttcccaattacgttagctactactaagaagaatttagaaaggccaaactagaagaaaaaagttcagcagacaggaaacactagaaaggattatagacaatgcacacacgcagaggatgtgtggttgtgaattaccctttgtgtgtctttgtgtaagtaacaatgacttcgggcagtgcaccgatggcttggctagttctggcaggatctgatacttactgtaattatgactgaataaactgcggaaacaggggcttaaagctcaaggtgagttcaaaagctatgaggatcaaaatagatcgcttcatgctaaaaagcagacatgcaagaaattaaaaatacagtcccaaaggtttaytgttgctttttaactgtgcttaatttcatattcatatcctaagcgtctgtctgaagtagcctgggttgatatattgaaggcataaacatatctacttccagtgagggcttctgcaaatcctattttgataaggtcttaaatctgttgagatcaggccataaaattctcctgcagtttcagcaataggtaaaaacagtgctcaacgtttttttttttccttttaattttgcattcagactgtgtaacctccatctgtaaatcttgccccccctcccacygcctggggaaaaatatgggcaacatgtggtgtgttaagcaacatttcaagtgtaaatattaaacttggtaaattttaatttaccttttaataattttctgacttacagggactatttttagcagatgagagcttagagatttagtgaaaatatgttgtcataactgcaaatgccagactagagtcgtttgtagtttagaaatgtatcagataataagttcctcatcagtgggcattgctttcctaggtgatakgtggaattttggcccatggatgactgaaggtttttgctaatgtgattaataccattaaattacttacagaatgccaactaaatgcatacaaatgttccctgaagaagagctctattaagtttattcttcatttctgacagcagaatcccaagttgctatttaatttcagaaagtcctttcagcaggtggctgctcatggygggtatgggstgtgaacactcacggtcactgaccgtgctgaggtatcaggaaagcctgggaattagcatgcaggaaagagtcacccggcagaacgtgttagtccttcaactcttctgtgatttgctgttgatacagaaatctatcctttgaagatggcctctgaatggaaatgtactctggaaaaatcccttattgatgctgccaaatttcctcttccaatggaagtgtttaaggtaagatgttgattcttagcaatgtatctaccctttttgagaataaaatcrtctacaaagttttccggccgggcgcagtggctcatgcctgtaatcccagcactttgagaggctgaggtgggcggatcaygacatcaggagatcgagaccatcctggctaacatggtgaaaccctatttctactaaaaatacaaaaattagccaggcgtgtggtgtgtgcctgtaatcccagctacttgggagtgtgaggtaggagaattgcttgaactggggaggcagargttacagtgagctgagatcgcaccattgcactccagcctggcaacagagtgagacttaatctccaataaaataaaaagttttccataccaaatccttttccacttgaaaaggcaccttcttaaccagtttccattttaaatgcttaaggttttatctgtttcatgttgctttttwaaaaaataatcttcataatgacccatattacaagatgctgattaaaattgtttaggtttactgactttctttgtagcatattgttatggaaatattttcaccccctcacttcctactacagaaacaaaaggaaatatagcaagtctaattttgacrtttagtaaaaatgacagaaaatgactcatctcgtggtggttcagttttcttgatgtcccgaggttctgctaagtaccaggccttccaccaggtgctcccgtgaaaatgaagggcttgtgaaatgcatctccaccaaaacggctaccaagttctttacacttcaaaaattatgcttcacacttacgtgaaatagaatattaggttctggacaaagatggtccattcaggttcatccarggaaatcataaaacaggcccatggagtgtgggcggcgacccaacaccattggcgtccttggacagttctcaatgtggttgtgacgggcagacatccagttgcttcccagccctggggtggcacgtgtctgcagagtcgtacaagtttcatgtagaagatgtacttaatgtggtacagcagagtttaaggatttagtaggggacgtgggcttcctggattttactgacacctaagtcctcactcagccttttaagcagctgtggcaaatcattgaccctttcattcagtacttcccctgtttgtaaaattggactattaagatctcccccttaacttagccatgtgattatgttgtgatgtttaactgaatgatgatttttacagtgtttgggggctcctgtactggaggaacagtgtaaatataatacactgttagcatgatattgaccgacagtgaagccgacagttgtggtggccaatgttgttattttttgcctcactgaccaaatctttctctctcctcctctttgtcttcctcttcctctccttccctcttctctcccttttattcttccttcctttaatactgtcctgcccttacaaaaacgatgaagagaaacagcctttaatgttggacctctcagctctgccacccccaccagagacagcctgtcctcgtctcccctgcccctttctcttcaccgtggcctcagtcatctttgaatgtgaatcaaatccaatcacatccttcacccttgaaaaaataaattttattttgacgtaccctatacacacatgtgaggagttgaaggagtgagccaatgggaaattacagatgcccaccctccggtctaagcctcggagctgccaggccagtgragcccccgctgcagccccaggtctgcctccctgcgggaccagggcacccggggcctcacagctgtgcgggtcctgcctgtgcctctctttgtggcgttccagcctgtgtatgcttccctaagtgggatgctgagtcctgttgacaggatgggaagtgggcacygtcctcattgttcagagagggccctttccctactctgaagagggaagaaagctggatgtggtctgggcaccacactggctttgcttttcctcagagtggatgaggattcagtaggtgaagtcgtgagctaattttttttttttttggagaaacggtgtcactctgtaacccaggctggagtgcagtggggtgatcatagctcgctgtagtgtcaaactcccaggctcaagccatcctcctgtctcagcctcccaagtagctagaaccacaggcatgcaccagcacacctagctaatgtattagtttgttctcaygctgttagggaagacatacctgagactgggtgatttataaaggaaagaggtttaattgactcacagttcagcaaagctggggaggcctcaggaaacttaaaatcatggcaaaaggggaagcaaagatgtcctttttcacatggcagcaggaaggagaataagagctggatgaagggggaaggcccttatcatcagatctcatgagagcttactcactatcaggagaatagcatgggagaaaccgcctgcatgattcarttacgtccccacaacatgtggggattatgggagctataattcaaaatgagatttaggtggggacacagccaaaccatatcagctaatttttagattttttgtttctgtacagatggggtctcactgtgttgcccaggctggtctcaaatcctgggctcaagtgatcctcctgccttggcttcctaaagtgcagggataacaggtgtgagcgactgcacctggtctgtgagctaatcttaagaagacgaggggttaccacacttgcttctactgaagttgcagcatgaactctcagtactggaggtcacatcccttagaaatgtgggcaggggctgcatagtattccatggtgtatatgtgccacattttcttaatccagtctatcactgatgaacatttgggttggttccaagtctttggtattgtgaatagtgctgcaataaacatccgtgtgcatgtgtcttcatagcagcatgatttataatcctttgggtatatatccagtaatgggatggctgggtcgaatggtatttctagttttagatccttgaggactcgccacactgtctttcacaatggttgaactagtttacagtcccaccaacagtgtaaaagtgttcctatctctccacatcctctccagcacattgggacatggatgaagctggaaaccatcattctgagcagagtattgcaaggacagaaaatcaaacaccgcatgttctcactcataggtgggaattgaacagtgagaacacttggacacagggttgggaacaccacacactggggtctgtcgtggggtgtggggagggatagcattaggagatacacctaatgtaattggtgagttaatgggtgcggtacaccaacatggcacatgtatacatatgtaacaaacctgcacgttgtgcacatgtaccctagaacttaaagtataatttaaaaaaatacattaaaaaaatgtgggcgggggttggttggttcttgttttctgattttacaacttagctctcaggagcaggctgaagttcactgtttctttgcagtggaatgaatgttctcatcttgtctagacagctggaccaggagtaggacccaacttaggaatctttttagtgtagtcaaaataagctgaatattgttaacaatcttggtctggctgactttggcattgtgtccgtaggttgcaaagatgataaaatgctgtctacatttccttctcactaaaagtggctaaaaatgtctgtcttatccatatactttattgatagtttgtgtgggtgtagaattttaggtgagctatcatttgtctcaagaatcagaggttttggctggggcgttggtggctcacgcctgtaagcgcagcactttgggaggccgagacgggcagatcatttgaggtcaggagttctagaccagcctggccaatatgataaaaccctgtctctactaaaaatacaaaaaaattagccgggcatggtggcatgcatctgtaatcccagctactcaggaggctgaggcaggaggattccttgaacccgggaggcagaggttgcagtgagctgagattgcaccactgcactccagtctgggcggcagagcaagactctgtctcaaaaaaatgaaagagggtaggggggattagaatgtggtggtcagcccctggagtgtggcttgtgggctgcttcttgtcctgtagtatttcctctttggctggttttccagggagagcttttcagtctcccaatgtcccacctggggctccaggtctgactgccagcgttccaggagccacgtggagagaagagggctgggtgctggcctgcagtgttggttcctgccccagcctgttcagagaaggctgagacagggatcagggaggctgtggggggcgtctaactgcctctgcttcccagtcacctccccatgcttatatcttaagctcctrtcaaccccccggtttcggacatatctggtgggactcgtttcagagcctttcaaggcttctgtaggagccactgtgttggtgctcagcttttctgctgaaggcctgggatttggctttgctgaatgtgtgaaattactcacttcttcttcatcagcttttttgcctccttacctttgtgtgctgagtgggtgtgtcttttttaaaaaaagtctctggactgtagttttggttagagtttaggaggaggtgaaatgaatgtgggttttcagcctgctgttttaacctggcactgctgttgaaaagaatcttgttgtttggactctagggtacgatcaagctgccacatccttcctggacatgctgagcctggggagatttttcactcgctcccctgtgcagtgtctccttccgtgcccctccttgctgtaccaggaggtgcacttgttatgtttctgtaacgccctttgtaccttgatatggtttggctctgtgtccccacccaaatctcatcttgtagctcccagaattcccacatgttgtgggagggacccggtgggaaataactgaatcatgggggtgggtctttcccatgctgttctcgtgatagtgaataagtctcacgagatctgatggttttaaaaatgggagtttccctgcagaagctctcttctcttgtctgctgccatgtgagacgtgcctttcattttccactatgattgtgagacctccccagccatgtggagctataagtctaataagcctctttctttagtaaattgcccagtctcgggtacatctttatcagtgaaaatggactaatgcatacctattttgttctgttaaagtcctactcatctttcattttcaaatatagattccccaraggartccttccctggacccctgaccctggcccagatgaacttgagcctctgttggtgtccttcagcagcttgttctgtcacagttatgcttaatcatttgtgcagctccttgtataataccggcctctttttgcctaactttgaagctccaggaaggcaaggactgtgtctttcctgtccattcttagaaacatactttcttgaccatagtagcactcattaaatacctgtccaataaatgcgtgaattcatggacatatgtcttcaactccttgaatttaatttttttttttttttttttttttggaggcaatcttgccctgtcacccaggctggagtgcagtggcatgatctcagcttggccccctgcaacctctgcctcctgggttcaagagattctcctgcctcagcctctcaagtagctgggattacaggcatgcaccaccaggcccagctaatgttttttgtatttttagtagagctggggtttcaccatgttcgccaggctggtcttgaactcctgaactcaagcaatccacccacctcggcctcccaaagtgctggatttataggcgtgagccaccatgcctggcctgaatttaaaatttttgagttcatatatagattaaatggacatgcacacttatttagaggtatgaatactaagactcaaaaggtatacacattaatcattctaatatatttgtaattaaaaattaactaattcattaaacatttattgtctttgcacaaagctattatgtgctgttgacctgattccagagtttaatagtttgttcatattttccaaaatacaattaccttaccttcttccctcactttaatttcttcccataagaattcagactattattttggtagggtatgtgagcattatcatcttattcagtattttgtgcataattaaggagtgctttaagagcagatactgaatattacttttgggcctctcatgaggcagggtgtggggttaggcactttataaatagacattagttgcattgaatattatgtgttcttaaagctggtgagatactttcattaatgttttctcttatttcagttcaatggaagagacacaggaggtttcttaactatattttgtaatgagtgagaatctacacgtttaatttggagggtgtgagaacaccattttcttagtttgcaaaggctactgtcacaaattcccatggactggatgacttagaatgacagaaatttgttctctcatgcttctggagactagtgtgtgaaatcagggtgtcggcaggaccacactcccctgaaggctctgggtggaagcagagggcggccctggcttctggggtcgcctgtgtcctgggctttgcttggtctgtggccacctccctcggttccctgcctccaggttcacatggccttctccacatctgttcaaatttctctctgcttacaagacaaccgtcatttgactggccctgtgtgaatcccatccaactttgtcttaactcaattgcagttacaaagaccctattttcaaataaggttgcatgatagcttctgggtgagtatgaatttgcagggagacactcttcaacccaatctgatcgcatttcatgtatgtacagaaatcttagaaataacacagtggcactctctactgacttcctctgcttgcacgaaggtaatgttcagagaaatggtatggatgcatgggatgaggatccaactgtcttagcagttgcttcatttatttaaaaaaaaaaagagaaatcttctctcaagtttttagaagttctagcaagcagtattctttgtgcaggatccaaaaagagacacacacacacacacacacacacacacacacacttacttgctttttttctctgttatcactgttgatcatcactgtttctcagcaggcagacttttttctagtttctttcattacggtaaaaggaatatgtgtttgaattcagcagtgagtcatctgagatgcgtgttgttatggaaaattgccatagcgttcagctgttacgagacagaagtcaaagctaagsacatttaatggccggagatgagcggtatttccaagaagttctttttattatttttacactttagatgaaatgggtatttggatgggatgagtcccattatgctgcggttgctcacgttggggggatgtgttcacacgtctgtgtggttgtcggtgtctgtgcatgcaatgtgattgagctcctgggtaggtgttcctttctgtcttgaatacaaactggaacagtatgagaacaagctcatgattattatttctactgttatttatctttgatttaagagatcactgtgaatagctttggatgccatactttactgggaattctgacttaccttatttggmaaatacagatcatttccaaaatgtacattcagttgaaggataaatagttgatgaaataggtttaaaaaaactcaaaggacattaaaagcctcattttattgaaaaataaataatgacttttttttcttgaagacsaaccctgttrtttagaggcctaaaagatttgccaaaactatccatatactatccatgtctataacaagtctgtagaggtgactgcactgtatatcaccgtggctctcagtggattttaatttagagcagatgtctctgcatcacacagctgggtgagtctcagcttttggaacacaaagaaatcttccttttaaaaatcaacttaagatatgtttagaaagtagataaaggccaggtgcggtggcttatgcctgtaatcgcagcactttgggaggccgaggtgggtgaatcacctgaggtcaggagtttgagaccagcctggccaacatggcgaaaccctttctctattaaaaatacaaaaattagctgggcgtggtggtgggcacctgtgatcccagctactcgggaggctgaggcagaagaatcacttgaacccaagaggtggagattgcagtgagccgagatcgtgccactgcactccagcctgggcgacagagcgagactctgtctcaaaaaaaaaaaaattagataaaacctttctttgacatagtcactttgaccaattttgcagcctctggaaaccatcatttgattaacttatgacatatcccaatgtccactcaagcaaaacgccccagtttccataaaagctttttatttttgtcttttgcgaaggactacyaggaagggtttctgtcrgtttgtttctgtcatcaaacaatgaagtttattacaggacagactcagtcttttggtcaataatgtctttgttgcctcagttttccagttcactgagtgtatactaagagaccactaaaggattttttggggcttggtaagttttaaaactagggctagaggagactagaaaataaaagcctatcagtaattgtaacatgtcacgtgtctgacatttacgagcctccatattactttttcgttcccagcaattcttataaatcgtattccatatctgagatcctacgtgtttgcaaatrttaaattgtacaagtttcactgacaactcatttgtccaccaaaaagatctataaataagaaacagcaattcccaattttctagttaatggaaataaaatattgtttccttagaggaatacagaaatatagctgggagaagacagaagctctctagcttactttgttcatgaccacascttgtcacagcaaggaagggacatayctgaaatgtcactaacatctatgatcctttttttatcctttaaagaagggaaattgttggaacttytttgtgttctttaaaaaaatattgaaaatctcagtgtgtttgaaattctaaatgagctactcagagatttgccttagagtgcagggaattatgcataagacaactgcacttctttgggaggctgaggctggcagatctacttgaggtcaggagttctagaccagcctggccaacatggtgaaaccacatctctactaaaaatgcaaaaattagccagaagtcacttgaacccgagaggcggaggttgcagtgagctgagatcttgctactgcacttcagcctgggcaacagagtgagactccatctcaaacaaacaaacagaaagacaactgcacttgagtccaaagccttggcatcctccttgtagcctctctccgcttcacacctctgtgttggggatccccacatctgccccaggtttggtaatttactgaaaggactcacaggattcagaagtcattacactcatggttataggttattacagtgaaaggatagaaagcagaatcagcaatggggtgaagtccagaaaaccagacagaagcttccagagccccctcctggaggcgtcacacagcacccagctgtgacaagaggtgccaggtactcttctaccagggcagttccttagacactcagtgctcagggtttttactggggactggtcacataggaaccctctgcctggcacagaccagaattcccaactcttagaaggaaaccataaaccagattgtttgtacacacagtttagacacagcaaaccactcttatatttaggaaaagttttagattggtataagctattttttatcagccgcatttccagattgcagccacagacccccccttgcaggcgagccccctctgtgaggaccacagcctaggcctcccaggtgaacccttctctgcacacttccattccacccatcaggaaattttgttggctctcccttcaaactctgtcctgaactcactcttctgtgtagcctttgccactgcccaagtccaggccaccatctctgtcccatggactgtcccatcacgccagagcttgtttcctggcttctagtcattgcgtcccccgactgcagccagagggcttctgttgaaactgaagtcagatggagccccacttttgctcctgcctccctgtggcatgtcatctcatcagggcgggatgcctgggtccagtcgcctgatgctggaggcttcacgtacctgccgtgccccctccagctccccactatcccactgacacctgcttactcctgcctaaggcctttgtataatgcctggtctgcctggaaggtcacccccagattcctgcatggccccttccctcacttcctacgggtgtctgcttaaaattagaaaaccctggactgggcgtggtggctcatgcctgtaatcccagcagtttgggaggccgaggtgggtkgatcacctgaggtcaggagttcgagaccagcctggccaacatggtgaaaccccatctctactaaaaatacaaaaattatctgggcatggtggtgcttgcctataatcccagctactagggtggctgaggcaggagaatcgcttgaacccgggaggcggaggttgcagtgagctgagatcatgctattgcactccagcctgggtgacagagcaagactctgtctcaaagaaaaaaaaaaaggaaagaaaaccgcactctgttccactatctccccttctgcgcactctccctgctatcctggttcagcactgatctcagcactgattcccccgactattatatagcactttgccttttattttttaaatttaatttaaatagttttttgcatttggcctccttcccctagctagaatgcaggctctacgagagccaagtttgtatttccatgactgctttatccccagtgccttccgcagtacccaggacatcatcagttctcagtaaatgttcttgaatggggattcatggggatataagtccaaaaattaacttagaaggatcaaaacataggagaggtcatcactataacttaaattaagcaagcctcctgtgagtagttctgaataatagagatgactagcctaagaggggaatggctccatttatgggatggtgagtttacaactaaggatggcacttttgtaatcaactaaaaataccccagctcagctctttgctaagaagaggaaagagttgagagcactgagaagagtatttggcctcccaattaatttcaattcctcattgaaattaagaagacatctcaggggccaggcgcggtggctcatgcctgtaacctcagcactttgagaggccaggcgggaggattgcatgaactcaggatttctagaccagcctgggcaacatggtgaaaccccatctctacacaatatacaaaaattagtcgggcgtggtggcatgcgcatgtaatcccagctacatgggaggctgaagcaggagaatcacttgaacccgggaggcggaggttgcagtgagctgagattgtgccactgcactccagtctgggagatagagcgagacttcatctcagagaaggaaggaagggagggaggaagagagggaggcaggggagggagggaaggagggagggagggaaggagggagggagggagatctcagcattwaaaaagaaatcaaaacataaaattaaaatctcagcattaaaaaaacaaaacaaaaacaaatcatgttccacgaaatcctgttgctcacaaacctgaaatgtcaaggtttgctgcttgttgaaagtgatcacggactaggcttaatgtctacacatgttttatgtaagtttttttttttttttttttcctcttttttaaaatgtccgtcttttcagattgtttgatccaggcactaacctgctactgtatactgttttctaactaaacaaatagagaataaagatataaggaacttgaggaataagcccaagagagcactgtggtctggggatacggttggcatccagggtttctgcttttttataggcagctaattcttttctgctgaattgatcgctgtttcatgtcatgcttctcaggagtgtatgtagctgacgggtgaggtgcggctgggcagtgactccctagtgcttcctgcttatttccgttttatttgaagccaaggaggagtttgtttttgatgtgagtcatatgcccaggacactaattccaatccattctcttatcacctccctgaccagttcctaatcagaatctgtacctcatggaggttacagggatccaaggtcatgataactgaggcttgtactgcatctggactcagaacagagcaaatgtgtgcctggtctaagtacttccgtaraatacccagtgtcttggtgtccttctgcagcacagtctctgtcgtctttgacataagtatcgagattatacacacatcactgataagggataaaaggcaccctggaaatccgtaaataaaggactagcagtcacggcagtgcactgcattgagtctggtttggttgggtctgaaactgtacctgaaatggtttctttaagtatcttgctttctctatttctcgatgtttaataaaggaagggacacggacatgtagagaaggctaaaataagaaatgctgtgtgaggccatttttccccacacaaaccaagaaagaaataaagaccttccctgcatggacaccctctctactaagagtgttcatgctgctcatagcactgaagattccacatccagtgctttttttcagtgttttcttagctttcaatgatgtacctgtcagtgtgattatagatttaacccttaggagggaatctctcctacattttagcatcggagacctagattaaaggctgaggagagaagattaaatgtggccaagagagagaagcttttctttctcattccgtctggtacagccaaaggggtaaggaagacgcgggcttctcttacgatagattgtgaggctgcagtttctatggtgactggtttctttttcccttattcagcagctaaatgcagcaacaytcaaacacttgtagctgagtttggccttcaggtgggacacttacattctccaggcatttgccttaagcccatatatagagacagagcttaattttttccccaagtcatttagcagttaatgtttgtgggatacatgatggatatctccttctcatcatgttatccccaaatggctttgaaatagaggctgttggccgggcacggtggctcacacctgtaatcccagcactttgggaaaccaaggcgggtggatcacctgaggtcaggagttcgagaccagcctggctaacatggtgaaaccctgtctctactaaaaatacaaaaatttcctgggcattagtggcacgtgcctgtagtccacctactcgggaggttgaggcaggagaatcacttgaacccgggaggtggagtttgaagtaagctgagatcgcgccattgtactccagcctgggcgacgagggagaaactctgtctcaaaaaagaaaagaaaagaaaagaaaagaaatagaggctgttttgatggtaggtgattttgttagcagactggtgcatgtccctctgtgatctcggtgcyattgattgaacttgggaggtttctaccccatggctggagccgggtctgttctctcaggcatccccagtgtctgggcctgaaagcacggttctgcagagtgcgtgctcccctacctcctgttgccattcccgtttctttacagacttgaagaggtttgttaaacagaatctctttgggtggaaaaccccagagaagtccagttcgttgaatacccgttcctggcaacatacagaactgcgaggtggggttcatctgtgggatcctttgcctgttctgggtacttgaactgaagcacrtgaattccatggcaaaaaaggaccagcggggccatctagtttttatgagtattggagaaaatcttataagagacacactaaagagggcaacattggtcaaacaataaatgtaactataaaaatcgcaaaatccagatctatacagagttcgccatcgcagctgcttgatcactggggcctgagctccgctgtctgcagtccgttagatagcaacttgcttttaatcctaaacgttaagaatttaagaatttagtcaactttcagttatctgctccgggagttctcactcccaaatggcttctgcttaccgcggataattctggctcttgccagttcccggggaacttgcagggagggtgagatcatattagcatgaacttagcgtaattggtgtatgggatttggaggtgtgcaaaggggatacatctcttgtttataaaactagacacatttcaaagtgatcattgtgcctgattttttattttttgggccattttctattccattctctattaataaaaataattaagaaaagattataattcttttatctacagaagatcttattgtggatttaagccacggtaaaattgtttggaggtggctcccccatcccccctccaaaaaacattaaaaaaccaccaatccttttgcaagttaggccacccgtttaagccccgtagtgcctttcatgaacagacacttgctccagggagaaacctgatgtaaagagaagtttgagcttctctcttttaactttaggacttcagaggtttgagagctaatggaaaatgaggaccccatgtaataaggggagcccagtggtgtggccatgccaccgggccttgcccttcagcrctgtcacccctgcccccagggagggcacactgaggaggctggcctactttgctgggtgtcaataaaaggtgtggggactgttcattcctgagctttctctcttccgtccttccgccagccaccctactttgaatctgcctgtctcaatgacataaagtcaaggataagataaaatctgcctccagttttgtcgccagtgccatttataaccagaaaggccagcacgaacatgtcagataaacctttacatgaatatatgatgtcctgcacttaacaacttgatgaaaggaaaggctcagtttaggagagtggaaacctgctttaaagctccttaatatttaacaagatcttgcacttgtggtgacctgcaaagtctctagatcacaacaggatttattcttttccctgccggcatctggattctcctaaaagtaaatccatccagacatgcctgcatacgtaacccccacccggcaaagggatcagaacatttggtcatttcgcctgtgagtctgtactgattcatgcactccctgatcctcagtcattgctgagcatccgaagattctgagagactgcaggtctataaacaatgggacagggagccaaggcatggccagagtgttacaaaccctggctttctgtgtgataagccactcaccttgaggaygtttttggaatatgcattaacctttcagacctttcgggatagcataaaaaggtacgaaggaaaaacataattgaagccatagatgaatcataggaactcaaaaaccattcttcattggaaagtgttgcagtgaattggtgagcgtttctagtgattcgcacccacgggctgcagaccttgtgctgggtactgtgcatatactatctcacatccccacagtaacctgactcgagaggcacaggagtcttactggttaagttcaggaattgccaggctcagagaagttaatttctagtcatacctcatacagagagaccatgggtgagccaggatgcacagacgtacctcaaacccaaggccacacttttttttttttaatgtttctttgttaaactggggtatttaaagactgcgcaaactcagtattattataacaaagaaccagaaaatgaattctgagagtattcagtgttgcctattcagtatggtatttgaactggagtatgttgctcaactccttattactcagttgcttttgacgagggctctcctgggattttggccaggatgatttttttattgtactaagtgacaactgcccctgccccttgccaaataactgtctgcactggggaatgtggtagatgccgcctgtgtagaattagaaccagtggtgtaagccggaagagtggccccatttttcttgtcagtgattggcttagggagagatttgtgaccaatttgggtcagtaataaatgaggacatctgctggtagtttctggaataggtttccttgctttgaagaagcagcatagggaagagggggccttgctctgcctgagaggcctggagtttctgcagccatcttgagcccacaagggaggagctggactggggaaagctgtcatatttagggtgtggaaggaggaggatgaaaagaaccgaggccatttctgacattgctcatggctctgttcaccaggcttttctattcacttgccttttctctggacccctttgctgtgtgagataatggatttccttatggtttataccaggtcgagtagggttttctgtctggtctttgtgtgagaaggccctttaatagataaaggcttccttggggaccagtaccatttcaggtgactggtstgcttgtctgtaggttggaaatgattgcttactccttgcaaacagagaacccattgctgccatagtggtagtaggcagtgggttaaggagtacttgagttattgttattgtcctgtgcatgcaaagcacctcttgtaccaccataytgtggtcaccattgtttatggttattgctgtcattcataacagcatctttgaatcttatacactagacattcaaagtggaggcagtgggagggtaacagcagcaccaggtctgcagtgtagactggcagcaccgggtctgcagtgtagactggcacaaatgtaagtgtgratttccagktcttgctgagacagcatcagagtgagtcaaaattaacagggttggttggcactgctgatcacaccaaggggctgaagggtgggtactagagtgagttaatgctggagacagaggcagagagaatccactgatgctgaggaagctcatcagaagtgtagggggaggagaccacaaggtcaggtgtctcatcagcgatacctgacttctctcttaaccgaatctgaatcaatggtcctcaactcaggggccaggggcatgtgcccttcagtggacatgtggcaaagccaggagacatttcagttgtcccaggtgggggatgcagtcagcatctagtggatagaccccagagatgcagttgcaacrtcctacagtggcagaacagccccccaacaaagattctggcccccaaaggccaatagtgttgaggctgaccatccctgtttctcacctggaagtggttgatggagggagccgagggcagctggggtgtgaggaaggctctggagactgaagctgttattagatccagtccaggctgcttggcagtgggcactttccagtggggaggcttcccacttgtggcagagcacgtagaggggtttgcaagctctctgtgtttactggcctccacgttggtgtctgggaagggcaaaacagaagctcagactgctgggtggagaagttttgygccttcccagctcttgcttctttctgtgaagcatgctggcgtcatgtttccatgacagcagttgagttaatgcatttaggggccccctcagcgtccaccacatcctgcctgttgtaaattgtgtggttcaggttgtgatctatgatactacggtcctaaatttctcattactattttttaacttgattgaatgcacagctactagacaaaatcgctctttacctctgtaagtaaaaaatagaaatgcttattagtgttcagcaatagattttaaaattacatttttgttacaaatacttcactggctaaattgaaatcagtgtgatcaaattgaaatgtcataatactattgatttaataaatgctggcctcctaatatctgtttttcaatgaaactagtattacgggagtaattttctaatgaacatctgagcactaggtcattggtaaaacaaaagaagaatgatatcataaatggttctggatggttttttcagcgggacctggcatgctgatacgaatagaggaattaaagcgtagctcattatatattaatttgaatgtaatactaactaaaaccttccattgacttcactgaagcctagtcttagaaattatgcagattaatggaggccttgaaaagaagcacatgcaatatttgagttccctttggaccaaaaaactggcatgttggaactgaaaaaattatatactgtgcagtatttttgtgtaagtacaatacactaaaagattttgttgcttaaaaaaactgggcagggtgaatcctatatctgttttttgtctattttattttatatccaaataagccgaaaggaagaagcaaaggaccgaaggttgacactgagattgctgctgcagagggagaatttcctgcagcttttgattgtggaactcaggttaagaatgtggttcctggagccaggcacggtggctcacgcctgtaatcccagcactttgggatgctgaggcggttggattgcttgaacccaggagtttgagaccagcctgagcaacatggcaaaaccccatctctacaaaaaatacaaaaaattagccaggtatggtggtgcacacctgtcgtcccagctacccgggaggctgaggtggaagtattgctggagcctgggaggcggaggttgcagcaagccttgattgcatcattgcacttcagcccgggtggcagagaccctacctcaatgaaaaaagaatttggtttctgcataaggatgatttcactgccttttttgtttttacatgaaaatcctcaccaagtacattttaattttgttgtattaattaatgagaacttgttctcccctgtgcctcatctttcacaattttatatcatgtgagatgtatttatctaataaagtggcgatgggaagaggcattagctattttcggagtctgtgatagccacatagtgacattttaaaagcataagcttcggttcttcaagcccctcaagtaaatgtggagatgagtcaagttcaggcaggcccagcagacatgaatgttctttcttttctgtcttctctttctcctgtctctctgttagtaatactctccattgctgtctgtagattaatactcacagccacgtgtatactgtattttataaagaactttgctgttcaccctgaagctttggcacctgccagagacatgagttgctgctgactcatgatgactatatccaggcaggtgtgtttctcccgcagcgatggttcactcctcctgaatcaggtgctgtccctttccaggcacagcaaccactggcaaggcagggacttcatcagaggcagatgttgaaagtggtgggtgaccgtgggtagtgagtgcacccagggcaggctctgacgttgtgggatcctcctgacccctgttttaagtgaaaaaagtgagacataagccaaaactataaagtcaggacaccaagatattgcagtttgtccatactcctttttccagcgtgatactctacttcctgtttctcactgtacagttttttcttttcttttcttttctttcccctcccctcccctccccttccctttccaacggagtctcgctctgtcacccaggctggagtgcagtggcgtgatctctgctcactgtaacttctgcctccggagttcaagccattcccctgcctcagcctccccagtagctgggattacaggcgcccacygccacgcccagctaatttttatatttttagtagagatggggtttcataatgtaggccaggctgctctcaaactcctgacctcagtgattttctaagtaaatttccagcttctcagggtcagcaatcacatcaactactttcctgtgcgtccatcataggatggtgcctgtcacatggtgtttaaaataccagtcccaggctggggttggtgtggactttgcagccagccacgtgtactagattaaccacgttggtcagagtaacctgtcttggttaacatcgataacatcgcatggaagtcggtatcgatggaggataattgatgaagcacygtggacattttgctgcacatatttcctaaatcttcattgcttactgtataaacacacaaaagtagtcatggtatttgttaattgttgatgaaggttgtgactggctgtaggtaaacattttggaagtaatttttaggactggaatgcactcacatgctttttycttaagccactgaaaagtgcgaggaattaacagcaaaacttggaggttttaagtaaatgatcagtgttagtagctatcactttttaacttagcaatagctctctttgaaagaaaattctagggggctttaagtaggttgtaggttgtagtggtattgtttgcttgtactaattattgattttttaaaaatcctttttggtctttgttccgtggtctgttatataacctggtggctagagggtgggctcagactgaatcaggctgcttgggtttgaagcctggcttctcttggtagctgtgtgcccttgcttagataacttcatctctctaaatcttaatttcctcccacaagagggattccaccccacagtctgtgtcagcagaaaatgacaatgcagggagcatgcctgccagtatttacaacatgttagctgtttctgtccacttgatattacagcctgagcatctcttatccaaaatgcctgggaccagacgtgtctctgggttcagattttggaatatttgcagtacatttgtctgttgagcatctgaaaacctgaaatcgaaaaggctccaatgagcatctcatgtgagcatcttgttggccctcaaaaagtttcaggtttggggcttgggattttcagagttgggattccagtttgtatacrcagaacctagttagtctcagcacagagttactacatcttagtaggagagtgagaactgctcaggctctggagggaataaagctgatgaaaccagggtgcagaaaggaagttgatgtagatagaaccacttttaccacgtcagtctgctgaaaataaggttccctgaagagacattgccacagtagcctgtgaagacagtcttccaataaaatgaatggcattttacttttgatcaatataaaactactttagggcaaaaataaaaatgggtagtgatgaatgtagatgggaatgacattgctggcatttattaaaggagagcagtttttctgtacgcaatttgaccagactccagtactctgaagtaaacagtatttctttaatgtgacaggcatatttgtaaatctactaaggacttagtaatatatcctgataacgggaataacatcattcttgatccaataattgcaaagtgtgaatgattctctagagctttgcaaaggccaagaatgtctctttcaaatgacagtgaattttccattatctcttagtacataatcggtttggcgaattgtcttcaggacccaggaactctctctgtccttgacattgaggatgatgagttgggtgtttgtgtaaatgaatgcatgccctccgactgcattaacagcccaaagtaagtggtctggggtgattagatttgtttttcaatgagaatagctgcatcttttctcatatactaatatggatggacatttacaccacagaactcagcagttctgtctgttggcttatttggaaattcgctggtgttgaattcttcaattatcataaaaacttgttattccttaggagtgtcaagtgacttcttttgccttttagatcatatttcagtgcttccatccagtatccagagcccagtctccatgcataaatccactgtgccaccttcccagaatctttttttttagacggagtcttgctctgttgccaggcttgagtgcagtggctcgatctctgctcactgcaacctccacctcccgggttcaagcgattcttctgcctcagcctcctgagtagctaggactacaggtgtgcaccamcatgcccagctaatttttgtatttttttttctttagtagagatggggtttcaccatgttggccaggwtggtctcgatctcttgacctcatgatccgcctgtctcagcctcccaaagtgctgggattacagatgtgagccaccgcgcctggcccccagaatcttttatcatcatgagtcacatgattttcgtcttccaaattaagcttcactcctataaatcctttgactactgtgatcgtagtgatacttggtttttatatgctagaagtaaaaaaatttgttttgaagttccttctcagtctggatcttccatagctgttcttgcctctcttttccttctccctttgacaaatggagggtgttctgtgtattccatgcaatagctgttagtctcctgtgcggtgyctcagtggtttctgatcagtgcttattggatgaatgakagaatataggatyggaatggatgtcaagacatcattgggtttttgtcatcccttcagtttaattcgataaatatttatggaagcctttcttgggtgagccacgtagcataaatgagggagtttggcatttactggaaagttctgcacatacagcatggatatctttcatgttttttaaagttctccaatggccagaagtttcagtggcaaaccccgtcagaaaatattgtcacgctcttgcagtmaaacgtttctgaaatcgtcattcatcaataatataaacattagagtagcaggtttagccaaactcttaattgttttgtctttattcttgagtcttctcaatttccgttacgttgacttagctttcaaactggtgggatttctatatggtcatagagggattttttttttttttttttggttgttgattagaaagtgattttcagaaagtgaaagttagggctggaagatacagcaatgcattttatagtttccaaatttatttctgaaatacggagttgaagttcagtaggataagatatgtggctatttgaggccagactacaaatacctgtgtttggatgctgcaacctctcagaatgtctggcttctcttttcagtatatgaaacaagagtgtttaaggggttttgtgtagtttggaargaaaaacagatgcatttctgtgagtaagaagtgtcttgactataacttacgaactgtttttacccacaacacttctaacatcacatgtgtgggttttttccacaccaaccagttcttcaactctctggacagcaagtgaatatcctgcagtttaattcatttctgacactgtctgaaagcagtgcagaccccacaagtgargggctcggtaccataagatgcctccactttgatgccagttacaagtcctgggcttcctgtacttgatggctataaattagggttcctgaaaccccctccttggatttgatagttttccagaaggcctcacagagcagtttccttactattacctgtttattgtaaagggtaccatacaggatgcaaatgaacagccaaatggaagaggtgcccggggtgagggctggaagggggtcccaggcacaggggcttctggccctgtggagttggggtgcccccacctcctggcacatggaagtgttcatcaacttgaaaaaccccaactctgtcatttagggtgttcatgggagtttcattatgtaggcacgattgattaaatctttggccattggtaatgagctccatatccagctcttctcccctccctagtgggtgtggggtggaaaagaacttacaaccctctctaattatgccttgggctttctggacacgagcccccaccctgaagctgtttagggtcccatcaagaatggacccattagaacaaaagagctcctatcacctgggaaatcccacaggatttaggagtcctataccagggacaaagaccaatatacatttaccacacagctgaaacctgggagaaataatttaagttgtaggagatctgagccaagactgacagaggggaaactagtttctaaaatttttggaataatgctcactgagcattattcttaaactgtttaagaatattttaatgtcatgctatttttattttcatcccgcatccaccatgcttggttttgatgttttatgttcattgttatagatgagcaaagatgggaagtttaatgatggacgttcgagcacaggacactctgggagaaaaggaagagattgtgtgttgtctgcaggaagtggaagtgatcccctcttaacctagagatgtaattagatgcagaggacgctgaagtcattacccataagcatttccaatacagtccgcagccctgagtggatagggttatctcagggacacattgctgtctgctgtatttccaagcarcggcagccactgcctggtgtctgctagatgactgtgaacacaggaagtcctcagagagggcagggcttctggggacacagagtttccacacagcacggggagctatgattgacagagcttcccagaggacttggagtatgagataaaagatgggtgtggatttggctaaagactccaagtcagcggtcaaggtcaggttgagggcctgcgatgtagaaagggcttagggttatgggtaaaccctgcttagaaagctgactctactcagagagcaaaggttggagcaagagttttgtggaacagagagaagcacagaatctggaatggagggaatgaagagggcgggtagaccagaagccccgtggctgtcaggatgccyctagagcagagactctcaggaaagccggggtgatagaggcagccagggagaagacccatgcttgtccccgtgcaccagacctcaggaatgcctcaccctgtgcctgtggctggtgaggggcaggctgcaggaggaaaggggtcctgcacagagaaggaggctcctgagaaacactgacattcatctgttagccatcacttatagttatgaatgtgccgggagtgactgagggcacctctgagttgtcaaacagcataataatgactgcttagacttgctgagtacattcaggctacgctttattatttcataattctataataattccccttttccaaagatgaaagggtttatacttaaatggggaaggatatttacctgcaaaagccrtgatcgggactcatttcccgctgatgggtactggggacatggttgtctgacaggaacgttcactttttgagatggagtctcaccctgtcacccaggctggagtgcaatggtgtgatctcggctcattgcaacctctgcctcccaggctcaaatgattgtcctgcctctgcctcccgggtagctgggattacaggcttctgccaccacattcagctattttctgtatttttagtagagacagggtttcaccttattggccaggctggtctcgaactcctgacctcgtgatctgcctgcctcagcctcccaaagtgctgggattacaggcaggagccactgcgtccagcccacttttaatctttttttttttttaatgtttaattttttttattggtacataatagatgtacatactttggggtacatgtgattaatacattcatataatttgtaaagatcaaatcagtataattgagatacatatcaccttaaatatttgtcttttctttgtgctagaaacattcaaattaactttgaatctttgaattcggatgctagcaagtcaatgttggtttagttgtgatggcgcctcacctgtggcttctggccctgcctggacatgatggctggtgtgtgttaatccacattcgctctctgtacagtagcctttgattccttctgtttcctgatttgctttcccccagccacctttaaaaataaatgttttgaaatcaaaaccacaaggagataccgtctcacaccagtaagaatggctgttattaaaaagtcaaacaaataacagatgctggtgaggctgtggagaacagggaacacttacacactgctggtgggaatgtaaattagttcactcactgtgaaagcagttttgagatttcttgacttaaaacagctaccattcaacccagcaatctcactggtggctgtatacccaaagggaaacacatcattctatcaaaaagacacaagcactcacacattcattgcagcattattcacaatagcaaaggcatggaatcaacctaagtgcccatcagtgatcgactggataaagaaaatgtggtacatatataccatggaatattgcatagccataaaaaagaatgcaagtatgttctttgcagcaacatggatggagctgaaggccgctattgttagcaractaatgcaggatcagaaagccaaatacctcatgttctcgcttagaagtgcgagctagaccttgagcacacacggatgtaaacatgggaccagtagacactggagactactagaggggaggggggaaatgagtcatgggtcgaaaagttacctattgggtactatgttcactacctgagtatagtatgcccatgtaacaaacctgtgtatgtacccctgtatctaaaataaaacctaaaaataaataaattaaaggctttgtttgcaacataaacaatgcacatcatcacctgcacctaatttccttgtacttttccttctgcatataatttttataaagtgtggattgtaagttcttaaggaatttgtaaatatttagagtggccagttcctttgattgggttttgtcgtatttgaccgcatcctgtcttgttctgattaatgtcctctttggacatggccccagcattcatcatgcatcccccaaaacagagacctttgccgactgccctggggacatgaaaaatgaaagggtccatgcagttctataggcgtttacattctgttaaccttggcaactcggtgcactggtggagagttttataagcagttcttctagtctgatctcctcttggacgctgacggtactgaccagcttttgggggctttggggaaacaggcactgcccgactgggctctgtgcagtcctcagagttggatatagagtggcgtcgttggagtaattaaaaacccactttagatttgcaggtaaaagaaagtaacaggtccccagatatttttgtacttcacacccaattgatgtatttggaaatcgcaggatttatttgcaggtattatttcctcagggacagactgcaaatacattcatttatccactgctgtttatccagactgtgagttatgaggtgacctccatctccgcaagataaattctggtatccagagtccagccaacctcctctattgctgtgtagctgaagtggatattgaaatttgttatcttaggaggcgggaaagccccatctctctcacataaggttgctgtaagcaggttataaaactgccagacccctattaggaatggggtgttgctcacctttattgagtaggagacaggttctaatcgtctgtggggcaggtttggattcttacctgcaggcatctctaagatcatgggatcttgagtacccctacccttactcgtgccggtgagctgtgtgccagcttacttctagtaactggtaagctgtgtgctcttagacacgggaggtggtggcagaccttgggtacaaggtgctgactgaagccctgagatgtgactccagtagcaagagacctggtgttttctgaagacaccctgctgtgttaggatgacagattgcctcccttactctgctgtgcttcagttaatagcaccaaggacgagcaaagcagwgtcatgtgaacttttgcttagtgtaaatttaagcatggccaggaagccttgttgcctctcccttggaaaagcaatttagcctgcagaaaataattaaatccgtggtatctggcaataattagaaattcgaaacagggaaggttaattgtctccataagattttggttgcccaataaaatgctccaggagcgcatccggacagtggctgaggtcatttacaataccgtggctttcaatattttcatctttctccctgcaggatcacgcagatttgcgaagccatttcttcacagttgggatgaagcttgagacagtgaatatgtgcgagcccttttacatctctcctgcgtcggtgactaaggtgggttttcctccctcgctcttcgacccagcccctagagtggatcaaattaagcctttcaactcaaagacgaccagatgacatatgttcgtgcaaggctatcagcaatgccaggcgaagctaaggaagattgccgcccttccagtccagcgctgctttaagctgtttttattactggtggcacagagtgactctaatcagatgccccctcttatcatggatagggtgaattttccttgtcttctgatagttgtccactgacgagttgcaggttgtaatcattacaagagtaatttgttcttcctgcatgggtagtagtaaatatgatctgtttatacttggaaaatacatgaaaatggtgcaaagcaaattctcatctcccttttctcagcatttctgtgttttttctcatctgcccttgttgactaaagaaaaactcatgcttctaagatctacagattcacaataaaattaccttttaacataaagacatttttataatgatctgttagtccttgaagattgtaatatcccagcaggtcatggtggctcatatctataatcccagcactttgggaggccaaggtggaaggatcccttgagcccaggagttcaaaaccagcctgggtaacatagggagaccctgtctctacaaacaataaaaaaattttaaaaaccagtataatatccattccccattaaagaagttttaatgacataacctctggtaaaatcaaaattgcttgtttctaccttaagtattctcttacaaatggtgcgggaaacttaacattcttggccgatgtgtgttttggtgaatggtcttttgtgtacttcactaggagaatttaattaaagatttaaatctgttttaatttctttttcttaaagatacgggattttctttaaggaaaatcacttttcatgcagtgattagtgtttgttacttgagtcatgagtttttaaaaatttatgatttggtaacacttgaggaatttagtagtgtgataatgtattacagaatatggaaattggttataaaaatgaaatgctttctaaatgttttttctttagtgaacataaattatttttataaccattaaagtagcttatttcaaggataactttcggagctgggcacagtgactcatgcctgtaatcctggcactttgggaggctgaggtgggatgatcacctgaggtcaggagtttgagaccagcctggccaacagggtgaaaccccgtctctactaaaaatacaaaaattagccaggtatggtggtgcatgcttgtaatcccagcttcttgggaggctgaggcaggagaatcgcttgaacctgggaagcagaggttgtagtgagctgagatcttgccactgcactccagcctgggcaacaaagtgagactccatctcaaaacaaacaaacaacaacaaaaacaaaaagaaactttaaatatttaaggttatttaaagaaaaatatattggcttttgctttataatctggaggttgaaagtcatgtattcctgattagcatccgttaaaaaccttttatttgaaatggcctttggagttctttactgtgtatcctgtcagttgtcggatatttttccaaaatggaccagtggtgccctgttgaatcccagccagaattcccctttgttctgttagtgggtgctgcagtcatgccggctgcccatctgtctgcagatgtatcacgctacagagtcgcttcacctggtatttatcaattaaactcaacagacttgatgtgcatagcctgtcagcggtagcgtctctcaccattcttttttttttttttttttttttgagatggagtcttgctccgtcacccaggctagagtgcagtgacatgatctcggctcactacaacctctgcctcccgagttcaagctattctcctgcctcagcctcccgagtagctgggattataggcgcctgccaccacgcctggctaaattttgtgtttttagtggagatggggtttcaccgtcttgaccaggctggtctcgaactcctgaccttgtgatctgcccgcctcagcctcccaaagtgctgggattataggcgtgagccactgcacccggcctctctcacattcttatgcctttaaataattcttatgcctttaaatagttgtaatatgtcatgttagaatgtgtctactaatcaaaattaatttcagcccaaatctctttttctagctgaatagacttccagtgatagttggtttttcacagtaaataattttctctaaatagatcttattgaggggagggagaaagtatttttactgatttctaaactgtgttttcctttttattttgctttttcttaccctttgtagcaaagataaaataagtcatgccgtttcgtatayacccctcctcttattgaccatgttttgtataacacatggattggggtatgtgcatctgtcttttagaacctaggtaggcacctctccaggttcaagactcatcttcatgtaatgaggtatcagaatactcttagcgtagaagatatttataataattaaatgtatttctttaaatatgaggaaagtactttggaatattatgtttgaaaatataacacactgtgctgtcattactcatcacaatgaaaatttcattttttttccaccttgggccttttcttcgtggcataactgttgaagaaatatgtaaacgatgttacaacaaacagacaaggatgcagacagacgtgtagtggatccagtattaaatgatgaacctccagcagtccagccagggtgtgtttttggtgttgagatactggcagatggtgatgatgtcatctttgtaagcgaagtgtgttgtattgattagaggaaaggatactggcattagaagccttgggttctgtttctgtttctgccatctcttagctgtgcagtcttgggcaagtcagttaactgctctgggcgttagttctgagtcctgtgggttatggactggatagagcacaaaacagtgcttcagaccatttaggaacatgagccctgatggatttgatgaaacttactaagcttttcctttggagtgttcccacgtgaacatgcattttaacggttgtggaaattccttctttacagggtaccgcagctccaccaaaatcacatgctctttatatacgtatgtgtgtgtatgtgtatatatgcaagatagactaaataacagtaatttaacagatatttattgagcattcataggctcaattctggacaatgttcccattgtggagcttttattttaatggagggagacagactataaacagaatcaataagtaartaaatctagtatgttacatattaaatgctaaggagaaaaatacaccaaggcagggatgttggggtcctgggactgtgccccccggtagcagtgaggaccccaggaggccttggtgttagtttccctgttggtaggcacttggctttgcaccctgagccagatcgccgtgcatcagttttcaggactgtccagtggagtccaggtgcccagcagagtgaaaatgatagaagtcaaaggattttcataatcctttcaggtggtgggaggatgagattctcaacagggctctcggacatgacctcactgggaaggccccatctgatcctttgttgcttgaagttgactttcacaggcaaaccttcagtaaactatttaccaaaattagcacaggcaagaacagaagtgaatttcctttcctgcttcactttgaactaaattgcttccagaaaaaaaatgaaggggccaggaatcatagctttgtaaaactctcaaggtttcctaagaaagactgggttatgtctgttgaattgggaaagggatctttttttctggcctgttktagatactaagttacttaaatccatcttgcttttcagtgatggtccatctgatttttaccctctgctttgtttatcggcatgtcttgttcttatttcttcattgatgtttcttcttatattcagtggacatttatccygttcctatgtacaaagcactttctatgcatttggaaatacttgtgttaacaaaaagacatcactctcctctaataacttatgctctatggcattggaagactgatgtgtaatcggtctaggaaggaatgagagttttcaatacagaagttgaagtctgaaattttaggagcgcagagtgagggcggtttattccagccagatcagaagcattgaaatatgagatgtaccttgaaaacgcactgtgttttgatagcttaaacatggcattgggggttgttgtagtccatgaggcttagtgtgaacgatttcctctcgggctggagggtggggtgttctgagggaaaaggtgcaggaggaggctagaaagctccaagccagatcttggagattcttgagtgatctggtgtaaagagtttggtgctggctgtggacactgagaaacggtttcacttttcagttcctgtcttggctgtcatctaagctggggtttgtctgtctgacttcctccattcatttttcttcaagctatagccattggttgacttctctaagtctttgattttgttcattctcactcttccagataacctagttatttatcttttcattaataggaccacagcagtcaattctaactttttatcagctgaattaatttagtaatggacattgaaaatgccagtttgtattcaaatcattttgatgaactatattaattgcctttggaagctctgccactattttatactagcattatatgtaactctaaagaattaacctttggctcccccattttttttcttttaggtttttaacaatcacttttttcaagtgactattgaygacctaagacctgaaccaagtaaactgtcaatgctgtgccatgcagattctttggggattttgccagtacagtggtgccttaaaaatggagtcagcctcactcctcccaaaggtttgtattctgtgaaggtatgcagggtctggagattcaggagggtgtcttactgtcattgaagtaacacctgcattaatctggggagkctggttgtgtaaagggtttagatgtagtagaaatagggcgttcttcatcagcttgacataggtgtcagttacagctccatcccctggcgaggcgagtggccttgggcttctcacttctgtccacaggagtttccccatccgttaccgcattattggcagatgtgctgctattgtgtagacttagagggtgcagcattgctaagtgattgagctcaaagacttgaaagtgtctgagaagtggctttacaaatgtaacacaatgttggtgaagcatttctttagagtgtttatttccagygagctaagctttctccagagtcaatttgctttcagatatccgacaattagatgctataatactttaaaataattacactgggagccaggatgcattaaaataattttaaattgggattcaagaaccacattgttagtgagtgccagtcttagagtttaccagtgtggtttgttgtcctctataggtcrggtttattcaggaagaaagcagtaagatgagaggtgagactaagagaagaataataaaggtatagtaagaagaagaaaattggaaaaagatgagaaaagtaaacttattggggaggattttaacagacaaacttaaataataaggggttttgtactaacctttccagatctctagggattggattgcttgggacattaaccctattgggagaatcatgcagttcccacaggttgagtcccatcttgcctggtggcctcgccagtctgtttacatcatttaatggtgcctgcctgcttacctttactatgactgtactctgctgggcttttatcttcatttttccccatatttgtccttacggaggagatgcttttgaatatttccatttcagctttcaactctttgggttaaagttgtgcagtcatggagttccgcctaatggtatatggtaaacttacacagaacacagtttaccagtcactgtttttaatgcctaattcattcactcctcaaagtgaactatgaagaatctaagtcacagagagtttatataacttgcrcagggtcatttggatcgtaggtctccaggcagagcttgggtcctgggactgtgtcccctggtagcggtgaggactccaggaggccttggtgtttgtttctctgttggtacayactggctttgcaccctgagccacatcactgcttcagttttcaagactgtccagtggagacacctgtgggagtccccaggtgccagcagagttaaaatgagtcgaaggattctcatccctttaatatggccttgggggagtcatattatcaacgacctattggtagtaggtgggaagtccttcgctgctgtggaattagccataggtcctgtagagtttgaacaccctgtgggccatcttcctttgcttcctttggacttttctcatggaagtatgtgtggggaatgggtcctgtgtcattgaaggaaaactttttctagatatgtaaatgctacttggttagactttgcttattcctcaatagtattagaatctattatatttaagaattttgaaaaaatggttggctgtttcctcattgagtgaaaaaaaggaaaagtatttatatcagcattttggctgcttgatcactccattatggcagaggtttcatagttgtcaatgttktcagaattttaagatacattttctatgaattacataaaaagatcattgacatagcttagaagttcaccaggaaaatggatgtgcctatttggatacttgagttttatgatattaagaaaattgttttacattaatgcaactgaactgttaaacattcaatgaaaggactgtacaaagatataaaattaaatatttttatattttaagctttttatacataatatttagttatgatcatttcttctcttttatccaaatatttgtgatatttggtaaggtaaaattctcttcatgcattcttccaaaccattcctttctcttgttgaaagtgaaattttctttttcagaaactcaaaagaatatttcttcatggatattatatgcaaatacatactacacatcaagtagaatattgagtaatggtggctagtaccttccaataagaaactataactctttttaaaccattaaagcattcaagaagtggtaaatatcattagttcagtgtactagtctgttctcatgctgctcataaagacatacctgagactgggtaatttatataggagaaggggtttaatggacttacagttccacacggctgggttaacctcctaatcatggtggaaggcaatgaggagcaggtcacgtcttacatggatggcagcatgcaaagagagggcttgtgcagggaaactcctgtttttaaaaccatcagatctcgtgagacttattcactgttaggagaacagccaggaaagacctgcccccgtgattcaatcacctcccaccaggttcctcccgtgacatgtgggaattgtgggagttacaattcaagatgagatttgggtgaggacacagccaaaccatatcattcaagaatgtggtaaatatcattagttcaggaatgttttcttgaaatagtagaatttttactcgtaaaccagtaagaaaaagaccagcaacttacaggagtgtggacaaagaataacctcagaagagcacacaatacaagaagctcagtgactcttgggcaaacttatcataataagagaaacacagatgaagagaaatcctattgaagtggtgtctgcttatcagatgagacagaaatcccaaggagaaggaacaggagaacctcagcttggtgagacggtggaggaataaagattcttagacattgccgttgagagtgcaggaaggtgcaagctgtgtggaaggcagtttggtggattttgctaaacttttattttcccactgactcagtaattccacttctggaaatttccccttaagttataatgtagagatcatctgcataaaagtttgttttttttgcagcattatttacaatagcaaaagagtggaaaaattcaagtacttatcagtaggatattggttaaatagactttggagatccttctaatgagatctgtgccattgttgaaaagaatgagggacgtctctatgaactgatgtggaaggctgtccargatacactgtgagtggtacagtaggtatcgtatgacacttcctatgttagagaagaggcaaaacagtacctatgagtgtttgcttatatttttgtagttacataagaaaataatgagaataattattagtgtttttggggtatgagggacagaggtggggaatgtggcataagggatgaaggtagacatgacgtgtaacaataccatttttatctttttttcttttctrtctaaataaatgtgttacctattaaaaggtaacacatattattaaaaatggagggtttttataactgaaagggatcctaaagatgatttcatcaaccttacttattttatatctagagaaattgaggctcagttgtgttaaatgactttgcaaatcctggtgcaggggtgcaggggtgcaggggtgtcgggttaaaaaccccagacttaagataccaaatctaacgctttttctacacaaccgtatccacacttcactgctgttctgtcttgctgatgttttgtaatgttcctccttcttagtaattctagagagtttggggggcctaaagcaacctaattcatgtcagtggaccatggctttacacaattcagatggtcaatrtatcaaagcagtcagagaattacaattttagggaataattttacaagggtctgtggttaaaagacagtcatggcttcattcattgactcccttactctcttgtgagagtgcagtatatttatttttgtaattaaactgaatgagcatttagaggaggaggtggtggtggtgattgtggtagtggtgttttacrgtttccttttgaggtggttggtttcacatcttgcatctcaacaccaggattaagagtcatattgtagagatgtttcaaagaccattcttcactttatgaaggtatgcaagtagaagcttttttaaaagtaaaaggttattgtgtctaaattaaattcttaggttgacacgtagaatatgtgggatttattgtacatattgccaagtgatttcagatgtttccacatgtgtatgtttcccatgaatgtattgggttgtctaaatttctgttaagaacatggatgctgcctacaattacaatgtgttgcttgacttcaaaaagaggttgggaagcagctgttgaaatgaaagacttccggtggtgtaggagaaatatatgcaaataacacagatattttattgcgttgttttgactctgttcctacttaaaaaaaaaatttgtcctcacaccttagagacaagtgagctagagtggatacgagtttttcagtgtggctttctgtgtagtaaggattttcctggtaagcaaaagttagaatgttggagattttactcaattagtttaaacccaataaacagcaagtcagtttcacaggcactatgaaaagtgatcaacaaataagtagatcacctaagcaaaaatgtgtataggttatcaaccatgactttctattttaaaattatttcattaacctttcttgtgtcacatcaaagattagttgtataattagtggaggaaaagttccacccaggaacttttgtagaaaatgttcagcctttaaatttctgctgtaaaaggtgtgagcaaaggctgaagtaattggcttacgttagcactttgatttgtctctgtttggctgaccatttaatagacacataaactgttaacacaatttaggaagtaaaggtgtattttaattattattgagacacaaagcagggaaccgtaagtcgtattctcttttcctaaagaaaaacctcagacactgactgatgagcttaatccattttgtcactcacgtttcagacataccaaagggggcagaaaataacatagacgctcatggccctaccaccttacttcaacagatgctaacattctgccttgtttgattcgtgtttttcaacaatgaaatatgaaacacgaaagcattatagatataatgaagaccaagtcatccttaagtcctctgtttctcatgccccatacctcatccatcagggagtcctgtccacattttcagagtctcaccacttctcctcacagccacctgtttcaggccgctagtgagtctcacctggttcctgcagcagccccttgtttaactcaggggtctctcaacactgcagtcagatcgatcgtgttagaacataaaccatgggtctctctgctcagactgtccagtgccttccaccccaccctgtgtccaagtcaagactgtggcaacagcctacagcacccagccgtgctgacttccactgccctgtccagcgtcatctcccgactccccactcagtctgtcccagtcactctcatctccctgacgtggcacctgctgttccctctgtgcagacacctgtcacctgactcagtcttgactcaagtgctaactgcttgaagtcgtctttctgggcttccctgttcaatctcagtagcaaaccaccactcccaacatttgcatctccttccctgcagtatatcacagaccttatcatataatacacaaataagtcatatatacgtcccttgtttgtcttgtttttcattcatctcccccactaaaatgaaagatccacagcagcaggggtgtttgtcaatcacccactagtcatcctcagtagctggaatagtgggtggcacttggtaggtatttgttgaggttgaatgaattgaagctctgtccccattctctcccacccctagcccttcacccctcatcctccgcaaggtgagcaccctcctaaagattacatgcttttatgacatgactgcataggcttctttgtttatgccttaccagtatcattgtttttattaccgtcaaattaaaatagaccttatttgactatatacatatataatgcgctatgcatatctttatgtaactttttatttattaacatttttcagatttttttccatgttggggcatgtagattgtttattcattttgcttgctttacgaatatactgtaatatttgaaaattccattttctattggtgaacattgaagggatttccaggtttccctattgcaagtgatccccaaatgtacatccaatgtccccaagtgtaagaggtgctttcaggggatattcctaaatgtggaattgctggaattctgtagatagtaccaaatactctccacgttgtgtcagtttacatttctaacatggtgtttgagcattcccattttgtgtcaccctccctgttttgcggtattcccaggattaagcatggcccctctgaggggagtgaagtggatctcctcgtttcagtgaggtggtcctgatcactaggatggttgagcactgcatcctacccttactggccatctgtggttttcttcttcggcccattttcttttgatcgtagaagtagtttatatattctaacatgaattctttctcagcaatgtgcttcacacatatgataacctagtctggcttgtttctttgctttttaatggttttttttaaaggcatattgaagtagtaaattgtaatgtagtcaaacagccatctttccctgtatgcattgtttatatacctttagaattccttcctactgatgtgttttctttaaaacttgcagttttacttttccatgtttagctctgtaacctacttgacattgatttttgtattggcatgaggaaggaaaactatcttatttttcttgcttgaattgaattgaagtttttcatttccccacttgtctctgcatcgtttgttgaatggtctgctgtttcctctttgatttataatgccaccactgtcatggatccatccctttgtgggtgtgactcttaaccctgttcttttttattctgcctcttcagtctgtttgtatagccctgaacaaattgttattactttataataatatagtcttgatatctattgttgagtcactttttctttatttttgttcaaaatttttggttatttttggcaggccattcttgtacattaattttagcattggtttgtaaggttctataaagagtcccattggatttcggcattgtgttgaatttatagacttagaaaaattgatattttcttatattatctttttatagcttgcaatcttttcttggaatatttcctaggtaccttatccttctgcttgctgtggtgaatgggatttcttttcatttcttattggctgtcagctggtataagagagtaccactaattttgtatatttatgtcatatctagctacctttctaaactgtctcaaaaacagtttgtgtaagatatgacttttgtgatacttgacagtttgggaaaactgtcttataaacctatctggagctgttgatgttgttggtgttttattgagtgtgaatttatttcctttmgtggatataagtttagtcagggtaaccatttgtgagatagttttggtaatgtacatgtattttacagtattgtctgtttcagctgtattttcagatttattgccacatcagttggtcaggtcaagtttatttattgaagtattcagatattctatatcctcactgtatttttatctgttctgtaaatttccaaatggtactttaaaatatcattttgagattgaggatttgttagcttctctttgtttttgtgatggatatgtttgtgcagggtgtgtatgtggggtgtgtgtgtgtatctaatatgtgatgtgtatgtgtggtacgtctgtgtggtatgtgtctgtatgtgtgtgctgtgtggttgcgtgtgtgtgtgtgtggtatgtagtgtgtggtgtgagtgtgtgtgtttgaagttgtgttaaggtgttcagattcaggatcattagactggcggaascactcttttttcctgataaggcattttgcattaaagttyatttctctgccctccctcaagttggttagtttccttatgtggtttgtgattgttgattatgaacyaatttcaktggtggttgttatttatgtggcagttccatgtgccctggattgaagtcatctctatttatttgttactgtctctatccatccactaggaaataaacttcatagggtcaagggtatttttttaatctcttttgttcactgctgcatccccagcaccaaaaacaatgtctggtccatgagggtgtccctgattattcaaggaatgagtggctgaatttgatattaatttctcagtctgtgtcccacggaattggaaagctggaccccacatccgtgtgtgccactggcctggggaagtgcatgatctccttttttcttcttcagaaccccaggtaggtagcccatctctgctgcctctctgatccagtcagcttagtttgtctggttctattttcatagactgggctgctgcctggggccagctgtagatagtagcctcgggtcctcctgctcatctcccttgaaccaggctgtygtctgccctctgtgagctgctcactgctcagctctggctttcagggctctttcaggttttggttttttattttttactttttttttggtgtctggagattttcttctcttttgacttgggctatgtaatttttcaaaattatatttcatctgatatctgtagggagactgtcagatcgtcccgcccggctactggacttggaagcaagtctcatttctagctttctgattcattcttgagcaaaacggtcacttttgattgaaaagagttggtatagtaaaactctctaggtcatttttaatatctgaaaatacttctgattgttgaaaactaagaagaaccttttatgttatccttaaattcacttcattcttcaggatctgtaagatatttttgccattgacagctgatatttatatgatgttagaccccatcctgggcacatacctgtgtcccgtaacattgtgtttataattcagaataacatgtagaacattccctcagcagagaagtatattaagtgtcataccatgaccaagatgaaatacttctcaacataatgttttaaaagataaggaaggcggtagggctagtgcttatattattgtcttctttgtttctcttccttattttctgtttgtttgtttgtttttttcctgcactgttccatgaacgtaaaaacacagagtaattcaattgggaatgaatgaaagtgtcacttttaaagaccagtatcaaggaaggcttgaaactgaacatcacccaagactgtggaggtagctagaagatttcaagagggaggttgtagttttttagcaaacagcatcgacaagaacaaatgctttagtcagtcgctgatgtttgctgtcctgcctgtaagcctgcaatgtacacaaactcctttgtgaaacaggtggaggcaatgttgagaaagttgttttctggaatagacagactggctcctgggacaggttctgccagctgaggtctgtgcaatcttgcctccctgccagggccatgggacattcatcccctgaagggttgccacagagcccctggctttagtgggtgttcaaggaatgttggttgcctcaaaaacaacaaaaacttgggcttgaaaggagaaagatcagctgtcaattggaagagtaaggcattgcaaaaatgccccgaagtgctgctctgtgagttgtgaaactttctcrgaaaggactgagaacctgttcttagaacttaggttctgttgcatcaacatttatgcacatatctgggtcctggtatttgctgactttgaagatgattgtatcacttttcctttccaagggaggtggaactgaaaactaaataagcttgctatttacacatgctcttctaacatttaatagagtaaacattctctggggtgaggaagatctctctatggagctgtttgctctgcagtagtgagatcttcagagccttcttccctcactctctgagtgtccctccatccttgcttttacctcactgtgttatcggtgtcaggctgtgtgtctgttactcccagtagtcgctggagcctgaggattttgacacgttaccaaattgacatctacagtggttttttaaagttccactcccaccacaaacacataaaaacgcctgcttcctaacagcctttagaatggtggattcttagtgttgtttttcattctgccagccaggtagatagcaaacatggtattcctttgctatttttattttttattaagattgtatatgtatttttcgtagccacccaggatagaagaggagtttttattcctgcatgtctcttttgttagagagagaatttttttctgtaaacccttctcctacccatcttaagcctcctgaaaagggcatatggctaccatgagcatctcaagatggtcctgattcacttcctccaggaactggataaagtcaggattctactggcaaagctggaggaaggctgaggggaggcagtcatggtgtatttcatgtgctgagtggactctggattgatcgaccaatgccttaattaccatttaaaatagggcaaagattctgtgttttcaaataattttttattaatgaaataattttgtgatcattattaaaaacttggaaaaatacaaagaggtcaaagaagaaagtagccaagagtcccaccacccaacaattattgtaatatttattattaaggtttttgtacattttctctggtcttcatctttgcatattttatatgaatctaataattctgtatatgtttatagcagtcttttcatctaaagccatagcagttattttttatgaattttttaaaactacgtgccgtttcatgcctgtgtggcattctacagacttggagaagtctcatctcattttctattactgcacagaaggttatttcattttttttcctccagtgttaccagtcataatgccgtaagtgtcttcatgtataacacctttttcagtttttagggtcatttttatgggataagttcccagaagtgaaatggttgcgtcaaagggtaggagtttttttttaatgccaaatagtttttccaaagaattgtccatttacactgccaataatgatgtgtgcaaatagagctgttttatgtcaattagtttgtatccgagggaaatgggtcatcaacctcttcccttttggacctgtaagggttgaaacttcattcagaataaacactaataaaagcttaaataagtctaatggttgtggttcaacagtctctcagggaagcttgctgcaaagtttaattgcctaaggggttttatttcctttcattttcttctcccctctgctgttttcctccctccctccaggtttaaaatgtgttttcctggccacagttaagccttagtacgtcttgttctgtctttgttgattaatgagtataattgaccctgtcatctctattataccatccacagcaatttgtttttatgtcgcagttattttctgagctgtcacaaaactgccttacaaagacagctcattatcagcccaaaggaaaagaatttgaaatgatgaagtgagtaaaggtcccgaagaggaggaggaggaggggacagaggagtctaagctgttggaatgtcagggaaatgagcahgttctagggacggaataattaactgttgcttacaacatagccagcaagacttgattttatctagaaattatcagaytagaaatggctctccatagacagagtgtggaggactgggtgaatagatagaaggcctgaatgtacgtccaagaaaacaygaggcatgacattttagagartgggttgaagctcattagaagttagttatagaaagcccagcttaatgtctttgtgtagggaatagcggtgacttccaggtgggaaagttttatctgaacatgtatggaccataaagattacccacatgccaggctgtgtcagaaaatgctttgctatttttctatatagttttctctcatttccctcctccccaccccagggatctcatctagttttcttcactcttgaaattaactcaggaaatagcagaggtccaggaagagatagtggaacagaaggagatcttgactttaacaaagtccgtcttccaaaaccccagacagatgggatcrttgtgttacagagatgtgtcttcacagatggagtcgtgagtcttcttagaggaatgccttgttaggtaactgctcgtcatccagccacgttacacttttcttttaggagcagagaagggaattaaccacagagagttgggggaaaaaaatccttagtagcaacagtaaaataattagtgatggtggttctgaatcatagaatgtgacagcagagggatctaaaagcttttctctttatttactttattttatttatttttatttcgtgttttgagagacagagtcttgctctgttgcccaggctggagtgcagtggtgtgatgttggctcacagcaatctccgcctccgggttcaagcaattctcctgcctcagcctcctgagtagctgggattacaggcatgcaccaccactcccgcctaatttttgtatttgtagtagagacaaggttttacratgttggtcaggctgttctcaaactcctgacctcatgatctgcctctgcctcagcctcccaaagtgctgggattatgggtgtgagccaccgcacccagacgcttttctttttattttgtgaatttgtagatgaggaaagtggggcacagaagatttaatctactttttcctggctccctcccattactgggagagctgggtcttaaacccagataccctcttctccagttccaggccctttgtcctgttaagaaacttctccgtttgacgtgtcttgaggctaattcttctacagtaatatgaggctttgatccagacagctccagagaaactacgctcaaagtggagggttttcttaattgtagagaaactcacattacattaccttgtttgtgagatgtgttctgttgtattcagaaaggttcagaagaaagtcggctctggtcctgtctagaaatctttgatgcaggagccatttagctggaggggagctttagagagaagggcaggagaaagggcaggtggaagaactcgaagaacctctttgaaagtggctggaaagaattttcagtctttatagaatgaaacagctgtcttaagaaagaaggggacctgccactgatggtcagcaggatatgggaaggtcacgggtcagtctctgggacccaagaagcacagctgcttttttgcttaactgtcaccctcccatcttaaatatatatatatatatagggctgggcggggtggctcatgtctgtaatcccagcactttgggatgctgaggtgggtggatcataaggtcaggagttcgagaccagcccggccaatatggtgcaacctcgtctctatgaaaaataaaaattagccaggcatggtggcgggcgcctgtagtcccagctactcaggaggctgaggcaggagaattgcttgaacccaggaggcacaggttgcagtgagccgagatcatgccactgcacttcagcctgggtaacagagtgagactccatcacaaaaaaaaaaacaacaacaacaaaaaataggatatattgagattgcttawtgaaaataattcgtattctttgcttgggaatacaagtggaggcaaccagtatcttcagtgtcttgagtttctttctttctttttttttttttttgagatggagtcttgctctgtcacccaggctggagtgcagtggggagatctcggctcactgcaacctccacctcactgcaacctctgcctcacgggtttgagcaattatctgccacagcctcccgagtagctgggattacaagcacccaccaccacacctggctaatttttgtgtttttagtagagaaggggtttcaccatcttggccaggctggtcttgaactgctgatcttgtgatccacccgcctcggcctcccaaagtgctgggattacaggcgtgagccaccgcgcccggcctatgttgagtttctttaataaagaatttccatagtccctctgcatctgatttagtaactaaaagtccttatgataagtgagtttgcactcatagaatctgtgacaatatggggaaaagaaactgggggatttggataaaaaaacataagaaatctcttagagatttayttcatgtagatttccaccaacagagagcactgtcaatgaagatactaggggcatttacacacttcagtgaatcacagttggactgtgtttttcctttgcttgtttacaggaaggttttgacacctcactcctttttccttgcctgtccattggtttgattttgtgccgatgagactcccattaagaggcattttcctccctgggttatgcctttcttaggtataattcagtcctcttttctctcacctcgtctcctgtcttgccatggccatgatggacatttatatagttgcatcttccccccaaaaatgaagtgaatacaaagaaagagagagagagagggagggggagagagagagagagagagagagagagagagagagagagagagaaaggaaagaaagaaagaaagaaagaaagaaagaaagaaagaaagaaagaaagaaagaaagaaagaagccactttagtaggatctgtagttggttacattcagtgtatatgaagagttgttgttcaaatgcctctctcagtatatccaaactgcccccagagctttgcagcagagacctgcctcctgcaattctcatgttccttcagcctcagcaggtcagttccagggcaacgtttgccttccttccctcatttctctgggagcttttctctccaaaccctctactctttgttgccctcttctctaccttctgttactttttaaaaagtcgtccctggtactgttttgtttttttttttttaattttttatttcccagtaaaatctcatgttttccataaagacaccgaaaagtaagctcccacgaactcaggcttcctatgaagggagatgtcattgtctatctctgcacagtgcgtggtgagagtgtattttatgccatatcctggctcagctcttcccccttatggcaaatccccccaccggctggtgccgccatgggtaagttccacccttcctcacctggcttcagatagtgtgttatagtaacgatggtttacctgtgtttagtactttaatttttccaaaatayttcatctgagcttatgaaatctgaagtgctgttaggcatcagaggacattatcttttgggagcctaaactttcaccccttctgattttgctcatctgtctgggattttgcttaatgtgcgctgttttatctgtgttttgtcattcccaggttactctggccaggacttcgactgggcagattatcacaagcagcatggggcgcaggaagcccctcccttctgcttccgaaatgtaagaagcttctctcttacctaatttttaaaaatcatagattttgtctacygtaagttttataacttgctttttattgatgaagcacggttggagtattacagtgcactggagaactacaaaatgtctgtagtttttggaaagctctgctttcaggttgtatatttgctagggtgatgctggtctgtgctaacaaattgactaataaatgcacagtggctggaacatgctaaaaggtgatggccaggtctcacttatggaagagcccagggtcttcctgattagtaggtggttctcattatggtgagtaacctagccagcagaagggaaagaaatagaggagaaggtatcactagttctaaatactgcagcctgatagcagtgtatgttattgctgtttactttctactggtgggagctctttgcctggctgcaccatgtcacaggtgaggccagtaagtgggtcctgcctggacttgctgcccagctgtgattctgaactctggagtgaagaggacacgttttggtggacggctggccatctgttcccctgttagaggaacacttgctgtgtagcatcttatccacgaacccactgataggagagtctttgctcttgaggcctagtcttaaaatgctgtcttacctattttgatggctttaatactttctttgatgtccagttagatgctagtgacttctgtgctttgcttactttaagctactacctgcttcatatagagctaattggaacataataataggatttttgtgacacataaagtggcaatgagtgtgtgtgtgtgtgcacatgcgtgtacttacagagttattggaggtcgttttataaactacagtcatgcattgcttaatgatggggttatgttctgagaaatgcatcatcaggccgcttcattgttgtgtgaatgtcatagagcgtaccttgtacctacacaggcctagatggtatagcctatactacatacagctctgagattcatccatggcctggatggtatagcttataccacatagcctaggttatgtggtataaccatataatcatatgggaccaccattgtatacgcatttcatcattgactgaaacgtcactatgcagtacatgactgtagtttacaaaattatcaataattcttcaatcctaggaactgtgagtagagatatcaattatctctgttttaagaattaggcttaaatgtatagtctactgtgttcaacatgcttttagttaggaaagttaatttatgttaagacaaaaagattatagcctcctcttacttgagatctgtaacaacagtgcaaagcactcgctggtcagagacttgtttgctgagcatgtcttcctggagcttgcggkttcgttgctgccacactgtcattgcactctagacataacaatatgaaaaacgaagcgagaaaggggtggctgcataggcagaagttcaaaagtgagtgcaagtcaaaatcggagtttggaggattcagtaggttgatgactgggtcagctggtacttgtaaatacagaagcacatcagcagcaaggttggaaatcaaggatccttctatgattgaacgaccttgagaagcagctcaaatctcagtcgagttctctccttatctaggctgcttggagcctgcctggcacctgcatgatccggggagcagtcaaaaatctaggcagaatttacacatagaatttgtggttcccagtccgggctctccgcaggattgccaccgaatgatgtcgcctttgcacaagagcggtttctctgtatcttgaagaaccgagtggtgtgtgtttaggtgacagggccagctgcatagccatgcccccatgaggactgcagctggttaactctgaaagctttgatgtcctgtgctgtcttgacttctcaccgtattgatgtcacagtcacagaatctgctggcttgtctgctttcattgagggccgtggaaacatcttatagcaccctaaaacccttttgagattgtgttttgtacctgacaaggtacaaagagaaatattccttccccgaatcattaacttttggaagaaaatccttctctctctctttcattctatatttaaagagtgatttcttctatggcagtatagtccttgccccactaaagcttctttttatcagtcctctgttcccattcgcagccaggaattgtccacatggctttgaatggtagagtaaatcaccacattcccaggtggcttctgagctttcaggatttgtccaccaagatgctctctgtttggatgaatctgcgggcatgttcaggaggaatgtctttgtttctggcactccrtttatgtaatagataggattgttgacgtatgcatcgcattggtgatgctttgctgaatttgttagcttgctataagtgctctttaacggaatgcgtattacgagttcattttttaatcacacatctcctgtgtattagaggagagctagtgtggaattggatgcatggaagacatttccccagggatgtttaacagaggctgttatgaaaggaatcgacacagtaaaatgcttggtaaataaactcacaggtaacagttttgctattgatcctttataaattaccctcaagcggtggattgaaatgaaaataggttatgtggttgtagctttcccttgttaagaaggataaatgcattttaacttacttagaggtttttcaagcggccgatgggattgtattttcagaaggaagctcaatacataatagctgtgcgtgaggctgggtaacttgcagaaacaaatagcccacctagaagatctttgcttcctatttccaaagaaatgtaaaggcatggagccagttgatttcttaacatgcattggatcacttttttcaggttacataaagatatagttatatttttcaaattaagttttagaaaaagacatgtaaatgtgaattaccttgatttctttccacaagtcagaaaaagaagtagtctctgttacttacaggaacctgtttatcttggtatccataagtatataaatctatagtattataacatgtctgatgataatttatagtagttggcaatttgggaaaattttatatttattttaaaataatgttttcagtattggctgagtaagctcatactgaattgacccttctgcctgtagagcagctctaaagtctggacacaggaccaaaaacgactatttgaaggtagtggaacgtgagcaaaaggaggcaggagaacaggagactggacgaagggaatagcatgggagaattgtcccatttttttcagacttttagcttgagggcagccacagttgacgacatgtgggagagtgatataaaattcatggtctctctggcctgatgaaccatattacaaaatttgggcaaccacagatcctggaaagtgaggggagactcagacagtggagagccaggatcgggaaccccagattccatgtgtaaattctgtctatgtttttatggtgattcctgaatcatgtaggtgccaggaagactccaagcagcctaggagaggtgaactcaattgagatttgagctgcttctcaagaggcagagtctgtagtttcagtccaaccaaggtgatagcttgataaaatagaaaagttgacacttttggtaggaatataacgtaatccagagtcgccacaacataacatttaaaatatccattctttaattcccacattgctcaagacaaatgggaaaatcagcctcattcccaatagaaaagaagaaatgggaaaatcgcctcattatcaatagaaaagataatcaacatagactaaaccaagcatagactaaacccatcatgacccaggtgttggaatgagcagacaagtattttcaagcccctattgtaactaagtgtgatgtaaagcagtggtcctttaaagggtggtcgtgagaccagcagcctcggtatcacctgggcacttttcagaaatacacattctctggctccacctacaatcaactgaatcaaaacgttggggagaagcccagaagtttatatttttaaaagattttcaaggggattctgatcctaaagtttaagaactgtagatataaaggaaaatattctcataatgaatgaaaagataggaagtcccagagaagaagtagaaactataaaaaagagaaattctagaactcaaaaatacaatatttgaaatcaacaaatttattggattagcttaatcggaacgagagaggaaagagtccatgaccttgaaaatagaaattattttgtctgaaaaacagaagatsggcagggaaatgaaggacaaatggaatctcaggatctgagggacaattattatgtagaattgaagacccaaaagaggtggctgaataagaattaaaaaagacatttcatcaaagaagatgtatggatcacaaaaaaacatgctcagcatcagtagtcagcagggcaaatgcaagctaacaccaccgtgagacaccactagatacctattacaatggctggattttgaaaaactggcaataccaggtgctgatgaagatgtgtagcaactaaaactctcacacactgctcatgggaatgcaaaatgctgtagcaactttggcaaacattttggcagcttcttagaaggttaaatattcatttaccatatggtctagcggtcccatctctaaaaacaggcaaacttaatggtatgggttgaattgtgcctccctcaaattcatatgttcaaatcctaacccccaatacctcagcatgtgagtgtctttggagatacggtctttaaagaagtaattaagataaaatgaggtcctatggatggaccctcatccagtgtgactggcgtccttataagaaaagagggggccaggctcagtggctcacacctgtaatcccagcacttagggaggccaagatgtcaggagttcgagatcagcctggccaacatggtgaaaccccaactctactaaaaatataaaaaaattagctgggcatggtggggcattcctatagtcccagctactcaggatgctgaggcaggagaatcgcttgaacccaggaggcagaggttgcagtgagctgagatcatgccactatactcaagcctgggtgacagaatgagaccctgtctcaaaaaaaaaaaaagaagatggggattgaaccccagcagatcttaatggcttagctagtttccccacctgtaaaaatcaggacaytcttactgctgtttgtgttaggtaattaacagccgtaaagcatgctgaaagtagaaactgctaaatacacacagaggcctgaccacatgaggacacagggagaagacaacatccacaagtcaaggagagagacctccaaagaagccacccctgctgacaccctgatctctgacttccagcctccaggaccatgacaaaataaatttttgttgcttaaacttcacagtctgtcgtattttgccacagcagcctgagcagattaatatacttacgtttacatgaaaagttgtaccagaatgtttaatgtttatggcagctttaatcacaatcactgaaaacgactcaaatgtcctttaactggtaagtggatagataagctctggtgcatctgtacaaactactcagcaagaaagcagcacaaacttccatttcatgtaatagcatggatgaatctcagtgtattatactaagtgaaagaagccagactcgaaaggctacagatattgagtccatttacatgacttacagaataaaatggggattctgatcctaaagtttaagaactatagttatacaggaaaattttctcataatgagaatataaagaaatataaaggaaattataagaacagaaaacagattggtggttgccaggaactgagtgctttggagggactaattaccaaaggtccccaatgcaagggtattttgggggtgaagggatggttctgtgtgttgattgtggttgtagctgcataatgaaattcactggtctcacagccctaccctcggagaacagtatacccaaaagactgaattttactctatgtaaaaatgtttaaagtgatcttaaaaagatagcaataaacaatagcaataaacaaaattagcaataaacaaaaagaacaaaggaaaataatagcaataaacaaaaagaacaagggaaaataaagatagtttcaaataaaaccacaagaattcatcatcaaaaagaactacactattatgaaaaaatctttttttttttttttcctcatttgagacagagtctcactctgtcgcccaggctggagtgcagtggcgagatctcagctcactgcaacctctgcctcccaggttccagtgagtctcttgcctcagcctcccgagtagccgggattacgggcatgtgccaccatgctcagctaatttttgtattttagtagagttggagtttcatcatgttagccaggctggtcttgaactcctgacctcaagtgatccacctgcctcagcctcctaaagtgctgggattacaggcatgagccaccacacccgaccttttactacgaaaaattctaaaggatatttttcccatttcctgtaaaggaaaatgatgccggatggaaattccgtgttcccacttgaactgttatcaatgggtataggaaggtggaggaaatggtgtgtacttcagtgatcccatagaaggaagggtgcagccgggcacggtggctcacacctgtaatcccagcactttgggaggctgaggcaggtggatcacaaggccaggagatcgagaccatcctggctaacatggtgaaaccctgtctctactaaaaatacaaaaaattagccaggcatgatggcaggtgcctgtagtcccagctactcaggaggctgagttaggagaatggcgtgaacccgggaggcggagctggcagtgagccgagatcacgccactgcactccagtctgggcatcagagccagactctgtctcaaaaacaaaaaaaaaaaagaaagaaggaagggtgcatatggaactggaaagagaatgaattcatactctcactcgtttaacaaatagtattaggcacctactatgtgctaggcatagttctaatttctgggaaacaaaaatgaagaccacctggttctttcttcatgaacagtgggaaggacaaacacatacgtgagcctgtcttgtcgatgtaagatgcgtgtgcgtgcatttctttcyctttcttcatctgcccagctttgtcctgctgcgtcagcactggctcagtgttggtctcgtttctcttgcagacatcattcagtcgaggtttcacaaagaacatgaaacttgaagctgtgaaccccaggaatccaggagaactgtgtgtggcctccgttgtgagtgtgaaggggcggctaatgtggcttcacctggaaggtacgtactygctgggggtagcagtcgctggggggaatgtagagtttgtcgaaatggcaacgtgtggaggaaagcagcccttctcagaaggggccttacttctctttcatttaaacagatcttaaattattccgtgttcttaaatcagtgaaactaatcaaacataaatgtagtcagaggctctcatcttaactaataatttcatgcaatgagatgctggcaagataattatgtttggaacacagtggtctttttacatctatgattagaaaagcaaatgtcacaattaaattaatgtgagtcactaaaactgagattccaggtctcggttattatcaggacaaaattgtacatttgtattttaatgtggttatatcctttactttgatttctttcgtagttgtttaattcttcctcaaaatagtacctggaggatgactttctccccaaatgtctaataaacagaatttaggcttgtttgttcagtgatgttgaaactatcctttatagctatagcrtatttacaggtgcaagaaaattcacagaatgctgtattttgtgaacagaatcctgatcatactttatatttaagtagaaaaccatattttctaggtggtgggttttcagtgataaatatttacaatggatttgatctccaagactttcccatctttctgtgatttataattctttggttttttttcctaggatttcataatactcagtagttatttcaagtatatatgcaaaaatgaatagatatgaatagtaaaataaagttagctctcctagttcatagtttaaatcttacgacttactcaataccatgattggaataaagagtttagaaggaaaatcatagaattggtgctcagatctccatttttatttcctcactatgcatctataaaatgtctgcaaaggtcttaaataagcctacaatctcatacatatgtagtccaggggattgggaaatgtggaaaacagtcattgtggctgacatcattgtgttgccaattcccagaaaattgtttaaaacgttactgaagtttagggttccaaaatcaatgtgaaataaatggaaattcccaaaaagttgattgcttagtaggttttcaagtagaatggcctctttctggaattcamgaaagtgtagacacaggcaacgtggcaacatttctgtagcttacaggaatagaacatggctttrttttcacagctccacctagagttgggtgaactgctcttggagaagcaagattccttctgtattttgtaatgactaaatttaacttgctatctaacactatgctgagccatcttaacaagattggactcttgtttgcattattaatttgaaaacaaaaatggtcaagttaaaagcccatgttttatccttattacttagtgcgttatggttaaaattcttttgcagtcattatttatttagcagtttctactttcagcatgctttatgactgttaattacctaacagaaacagcagtaagagtgtcctgatttttataggtggagaaactagctaagctattaagatctgcctggggttcaattccattgctcttgacattttctctgttgcttaattccccagaccctacggcttcccacgtcttaaaaaagagtratgaacaacatttagtgtatatttaacattttgggcagtattttcttctttgtcctgttctctttgaatacagatttttgattttctagcaaagaaatagaagtcagctcatgtccgatctttttcttattccccagagtgttttcattgggtagtgatgaaaattagttagtgttaggaaacagatcagaaaatatacattgaccatttttccagacctgattcrttgttctaaaaagtgtttgtaaacagtctgttgagtcttatctgttgaatagtatattacctgtaattattgctcaaaatcatgcatctttttcattacttacaaaagatactgcatacaaataaagtaaaattccagtcagtttcctgggtcttgcttgaattttggttttggttttgattttggcccttactgagcactgacctttcagagtgacagcttaatggcacttagctctcattatttcagttttatctatctagtgtttcctttcctccatgttgggaataaaatgatagagtttcatcatggtcactttgtggctgctaaatttttttatctaatgatgattattccgattataggccatttatttgacactttaaatttataaagtactttgtaacaattttattagttattttcgtgcattaaattgatttgaagtgttttcaacactagactgaccacttttaggtaattaaaataattctttctagttaatatctgacttctcttgaagttgattcattctttacgtgtctctaaaggggctgttgttgaagagggagcaatgaataaactacatgagattaatgtaatatcattttaagtgcatatttgaaaagaattttaagctctcagaaaccactggtagttagcaagggtgactgatgatgatggggccagtgttccggaaaggaggcagtgccttctcctaggtcagtgttctgctgcaggtcatcatgtctgtaactgtgaatattgttcatataatacaagttactttcagtcttaggtctctagcattatggccgcacacactggctcccacactcacagctctgcctttccacaaaccaagtgactttctrttcatttccagtcctttttttatgggacaaatacattggtccagcagttcggtatgctctcctagctctttagcccagaagaaggttcgcctgcttgcattgtcttccttagcatctttttttggagtcttgtttctcagaatcatttttcctggacacctggctaaatatatacatgcrcgccacttacatgcacttcaaatgagacctggtagatttctagctcacgtttagcagttaatgcaagagattgacaagaacttttgggtggtttcattgagatattttattgaaaaaatttttcatttttaagaatggttttaaaatatatgtaacatcaaatttaccactttagtcattttaaattatacagttcagtggcctaaagtttatttacacagttatatacccatcaccaccatccatctccagaacatttttcgtcttgcaaaactgaaactctctccccgttaaagtctcccttccctcctcagcccctgactggcaccattctccttcccgtctctatgaagttgatgacttcaagtacctcacatgagtcaaatcatgctggatttgtctgaaaatggccttttacaagatttattatcaatcataaataatgctttatgtttatctactttcatcataatttaccatattgtctttttggtcctcatagacctggccacctattggcaagaatattaaattgtaggtggcttgttgttaatggaggactgaagagttagttgatagaggggctggtcctgattcctcggcttccttggaagtgtccccagggacacattaaaaggactagggacacagaggaggaagaacaggtttggaaggagacagatttgaatagcaacagttgcattttaagatacggatggggattccaggtgaggaggcatagggagtggygggaattttgacactgaggccctcatcagaggctacaggatatgtggggacggtgaccacaaactttgcttaaacgaggagacttttagaagcaaacggggcactagccagatggggcactggcaaggaggggacagcaagatagctcggtagtcacttgagccactgtattagtccactttcatgctgctgatgaagacatactcaagactgatgagaaaaataggtttaatggactcacagttccacatggctggataggcctcacaatcatggcggaagctgaaaatcacgtcttacatggcggcggcaggagagaatgaggccaagcaaaaagggaaaccccttctaaaaccatcagatcttgtgagacttgttcactaccatgagatcagtatgggggagctgccccccatgattcagttatctcccaccaggcccctcccacaacacatgggaatttggggagctacaattcaagatgagatttgggtggggacacagccaaaccatatcagtcaccatgatctgcggtctgcgatgggagcggggtcggctgcagtcacagcagtttggagccaggcagtgccaggtgtgaacgcaggctcctggtggccctgtggccttgagcacgttgcttaagccctggtttccccatttctaaaatggcaatcatggtattacttatagcaggggcttggtttgcattaaagcagttagcagagtttccaggaagaattttccgagagagaatgaagaggaaattctcaggagccagagagggactctgtgatggacctggttccttgagaatgtgctcaagtcttaggcactgagctgctcctrgtggctgggatgaacagacaatcccatgggggtctataccgcctagcgagtttgtctactgtgttcgatgcacggggagccatccctagtagaccctcaagccaaacacagcagggaaggaggagggaagcaggtcaggccctgatgtctatgaagttgagtcagtgggcttaaattcatcggccagccgccctctggcacctgcagcggactctcctccctgcagggttctgtgctgcctctgcggggccctgcctccatggatgtgagccatgcaggtgaacccaggttctgattgcctagggagggattccagtgcttggttgagcagagcagtgccctggagcccccatgtacagtgttggataaaacaacccctgcctcaggagatgattgcaacattaattaatctatggagatcccctaaaacaggttcaagaccataggaaacatttggaagatgttctgtatatttttgttttgttttgagacagggtcttgctcttgtcacccagactggagtgtggtggtgtgatcacggctcactgcagcctcagactcctcaaataatccttccacctcagcctcctgagtagctgggacttcaggcacgtgccaccacacctggctaatttcttttgtatttttagtagagatgcgggtcccactatgttgcccagggtggtctcaaactcctgggctcaagtgatctgcccaccttggcctcccaaaatgccgggattacaggtgtgaaccaccacgcccagcctgttttctctgtttttgtcctcatcatgattcatacacttttcctcctatttagaaggaatgtgatcagctctctcttccccagtgctgagtattttagccttttagttgaggcagaaatgcctttcatgtcacaagagttaggaagacaagcagacttccttacttctgagttatttagctctttcagttgttaccactgcagaaattgttgaagagagctttagagtgcgaataacaaaacccagttttgaactggggagccctgttataaattaaaacaggcatggaatctgcagttagtgtttttgtgctttgaatgggtgggaaaaataaataatgacaaaacacaccctacaggtatcaagctaggaatctgtgctgtgcacagctttggacagtaagtttttggagttcaggaattgcctccttgtaccacgaacttcacattccacactgacaagcacagcacttacgtgcaaggcaggtcygctacgtgtgtagtttctgatttctgcaagtgtgtttgaggagcagtatggggatcccataagtccgtagaatttcctcataggtatttaaacacaagaagcagtgatagctcaggaataaatctaatctgtcctttgcccatcttaagaaatgcgtcactctgcaattgtccggtggcatcttcccatttatctgactggttggtggaggtgggttagttctctgaactcatgctgttatgctggcctttccttctccacttgcttcatttgtacccagcatccaagacaggaacgcaacacagcaacccacaggggaagttccccaacctggcagggccactgtcctctcttcacctgctgcagtggcctgtgttcttaagagtggtggccggaagatgctggacgttttcttaacctcttgttaagaaggatcgcatatattctccatctcctgctttggttggttgtttcttgctttttactcgtgatgttttctttttagtacgtttctctaccacccttggtgacttctgtctctggatgttcccactcctttcctggttgctcctctgtctcctccatcttctgcacagtcctggggtggcagggctggctcacttcccaccgttggctcctccccagatgacttttcttggcctcttctttgccctgcttttctcagatgtagaggttagaatcccccagtcctgctcttcagccatctgtgcccagcgtggcctcgtctttctctgtggctttggacggtcacgctgtgcacrcggatctgagtgcccatgcccatggcatcacacayggatctgagtgcccgcaccatggcctcgcacacggatctgagtgcccgcgcccatggcctcgcacacggatctgagtgcccgcrcccatggcctcgcacacggatctgagtgcccgcacccatggcctcacactcacaactccctttccatcccctgcaaaacatctccacgtggcagcagcatttccagaacagaactcaccagcagaaccgtcagaacccgtctctgctcttctccgtgaacgtcctggctgacgaatgatgccgttattcacccaagtcggaagccacggcatcctcaaagttagaaactctacaataattcctgccctcccaccaccacccccacaacccatgagtcacttcagtccggacctccgcctgtcctcttctggcccccacattgcactcaggccctcctccctggctctgtgatttcagccgcctcctacctgctgtctctgccctcttcatggggctttgaggttatttctgtaaaatacaggcattgccttcctcctaatacacagtaggtmtgtgtttcttttttttcttaatttttttattttactttaagttctgggatacgtgtgcagaacgtgcaggtttgttacataggtatacatgtgccatggtggtttgctgcacccatcaacccrtcatctaggtttgaagccccgcatgtattaggtatttgtcctaatgctctccctccccttacccccaccccttgacaggccccagtgtgtgatgctcccctccctgtgtccatatgttctcattgttcagcttccacttatgagtgagaacgtacagtgtttggttttctgttcctgtgttagtttgctgaggatgatggtttccagcttcatccatgtccctgcaaaggacatgaactcattcttttttgtggctgcatagtattccatggtgtatgtgtgccacagtttctttatcccrtctatcattgatgggcatttagcttggttgcaagtctttgctatcgagtagagactaaattccataacatgacactcagcaacccatcctctgtaggcacatatgcttcctggatgtgtgaacttggcactttctgagtgtaaaatcttttttatttgtacagctgtataaaacagctagtgatagagtctcttataggatggtggcaagtggatgaacatcgatagagtgtaagagtcatgttagcacgtagtagtcattgcttagtaaatggaggttgctgatagtattattaggcagcacttttcttttaagatttgccacctgcgggagcctgtgctccagctgaaaggagcacttgtgtctgcaagcctcctgatttggttcttggtgctggacactgtcccacagggctctgttcctctccgtgcacctgacaaagcaccatgtttttacaggcggtcctgtgaactttgcttgctcagcgtttgctgagtagatctgaggaagaaataaaatgtgtattcctaaatgaaatagygatttaagatacagcagtccattaagaactgctgtttggccaaccgaatttggggacagtgagatcttttatactggaagctaaaattcagaaactccttgactggtttgtctctatgactgactgacttgagttccagcaaactgccctccacatcccagtcaacggggtcctattagaatgcacatttctcccagacctagtgcctccaagtcccttagcagtgtctctgggaatctgcatttgcaaagtctccctcccctgatgtttctcatgcagcctagagtttgtaaagcactccagtaggtcaaatggggaatgcatggtgtggttcagagaaacccgtctgagcccaccttgtatgtttaggggaccagctgtggaacaatggtgtggttcagagaagcccgtctgagcccacctcatatgtttaggggaccaggtgcagaacacagccccttaagtttttccgtaactggcaaaaaaagtcaggtagctactatgcattttggagatacttgcaaaattgaaacaagggaacatgtaaacgtgaaaacaattacatttcaagccagggtgggtggttttaaaacctttacaaagaagaagtatggcctctatgaaaccttagggggagaagctgcttcagcagatgagaatacagcaacagtattttccagacagttaaagcaggtgacccacaggagctgtctcggggaagaggcgtttaatcccgccacaggtgtttgtttggaaggctgctgctctgttaggttttgggggccagcagcaggactggctctggctgtcataagtccattgggaatgatttgggaagactgttgaccagaggccggggaatcgcctctccagaaggctctgcagcaggaaccatagcaaagttcaggttttccagctgccattgtggtgcatgtgacttcccggtgagcacattctcactgaaggggtcccaagcctgccttcatctgcctgcaggtctggggttgacctggcttttcctgtagcagcaggcaacagctactacatggtgggaattctgcaagaactgtatggggccctaacaggagggagacagttgctagacacataccccccacccagaaataaaaacgaggaaggaaaaagatagccgcccaccccaggtgctttctaaggctctggagctggactgcccaggtttaaatccttcagctgccacttrccggccgctggatttcttcckgtgcctcagtttactgatctctgaaatggggatgaaaacaccccgtatctyttagggttgttgtgaggattgaacgcttggaatggagtaagcactgtgtttgctactgtgtgggtctctctcctctctcccctccccacaccccccccatactcgtctaatcccatttctgtcatttccttcagcctgtttcctatgataccttgatcctggccaccagtttcgcccaccgtttttggttttgtttttggttttgttttcccaggccttcggctccagagctgacccagggaggctttgcgcgctgggcttcttgataggcatctgcaaagggaacacgcccagagggcaggtggggcttccagcgtccaggtcttgcttgcgggcactcacaccggctttgccttctgctggtgttttgcctgttcatctcacactcaagcctgtcagcatttgccatgccctttaactttcagtggggacatttattaggcaaggttaacacattcccttaaatacttcttttccttcttctgattccagcctttaactgagctgaagcagttgttccgattttcttcctgaaggaggtggaacccatttgcctcctcatggtgggcttgtagcctccctcgccctgggtccctcctgcctctgctgcccagtggcatctctcaccccaagctcatgcatgctcgcgctctctcctgtgattcgctctgagtgaagtaattacataattttaggagtttgatagaactgtgttcctaggaagacactcaggtgtcctcccaagccataagcatctccctttttcatcctggggctctgggtagcataggtcactgtctcgattacagtcacctgtgtcatcggctgggtggagccgtggtgtggttgcagtgagagcaccaggtagacctctgtgtcctgctgaaccggggacaagggggtagcaagctgcagaactctttaaggttccaaagggattctcagaaatctgttatgaatttagattgtgagtacggaaagtctttgttctcttagaaacggaaatgttgattgctgtttagttttattttccttcatggtaattggcccctcattaacctgacctctgtggcaataccgtatttatgtataagagtcttactttcttctctgggtgtctatggttgtattgttacaatggtggtgattgtggaggccttggttgcaaaataggtaactcattcacaaaggccaaaaaatcataaaggtttatcttgggtcagattctccctccactcctgtgccccggcctccagccaactggttcctttccctgtggacacccactgtgttagtattttgcatttccttccagatttattttatgcacatatgaatatatgttatttcccccttttaaacagatggtarcatactatatatgcacagtgttctgcaccctgccttttatactcggcagtgcatcttggagatstgtacatctgagtatattaagaggtgtctgattcttttttatagctgcagaatattccttcatatggatatacccagatttacttaagtgctttcccatagatggggaattaagcttcctcatggtttttgagacgaaggttctggataaaaataaacaagtagaatccatactgaccagatgcagcttagccaaagtcaagagattgaacatggtcttgtgttgtttgtcggggatttttcgcttgatcttagccaaaaggccgagaagcaatgtgtcaggatttttctataaaatgataaaggtcttcagtggaacattcagctttgcctatgaactttttgcartcctcaaataatcaaggagaagcattgtggacattcttttaatagattattttgcatgctattgggtctcctgtcttggaaaataattagtctgagtccagccagataaatgtagactcataagcttggtaaagggaaatgaagaacttggtacccattatttagaatgggatttgtttagggtcagaaacactttcccaggtgataaataactgacttttccatcagttcttatttaatagatgccttaatgggatatatttggggtgggagaaggcataattgtaacctttttgagggaaaggtagccgacgcatctgacctcataaatacttgtttaattgaatgggaaagatgatcaaaggattctaaagtatggtaaagacggccctagcaatatactaatgtatacattgtactgaagcgtatgtattaaagccataatacgatgtgatgtttgaattagcagaacattggaagatgaaagttgtaattgaggaaggaataagccataaagttactttttttttttctttttttttttttgagatggaattttgctcttgttgcccaggctggagcgcagtggcgtgatcttggctcactgcaacctccacctcccaagttcaagtgagtctcctgcctcagcctcccaagtagctgggattacaggcaccctccaccatgcccagctaattttttgtatttttagtagagatgaggttttgccatattgggcaggctggtcttgaactcctgacctcaggtgatccgcccgcctcagcctcccaatataaagttactgttatgcttccttttgaagtactacttttaatgaccttgaaaatgttatttgtagctaaatgtaaatctggaaagataaatatatttagtagaggaatctaacctgtyagcaaaatgtttgagtagctaagaaacaaatgctctttgggtctgcggaggagaaaatgaccttgtgtaccaggaacctgcccggggacctgctttattggactctggggaatcaatcccacacccttcaggacgggcagaggcacttccacattggatgcctctggggagagtctctttacgttttgtctgttttgaacrtattctttcttgtttgattcctttagcaattaggctaaatgttggtcaagtcttacaatattagacagaaacaatgtctatttatttaaccttgttcaaaaataagccctgtgaaccttctagcattcctttaaattctatattctttaaattacaggggaattaaacatttaaaaagttaagactgacagtggtgataattgatttgagaaccaatcaaaagttcaaaatgatgaatgacaatgatagtatgtgtgtgtaagcacctgctgtccatgttcagagcacctgagatacaccaatatattggcttaactctaaattgggaccccacgtttagcaagtaacatactccatcttcaccatgtctacttgacgatgaaaagtcagagccggtggagctcgcaccagatttaggaccattttgtgtttggttgttggcatttagcttcgtgaagttatggttttggtggggagggaggatgtgattcagaatccttcagatgttatgagatgacttggatggtaatggggctcaccaggttattttcttttctctctccttcccttctttccttccttccttccttcctttctctttctttctttctctttctttctttctttttctttctttccttctttccttctttctttctttccttctttctttctttcctttctctctttctttcttccttccttccttcctttcttcctttcttgacagtgtcttgctctgtcacttaggccagagtacaatagtgcaatcactgctcactgcaacctcgacctcccagacgtgagcagtcctcccacctcagcctcccaagttgctaggacttacaggtgcctgctaccacgccaggctaattttgtattttttgtagagacaaggtgtcttcatgttggccaggctgatctcaaactcctagactcaagcaatcctcctgcctcggcctcctgagtagctgggactactggtgcatgctaccatgccaggctaattttgtattttttgtagagatgaggtcttgccatgttactgaggctgatcttgaactcctaggctcaagcaatttgctggccttggcctcccaaagtgctgggattacagtcatgagccaccacacccggccactgtgttatcttcatcttggttctcaatgaggaaaccaagcagggctggactaaggggtcagagtccatgggtcaccgtctattaatggagctctgatctcttgattcctggttcaaagtgtttttttcttaactattgatttggtgtcgaattttcttcttttaactagttccaaatttattctctccatagccagagctccttgaaacttttgctgctgttaaatccagtcttcttgtctttttcagagtttcatggctgtgaagccaggtcctcataaggcatgactgtaattacgaaataggatgtgacagtcatcaggtcccacattttagtgggatcttttagacattgctacataagtgacttttctatgacatagccaaagtctacaggccacaaactgagttcaaaacaaagtaactccaaactgataagttgtcaggtttcctagagaagggccttgtccacgtacactgctcataaaccttgtttttgagtttgactggttccgtttagctgtgatgcttgactttctttcattgaaggttgcctttacttggtgttaggtggagcatatcatgaaggcttagatgtgggccctgaggtcccaccccaagctccgatacattcccttaaccccagagctgttcttaggaaagggggatgcttgttctctctttcagccaatcctgctccgatgccaatcttttcctacggtccttcttcctcttttacttttagggcagagtatctctctttttccaaaccttcgttttctctgaaccccttttattcctgcctttttatatttcaaggagttttgtctctgataagattaaagactcctctaaagtcrtctcttccatatggctattttgtttttgtttttgttttttaatgtataaaggaatgtttttccccatgttagggatgctctattattgttgtccttctatttctttgttggtaagatctgtttgtacctcttgtttcaacttcttcccatgcagggctgcagactcctgttccagaggtcattgttgatgtggaatccatggacatcttcccagtgggctggtgtgaagccaattcttatcctttgactgcaccacacaaaacagtctgtaagtggttcccagttgagggggggtggatgacaccagtgatctktgtgaataaattggcagcttcataaagaaattataacmaagttctaaagaacaaataagatttttgattttccaccaagaacccatgttttcatgatctygcttaatctttaagtgtttgcatgagatgatgtcacaggttgacaaactttaacagtgagggacagttgaaagtcacagagaggcagaggaaaaatatctgaaatcatcactctcagttttttatacaattcattgttttgatgtgaaaaaatatgttagatactatattattgtgttaccatttctttaaaagaactgatttttctcatgtagcttctcctaacagaatcttaattggttccaataatatactgacattcttataaacacttaaccaggctaggcacagtgcctcattcctataatctcagtactttgggaggccaaggcaggagaatgcttgagcccaggattttgagaccagcctgggcaacatagtgagatactgtatatacgtaaaaaaagaagtacatatataagtaaattagtcaagcagagtgacacgtgtctccagctactctggaggctgaggtgggaggattgcctgagcccgggaggtcaacgctgcaatgagccaagatggcaaccaagcaccagtagactccagcgtgggtgacagggtgagactctgtctcaaaaaataaataaaataaacagcctactcttagcactaactaatcactgatatttcaactgtactttataaagtatattaccacacgtccctttggttacagaaataccaaataaccaatattaacagttaacccagcagtaaacgcccattcatacatgtgtgcacacacgcacatgcacatttaaatacatgcaaaaaaaaaatttttttttttttaaagatggagtttcgctcttgttgcccaggctggagtgcaatggcgctatctcggctctctgcaacctccacctcccgggttcaagagattctcctgcctcagcctcctgagtagctgagataacaggcgtgcgccaccatgcccagctaattttatatttttggtagagatggggtttcaccatgttggtcaggcttgtctcgaacttctgacctcaagtgatccgcctgccttggcctcccaaagtgctggaattacactttggccacgcctggctaatagtgtgttttaacatatttttgtaggttattgtcacaaaatggtaccatttaaaaatcttctaacctaatcattgcgtttattattctaccctaatgcatatcagaagtgttatttaaaatgatgagtccttagagataacaggttttaactgttaaagagattccgtctctgacattttcttgatggaatttaggcaccaactttacttcttcctaacagcctgttctgtggccacttctgtagactctcacaacgttgctggaaacacagttccattgcatagctgacttcacattccctgatggcgacagagtttcagggctcctctagttagcattattaagagcaccagaggacattatgtgtgtgaaacaagcaggtagttcagattagagacagctggattctatgggattctccttttcctaaaccatcctgcccaatggatctgattcagttggagtaatcgtttccccttacttaaaaatatttctaaaacattgagtgtacaataattattttaatcccagggacattcttttcccctgtctcttaaaatgatgcagattctggccaggcgtggtggctcacgtctataatctcagcactttgggaggcygaggcgggtggatcacctgaggtcatgagctcgagaccagcccggccagcatggcacaaccccatctctactaaaaatacaaaaaattaaccaggcatggtggtgcatgcctgtcattccagctactcggagggctgaggcacgaaaatcgcttgaatccgggaggcagaggttgcagtgaactgagatcatgccactgcactccagcctgggtgacagagcgatactccgctctgtctcacaaaaaaaaagctgcagattctgaccttgctcagccagcatggccaatagattctccccaacctgagtgttgtcctggggttggggttccaatcccctctgtccttgttgtccctcaaacagaacctggtgtcctagatcctcttcctcccctcttcacatggatttgggagggtgcaagtgctttgggtttttctggagcacaatcatatacaggttaaggtgaacactgtgaagtttcctcctcctttaggattttggatctgtctgttgtgcttggctctttcccagggggtcaggcatccccaccccgctaacaaagaccaggggagacaagtattccaaactcatttttcacctgagagatcctaagtctggacctttttgtagtagtaactggaattgaatatcagatagtcaagagtagcgggatcttattgagtatttttcttatttatttttgcttgcatttcttgcacatacattttgctttaaagaggcaaactccaactccaaacctgccagactctagcagctttagaagttttgttggaattaatttatgcttatgttggaagatgtaggattatctgagccaaagttagtagatgccaaaagctttggtctatttttgttaaggtgatctgaatcagttacaaatataaactggaaatgttcttatccaaagaaatcactatttgctcatttatgtcaatatttgaccaggcgtatttgcgagctactggttctccttttgtgaataacatgttttagttgaaatgcatgcctctgacagcaccttgggagtgtgctgtgatagtaacatgatttgcttcatcacaatttttattggaaaaaaatcattccggataactgcttgcaacaattgatctgaacatgtgtgctaatgtgaggtacaacaggtgtactcttttgctttcttaaatgcacatttaaaaataaagtagctagtgtaatgataagattaaatgaacgaagttgtactaagatctgacatctggtgagttaacgtctatcctatgctagaagaaactgataggaaattgtggcatgaatgacgtaacttttcagcatttaaattgctactttaaaatgggtacctctttgctttataacstatttttaaaaatggacttgccccactaacaaagctgattttctttttccgttttgccttttctacagcacaaaagaagagaaagattgcagtcgtgcaaccagagaaacagtacgtgcttttttcccctcyagactacactgtataccgataaactgtagtgtctttatggaggatgggaagcrtggctgtttttattggagttatctaacaaatagcaccctagtagaggtagcagtaaaacatagtgactgttayttgttatgtacctgttatgtgcaagacacagtgcctgctccccaaggcactcrcaatccagattcccatggctcactttttattccayttcgacatacctggggagtgwcccagacctacacactgagagaaatcgctgtctgtgtctatagttctcagcgtctgcaggggccccacgtggcaggtgcagtttcgagtcgcagcccctcaccacactcagaatgctgctgcttactcacctctcctagagtagcccaggcttgggaggcagaaaacttcagtccaaccccagctctgctgagtgaacctgagcaagtggcattaattctctgcccctcagtgccctggcttgtaaaatacaatttgggggtacttacaaagattaaattagattccatttgaaaagaagtgtaggccttaagttgtaggctgaacaaatacagattatgccctgtcccccatttcagtcgtgattttctgtggaaacagggtgtcccccatttcaattgtgactttatgtggaaagagggtgttagcaaagcgtgtccaggcaggcagtgtgtttttgaatagttgtgactgctagtaacatttgtagatattgaaaaataatttaaaatacgccaaaatgtacattccaggccaagggattctgctttcttaagtaaataaaaatacactgatggaaagacaggtgaaaacagcatttttcacttgcggtagtcgagtttaaatttaaataagatgaaattgaactggaactgcacgatttgaatgagaagagcagctctgtaggtatttttttgtgggtttggttctaaatgcagtttatctggctcataaccagactccacgttatccrcctgatggggaagtagagagatttcataacacgcctgtgaccgaatccaaacttgaatccatcactccttaaatgcacagcccgtggattaacggttctcacctttctcatgcatcagtcacttagagagcttggagcacacagattgctgggccccatcctcaaaatttctgattcagaatgtccgagatggggcccaagaatctgcatttctaacaagttcacaggtagcgtcaatgctgtgggcctggggacccctcttggagaaccactccatagatggccttgctaagatctcttgtaagggttgactttgagcttaaggagcttttcaaccatgtggtttctatgccaccaacctagacacccctgtgaaacctagttcacctcttttcccctaaggctacattgtaaaacacatatttattcagcaacatttttactgaactataacagagctctgtcctggaataagcctatgttacattttaagatatgccagtttatagattttcttttaaggccttatttttagtgtggccatgactcccgcgggcccggaggtcagaaatcaaaggttagtggaaagtggttttcaattagacatcgaagtggaaaagtctgactttaatcaaatgtaagataatgtttcttcatgtttaaaatataattgaaggcagtattacaattccatagcaagagataaggccagaagcgacctgggagaaactcactgatcaggaccagctgctcaggggcaggtgtctcaggctttcttgggccatccaaagaattggacaacaacttttctgaaatgctgttttcatctggtcttactggcattgctcccatacacacattctattstatggtcctcttatctgagatttctggaagagcccttttaaattatggtaagactttggaatgtagtagttccttctaaagcttgtggtccctgatagttttattttctctgttgacagattgcygcccacagtgcctgttaagaaaatacctcatgacctttgtttattccctcacctggacaccacaggtaatcagtcccatttagggggtctctgtgccttcccaccgtgcagccgggagcagagacatgtataggtttctaggtcgatatgaatacatctcaacgttgagcctattctgtttttctccattgccactcaggaacggatacctactttttaaaaagaaaaatttctaagctaaattctctgtgcctcttcttttctgcttcttggccagtagctctagatagttctagtctatagaaaaagggtttatgtgtgacttgcaaattaggagccaaattagggctgcatatcatggggaaaaggaaagagttgaaaatatcatctcattaggcaatttcttttttgatattttatttccgttccacttgcatttttccacttgctgttagtatttaagtcgccccgagcttttgaattgttccttaaaaccctctaaagagctggttgtgaataatatatgttttttaatgtgtaaagtcttacatcttacaataatctttggaaatacatttgtgagctaccctctgaccatcaagtctggtaatagacatgtttgtacattatcatacttgattaaaaagtctattctctaagccaaaatgaaacctgctctgaattccaggattaaaaccaacatgtcatggaagaatcctactaggagattatcttggtagtaaagagcagttttataagtagctttaactaaaattttgtttttctgcaggcctggtaatcgaaaggcagagtaatcctaccaaaaaatttccatgtaaatgcagctgtggacttcattatttttcctgttttatataattcaaactttagaatggttttaaaagaaccatgacagctaccctttcatagtctataattgtaattttactccttttcttttrtatccagaagaataacatttctgcttcctacctctgctggttcctagttgaagtctttatgagagcaagccttcctagactgttaaattaccatcccagattaatagcagtggttttgcagaaattccactgtgagtgttgcttagcttggagcttgggtagagtcagggtgggggcggtgactcccttagccaaaagtgaaacctcattctacatttatagacattaagaaacttttggcccagcatggtggctcatgcctgtaattccagcactttggaaggctgaagcaggcagattgcttgagctcaggagttcgaggccagcctggccaacatggtgagaccttgtctctactaaaaatacaaaaattagccgggcatggtggtgcatgcctgtgatcccacctacttaggaggctcaggcaggagaattgcttgaacccaggtggtggaggttgcagtgagctgagattgcaccactgcattccagcctgggcaacaaagtgagaccctgtctcaaaaacaaaacaaaacaaaaaactttcttctttttttgagacagagttttgctcttttcacccaggatggattgattacaggcgcatgctaccatgcccggctaatttttgtatttttagtagagatgaggtctcaccatgttggccaggctgatctggaactcctgacctcaggtgatccacccacctcggcctcccaaagtgctaggattataggcatgagccaccacctgtaagaaagaaactttagattgaggtcttatcatttaattattctgcttgcccatggcattggagacagcaagatcagcagctctcactattccctttctgagttgaaagaagaatacaggtaatgcacacttaagctgcagtgaggtctacttcaccgtcttcagactggcagagtggagaagtgcaacaggaaccattgttggggtagatgtaggactacaggagcccttccatggtgctaacaagagtgtcaattggggtagtcactgtggagaatggcgtggccatgtctagtaaaactgaagatacagatgcgcagacctgtggcctacctggcccactcttcttactcacctgcaagactctgttgcccacgtgtagaagattttcacaatcatattcatgaaagcactgttgacagtcctgaaaaagtagaaacaactaaatatccagcagtaagagactagacagctaaatgatgctacattaattcaatagagtcaaagaagtaaaaaaatgaatgaactttctagatccgcatttaccaacttggatatatctcagaaacttcttgttaagcaaacaaacaatatcttgcaggaaataatttatggaatatgtttaatatatcatatattgtttgtaggcacatgcatgcttctgtgtgtggtgaagttgacacacttgtgtggcatgatgaacaccagattcatacaatctggaaaaatgcatcagaatttccaaggtatcattaaggatataaaatgtcctgctattaggacacagcgcctctttctcaaaagaagaaaatcatctgtttttctctgctgctttgtcacgatttggaactagagtgtggcctcctaattacagttctaacgacactggctgtcacggttattgtgttcattttgggttccattgcttttattacgcctgactccccatcagccaagacctcggacagctctgtgtggtccttttccctgaccatgtggatgaagcaagggtctaggggtcccctagggtctggggctgtggtcctaagcatggactatgttgctgtcccctgcaggaaccgtcaacgggaaatactgctgtcctcagctcttcatcaaccacaggtgtttctcaggcccttacctgaacaaaggaaggattgcagagctacctcagtcggtgggaccgggcaaatgcgtgctggttcttaaagaggtaaagcccgtgcacaatcaccttggcttattttaacaggattttttaaaaagctgtgggctcagtttctgaaggagggaataggcattggaagcagttcagctggcatttaccgagacctccrttctctccatcctgtgggctgaagccagagatacacaaatggaaaaatgatgctctgacccatgaaaggctccccatctagagggagggacacacatctgccttccctcgaattagggggaaaagttgcactagatttgaatgaagtgctttgggaagacagagggaagattgtgtgtggagtgagggcctaggactggagttgaggtttccaaagaggtaaaccagcctggaatggcacagaggacttcatgaggcagcagagggtgttaatcaccgagaatggcgctccttggccgggtcatggtgctgtgccatctttttgtttcatccatctcttccgagcacctggtacctgcacacgggaggtaatggtaagtatttcaatggtctccaggtactttgacgaggtttgtgtcatgggtcacatccaggcccatcacttggaggctgtggctccccatttcttctgctgccttcgggcgacgacctgcagagacaggtgaatcctgaggatgttgatgaaggcttcttctccattgcatttttctagcatagcctcagacagtgcttggagacagattggaaatttggaatagtttccaaactcttcccggaactctatctctgctcttttcttacacgtatccgtactttctctgaagaaagaggataccaaatggatattctctattgccaccgtaccatgatgaatgtttcttaaaattctgcaggcacagcaatccattgatccattgaacaaatgtttgtcaggtaactttgaggagccaggcaccatcggaagcattggattaaaaaagaaataggctctgccttctgcctgttggggtttcctgctcttgttagggagatgatgtaatcctcagcttgatgtacagttgggcgtccgagagagaggcaggaacacagtgtcctgggagtagagtgcaggacaaatatatggcaagtgacatttcatctggcttaggcagagtgtgtaggatcctgattgcacagcgtgggcatggccacacaggtgggcattcaaggtgtgtttcagaaaggaaagtcaggtatggctggagcttaggaacttaggctggagataaaccgtggcataaaagggtgcattagattttgagaagaaaaacaggaagctggcctgccttgatgcttcagtgtgaggttggatggagcaaattggatggggcctgcttgtgaaaggccttctctgatattttaagtgatttggacttgaatctatggatagggcaccctcagagggatgcgagactcaagctttccctccacacgagagcctcggtgtgatttcaaatatcatttcacttgaggagaaagaggccattgaagggaagtcagagggcattttctcttcctggtcatcagtggtattcgtagttaaagacctttttatttaaaaaaacatctgcttgagagaggaagtagaggttacagtttagaagaaacctgtcagaaatcgataaggctattgttgtggtcatttatttgggagcatgtagaatgttaagcaggtggtccctggcccacatgagcgtccagtcgatgggaaagatgagtatgtaaatagaaggtagccacgtggtcccaggttccaggacaggacctggcatgcacrctgtgagatcacaccggaggcatctgcaatctgtggggactgcggaacaggtggcctgcccctggtagggagaggagcaggaacaaggctggggcatctggggtgcgggtgatgaaggagggaagaggagaggatcctcacagcacctgaaatgtgcagactgcaagggatggacccagaaagggcccttgttcgtgtttagagtctgttgcaggcctggccattgtaccagggccttcatacacatcttcatttagcagcagaatggagctgccttccttgtaaatagctcatttctgcatttggtcttgaaatcgaacagtacgcatctcactaagcctaagtggcaagtagattccatatatgagaaattcacagctaaagagaaagggtgattgagttgggagggccacaccctgggaagggctccgcagtgtggttaagcagcaggaccgctagttaatgctaagtgaataaattggcacagattggagatccctgcagatactaaactcaatccaaacagaaatcaagccaggattacacataagaatttctgccaccatcggaaataggaccctagagtgagaattgactttcttccgtctgccacagctgtcagtctgtgaatggatttccactagggcaatgttgtctgcctgtatttctgcctgtttttgttgtgagtgataggatgaggacacaacaactgacaaaaatacngagagctgatgggcttcttcgaagctgcctgcaagcctgtttcacgtgacgtgttccgttgttgaaatgacaccttcccttatctgccagctctgttaacacacaagatgaccttggcttcagcctgtcttgaggggctggctgttttactttactaaatgatttgtttaagtcagaagtggttatccctgatcaattctccgataagtgccagcggccaaatttaaagccgagtccagagcagttttctaatgacaaaactagttttttgctgatgtttgaaaaatgcatgtggcaggaagaaagaaaaacaaaacaaaacaaaaaagtaggtgagtgcttcagttctgtgagtgcaagaaaaatgtaagtgccaccaagctaatatttacgctaatgctcctctttcagtaccagagcctctgtagcttcaaatttcattttagttaaagagaacgaggtaatggaagtaaagacagagtgcattgcttttcctggccatcggtgttattaggaacttgaacactttatgtgtaggagatgtgcagtgagagcggttcaccctgatctgttctgccagaaatagacgtctcggggtgtggatgcagacatggtctttggcaaggctcagtgcaggctgcagagtccagttctgggttctgtctgagtgggccgctttataagagmggacgaagtttctggcaaaagtggtctttaatgcatggctctactcacttgatgggtgttagagttgagtggggtttggcaggaccacgagcgtgtctggcctcaattcgagggggtgcagcgaggggaggtaggggacctgggagaagctggaaccagagtcactcaatggtccactgaggtccagacgtaccccataagcaaactcagaacgaagcaggccttggcgtggaggcacaggcccagctggtgaccgcccctcacatgctgggccttttacaggatgcccatgcccagttgcatggagggtggagttgttaggcacaggcagtggtgatgctgtttatcctaagtcacgtgtccatgctcagtagggtcattgtccattgggagcatctttttctatcccaaatccttctaccccaacctctcccggagtaccagggtccccaaaagagagataaaccatgatctatgtcatatcaggagattgctcgcctcctatgaccaaaagrgtcttgtcggctgttgcgttcctttgcattgcacgaggtgttcaggaaatttttgccttgtaacttacataccatctcatgaatcaccaggcctgtagtcctcactttatagacagtgtatcaggctagtgtctgtgtgtgaaagagaaagcaaaccagtgagccagcctgggcacaagaggccaacggggagcggaacatctaatctatttactcctgtccgtgggtcctggagtgactgtttcagctgcagacacagacccatgatgaaggtgagagcagaccagccaagcgctcctggcagaaacgactctgaaaacacgcacctgggtagggcgatggagcctctgccttcacagggactccacacatcatggtggggggacattgtccttggagaaaatcccagggtggctctcagagacttggggagccttgtggtttttcttagaatttatttggcttaaaatatcagtatgtaaatgtcagtgacagtatctaacttctgtttttcagaaaaaaagagaaacatgcctttcatgtgggccatctgtgggcacccctttgtgggttttccgcatgagcttcaggggtgctgagcaggcaggggctctccacttgtgtttgctcggcagcagacctggcctgtcctgtgtgctgctttttggcagtccaggttcaggagcttaagagaggaacgtttatagaaaggaaatcgatgagctgtaaccttctatagaaaggtagaaatagaacgcctgattttctgctctcttttttcttcttttggtgcttaagagttcagagaaagccccaggaagcctggcacccaggatgctttgcaatgaggcgcttctcagggcttgtttttttgctccagtgtaactctccaccccgtttgctgagatgctggtgagaccagggcactcagctgaggtccaaagactgggtgtgaaggcgyagaccagcagaatcaaagaagtagtgcggcacccctgaaccagaatgcggtgtgccccggacccccggccctgagtcagagacgccccactgcaaatagtgatgtgacctccgacccccaaagggctcaggtgactctggctcctggtcacctgcagtttgggatctttccagtgggacctggcggtttgggatttggcctcagctgttatttacggtttcgatttctgcccctgtggctgatgcattaagcgatttccctccgtgtttttgtttggggtgtctggttctcacatctggggagtctgtcatgtgctgtttgaatttccccttcattgtggagctctgagcatttgtcctgggctatcactcacaacaacatgtacctaaaaactagaaagctttctggtcggaatcctgaaagtcggctgccccaagcagccttcagtgttcatagacttggtggtaggagaagagctttcattcttcgaagcagtcgtaagtttatcggtaacacccaggggaggaggtgttgagggagtaggaatgacgatctcgtattgaggacttttccatgtgatattggacagagggaatgtcttacccagctgacctcagcgaagtcagtcctcggaatcaaagacagatgcagacaggcctcttgaagatactgtgctgtgtttttgttgctgctgttttcaatttatgctgaacattagttaacccactaagaataatgtgccaggcttacgggtgggtgtgaacttgaacacactcacatggtctggggtgctgagggaaggttggcaaaggaaaagtgcacatttttttttttgcatgtcaggcttttctttattattttctcatagagaagacaagataaatttgatgaactttcttatcatagcataggataagattttgtagcaatgaaaagcaatagcaaatgataactcctgagcctccattcatgtagattatatggcatcaaatacttggagtgaatttattgttaatttttagatgaacagaataatttaatttcagagcccatattgaaattattgaactaattcaaaaaatatctatagagcacctactcttgccagttatggttgtatctgccatggatacagcagcaaacagaatgaagtccctgatttcctgctgcttatgtcttagtgggggtggatggtgaacaaataagccaattacggaataatcctatactaataataagacaagttatccatgagaggccagagaatgaagggaggaatgtgctgtgtacagaggatactcgcagagacctttctgatacggactttggagtaaagacccggatggggagggatggtctggaagggtttccccaggaagaacaatcctaagagaagaacagagcagaggaaaggcctgatctgacctgttgaaaggatcgccctggcggttgttgggaggtgaggctctcagagcgtgaggtggaagacagggaagcccctgccggcagggtgagaatagacccagagctgcccagcgtttcggccatgtgctctcaccaggcatctggataagacagtttcagggacattgtggacacagaaaagccccattggattgggttccagagaggactgaagaagaggaaaaggcgctgttgagtgtagactcttcttaaggattttactgtaaaagagctgagaaatgaggtgggggaatgtgttagttcgttttcacattggtgatcaagacatacctgagactgggcaatttataaaggaaaagaggtttaagggactcacagatccacatggctggggaggcctcacaatcatggcagacggcaaaaggcacgtcttacatggcagcagacgagagaatgggagccaagcaaaaaggggaactccttataaaaccatcagatctcatgagacttattcactaccacgagaacattatgggggaaaccacccctacaattcaattacctcccacaaggttcctcccacaacacatgggaattatgggagctacaattcaaggtgagatttgggtggggtcacagccaaaccatatcagtggaggaagatgagacacctaaggtcctattagtttgggggcaggggcaggctccctgctaccctctctgatcaagcacataatgaactgaactccagtgttttgcaaagcacaataattcagtctaactgtggctagtcatagcagctgtccacttagttattttcattaggtaactataatacatgacattgtcatgtgcacagaaattattcagctcacaattccaaagttttatagagagcttgttgaatttggagacggatgatgtggcatcaagaaaagccaagggaaaaacattcaatatccgatgcttttcataatttaattgctgcctgctcccaggctgaattgaactccagaaggcattttcttttcgcagtcacaaaatgcatctcnatatgcagcaaataacatgcagctctggggttttctcagcgaaacccaatgaaaagaatctgttgaaattttattgtctgttgataaacactgtgtgygttattgcagtcagtactaattagatttatttttaaactgagtttctgtaaattgtactgacagtaaacaataaaatcagatgattattctaatacagaaaacacaaacgcaacaaaactgccggtaccgccttgtcatggctttttagcaccttggcaagccacattctcttggtgggtggctttgaggcccttggaacatagcaagatgttacccaggcagagaaaaggccgtcgccgggctgaccgcgtagtgtaaagtattttaagagtgaatccttagttacaacttgagaaagctttgttgttttcaaataaatcagggtgcaaaccaagctggttacgttccagaacacaacagacccgtgaaaattgtgacaagcaaattccatccacattctcccatctccttccatttattttgtaatagtctccattaaaagatagtgcgtgtttaggcactagtgccagactcccatctcactcaggtgtatctcttgctctcccaacggtattttgctctgaaatccaaaatgtgagctccatgcctggcgtgctccttccaacttccgcacccggacggcctgcaggaggcatgggcactgcgtgctcccccgtcttgttcctgctactgtcactcagtggagcttcacagaggatcatttcatgaaactccacaccataggcctctgctttgcactctcacgttctgtaaggtctttatccaaacagcagcagcccaggaatgtgccagaactcatcaatgttaatcattaatgatgatttgctttttgaaaggtgagcaccttaggggtctgaggtccttgtccctttcattagagaaactcattgaggttaacaggaacatcgtatctccccagggtyagcagctggaactcttagaaatgcctgctctttctgagccccatggtagacacatgcttgttttcttggacttgggagtgaggggtggatgggggaaatatgatactggatggcgctggatattccagactctcttttaaaatattcacatttcagagggttgccctagtattaaatgtccatgaattgagcctgcaagaggagagtttcacacaatttgttaccctccttgcaagcatgtgaagcctctccagaagtgttggcatgagtagattgtctccgtttcattagttccttatgaaatctgtaaaaatagaatgaaattctcagtagcctatccaactgaagagtaatcctgttgaagtacaataaattgctctttggtgaaaatggttcagcttttctgcaactagaagagttaatgggagtctgccaccccctctagagagtggttcacacttttctagccagagagattgtattttaccacgctttttgtccatggatggtgaaacaactcagtgttagcctggcaagtgttctatcagacttaatcacgkttcttcacttcatgtgggtgtagtggcgagctgttcctaaatgtcagtggtgtggttttcaaagcatccttgtgttagtaggaatgaatgcaattgcagctcagtctgcttatttttttccccaaaaggttcttagcatgataatcaacgcagcctacaagcctggaagggtattaagagaattacagctggtagaagatccccactggaatttccaggaagagacgctgaaggccaagtaagtgttttcaattctggaaagcaagggtttttgtaatacttccccatgctactttgaamcttgccacttctctttgtgacacagccctgagaaatggaacaaactgaaggacgttcgttctgcagttctatgggcgacacgtaaatttcttggcatttttgccatacagcgttgccttaagccttaggattcctaaggtgaagtagagatttccttaactaatattttattatgctaaacattcagcatcataaaaacttggtatgtttcaggaccaataggttatttgagcaaaagggggaaaattgtaaagaggatatccctcatcattattatactatgttcataaacagctcttcatttttgatattatatagactatgctaaatgcaaatgctctcttttctggcagttgacagttctcaaagataaaaggaacccgtgcatgtttggtctgggttaagtaaatggcagcaaaatctgggttggcgtggagtcaagtaactttcttttatttggaaataggctaattggaaaggtgacatttttgctttctttaggtttcttgacctctgaaattgagagcaggagccgtatcaatgtacttgaacttggttgtttaggcacatagaaaaagatccgtttctaagataattttatgttgaataattgtttagagtgcttgagaggacttttaatattcatctatgggtttcaaatagaataggttttactagttgacttcttaatggtcattgagatgtaacatttgagaaatgatgtttttttaaaagagtaaaacagttttcagtggctagaggatatctaagcckcctttagagaaggcacctgccctattcatagtgaaaattgagaaatatgaaataatttgtatgatcggtaatattttcctctatagttaacttatactagtactgtgactgaagatgtttagagattgtgccacactcaacattcattgccagcaatccacttagcattcctggtgtcatttttgaacagctctggggttttagattcagtaaaacttatttatggtctaatcataatctgccaaatcaccaaagtggaagagaatatatgtaaataagaagagggtttatttgcagaaaatggcaggccrattaacgatgctgctacatttcatcatttccttctttctcaagaaatatttaagtgagcttcacctatagctcagagaaaaacatgtttttctaatatttcatatttttctgctttaaagagatcattagcagtagtggcacattttcttataagtttgtagtagtagtgggggcagaaaacataagcaagtgtttataatggagaaatccttcttattttaaaacttttctgcaaaattcaatacagtccaygtacacctaatggacacagatataataaaagtacaaaaatcttagctcccattaaaaccttccctgcctctaaataagccagaaactcgctcccgctccacagtgagaggaagttcattttgcaagtgtttgcactagttttcatgttaccaagtcgatcagagctttttattaaatccagcctgatacaatcaaaacagacatggtgaaacccagctctactgaattgtaaaggcagcatattacctattatatcaaatatgacaaaaagttccatggcaaactcttacacagcaacttctaatgagaaaatgtctgtctgaactgggtttcaactgtgcgagatcatagcagcgtctcaaagcagctgctaatgatgacagctttacagtcagcgggagctctcctgctctgatactgtgtgttgagtcacctcttcccttctgatgtgaaatgacaactttttagatcttgacaactttgctattttctttggtgcaaatgggaggagagagagctggcatcttcccatttagctgaaaggaaggcatgttttctgtcatgaataaattaacgtacaagaggagagactcacattcaagacatttggtccaggccaggcgtggtggctcatgactgtaatccctgcactttgggaagctgaagcagcaaatcgcttgagtccaggaattcaagaccagcctggacaacatagtaagaccctgtctctacaacaaataaaatatttwtatatatatatatatgtgtgtgtgtgtgtgtgtgtgtgtgtgtgtatgtgtrtatatagtatgtatgtatgtgtatatgtatgtatatatatgtcatatatacatatgacattcagtcctcttggttgattatgggagctgttgtacacaattataaagactgttttcaggaagagaggatgtgagattatccctagggcagtgtgattgctctcatttggcatctaggatttctggttgttttttccacctcctaagagtaaagacccatttacttgagaggatgaaggtgtctttgtagaggttttgacttgtaaatataacgaaaacttacactgttacctacaattgtctctgggtgatttttcccctatttatccaacaaccgtaccttttatagaaagaaattattgcaatatttgaacttgtgaggagtctatcattattaccttcaacatgtattgaaaagcaaaaatttgctagcttttatgccagggaaaaaaaatggcttctcatgtagttcatttctgttctggaagagaaaatttctttcttgccaatgaatttaaatatgctcaatttacctgcattgttttgaattacaggaggaggaattaggctatatcttagaggggtaaggaaaaaaaaagccctccacctctctgcatctagagacatttaaatatgtttttcagcatgttacagaatcttcttgagggaaaataaaaagactgtcttaactcttctttgaatggcttttgtgatcatctttataaaagccaggcagaagcttaataattcttctagtcctgtgttatagttattcagaatatttaaagaggaaatatcctggtaggatttcacgtgagttagagctcactgtcacttatcagagggaaggagataaagtcagatcttcactgttaggtgcgtcatgctcagctctgtggaaatgttgtggtttcttttttttcataagcagtggttaattttgtgtgtgcttttacttatttgactttaatttttgtccttttacgcaagcatttgtcttatgaactgtcgcaggtaacatttggctataaagtgatttatgtaaaaaaaggattccctaactgagagacttcaccggaaaaggttttgtttgttcatttgttaattttgtttaccttgcgcaagtgtatgtagtttgctgtcctgaaaacgcacgaggtgaacttcgcgttaagcaaagccatgaaccagtctatttgaagggaagactgcatttctgtgtatgtgtgtacctaaattcactggatcacggtgtggcgtgtctgattcaaacaggccagcttaagacattctggaggagcagtagtctccttgggataaacatacatgcccatgtgttgcagagttcccattacttaaaggcaagaaggaagaaagaaatttctgaggagtttgggtgtcctaaggctgaaaaccagtgacccattctcccgaccctgaagtccagtgaccaagaatgagaccaatgaagtgaaagctttgttctgaaggaagcgagaaccgtacctcactattgctgatgagaacagaggctttcccacagcttgtaaagcttccctatttctgcagggttctcagagtcaccatttccttcctcttttaattcttcctccagcatttgagggtgtgagttcagcttgaagaaccagaacctcgtcctccgctcccacacccctatccctgcctgacgagatttgttaaaaggtctcataagggtgattctgagggtgaatgatggaacttagaccatagtgacattctgcttgggccgtgccggtggttataaacggattgttacaccagtgttggctttttcactctgtttttgtttttgactcaaaatccatttagattcttctcaacttttaactaccgtattagtccattttcatgccgctgataaagacatacctgcaactgggtaatttataaggaaaaaaaggttaaatggactcacagttccacgtggctggggaggcctcataatcacggcggaaggtgaaaggcacatctcacatggtggcagacaagagaagagaatgagaatcaagcaaaaggggtttccccttatgaaaccatcagatcttgtgagacttattcactaccacaggaaaagtatgggggaaactgccccatgattcagttacctcccactgggtccctcccacaacacttgagaattatgggagctacaattcaagatgagatttgggtggggacacagccaaaacataccagctattgaaggagaggagatgatttttttggcattttatcatcccatattcctctctctgtctccaccctgctctatgcacttggacgtggaaagaaatccctactttggctaatgggaaggaagtggaaggccacacatatattgatatcagtgaggaaaaactttgcctccactcctttaggttcagagactgggagcctgaaggttaaactgaccaaagacaggtgagtgagagaagaaacagcccacttacatgtgtaacgctcataccgagggagtgctcagtgatgaataactcagagggtgggtcagtcgtttggggattctgtatccaactcagtacgggaaagggagctgggagcaaaggctttygtcagaagaacaaatagattgctttgggaaagacaaattggatttgaggaaagcaagtgagaagtaagaaagtttgtgctaatgtttgtttatgcaggtctgagtggtctttctctcttcttcatggccaggctgggaaacgtccccagagaggagatttatggcagctttactcttacgtctctctcctgggaggagaagctgcccccaaagagggaatttatgrcagtctccatttctctaaagtttctattttacagcagataatgggagctccaacaagacttcttgctgtatctgtcgaatctcaactatcttgagcttaaaataatcttctgtggactctggggttctcagtgtcctgcgctgacaaccagcaagagcatctcctgtgttttccactgttgatctgtgacttcctttactgtctcaaagtgtgcttccgagagcactgccagccccagcccctcctgatgtgctcagcttgtaggatgagattgcgttcttccctccagatttctctgcaacctgagtgatgcagaggtgctgggatggcaaggtctatctgaggactgagatgaaagctctccttcctggacctctcccttacaactttctcctccgtcaccttttttgtctttgctattccttagttccaactcagtaatcttttgcttgttgcttctattttccttctttctgagattatttatattgccagagagttttctattgtgtgcgagctcagctgtctcttaatattttcctcttactttgtcttcttgggacttgaaatattgcttcaaaaacttagtgtttatgagagccttgccgggccgtgtattaaataacatcggcgtctcaccctttggtctcacagtgtcagtagaaagtgaaaagcattatctcatgctttttggtggttctttttttttaacttttttttttattatactttaagttctagggtacatgtgcacaatgtgcaggttagttacatatgtatacatgtgccatgttggtgtgctgcacccattaactcatcatttaacattaggtatatctcctaatgctatccctcccccctcccccaccccacaacaggccccagtgtgtgatgttcccctacctgtgtccatgtgttctcattgttcaattcccacctatgagtgagaacatgaggtgtttggttttttgtccttgccatagtttgctgagaatgatggtttccagcttcatccatgtccctaccaaggacatgaactcatcattttttatggctgcatagtagtccatggtgtatatgtgccacattttcttaatccagtctatcattgttggacatttgggttgttcttttcacacatcctccctacaaagttatgtcattggtatgctgtttgtaagtctttcttggaaggtaaaaatacaaaacacactcttcttttcacttttggtaaaataaagagtagaatgaggctgagtgcgttggcctgtgcctgtaataccaacactctgggaggctgaggcgggaggatcacctgaggtcagaagtttgagaccagcctggccaacatggtgaaacaccatctctactaaaaatacaaaaattagccgggcatggtagtgggtgcctgtagtcccagctactctggaggctgaggcaggagaatcgcttgaacctgggagatggaggttgcagtgagccaagatggtgccagtgcactccagcctgggtgagagcctgtctcaaaaaaaaaggaaagaaagaacaggtcatccccctacccagccatccccaggtctgtcacrtggagctcaaacccctgtccactgtgcctgggaagatcgtgtaaggatcaagtgatcaaatgctgtaagatccttgagaatatgtcagtagcttcattacataaatgcagatttactgttaattcccagccagttggtaaactcttagagctgtcttttgcctctcctttttttttaatagggctgtatcttcgtatgttcagcatgcctttgaaagagttgttccaacagttaccctaatttgtaggccaactccaaaacaagcctgtttattggttcaggttggagttggatttcacaatcaatttatccttaatgtattgatagcatctggatgtgtccatgtgtactcaaccaatagtgctcagaaatgctcatgtgatggaaagtctgctgtagagtcagcttggtatagtttgagtcattatatgactacatgcctttatattatttctaagtgcttttgaaacaatctcatacttacagaaatattggaggtacagaataaagatactattcattctcctgattgatttgggataagttgaaggcctgatgccccgtcacccccaaatacatgttgaatatcctttattccaattgcttgggaccagaagtgttttggatttcatcttttttcagcttttggaatacttgcagtatacttatattatgttgacactcaaaaatttcagaatttggagtattttgaatttcagattttctgattagggatgtacctgtacttttttttttttttttttgaaatggagtctcactttgtcacccaggctggaatgcagtggcacaatctcggctaactgcaacccccgcctcctgggttccagcgattctcctgcctcagcctcctgagtagctgagactacaggcgtgcaccaccatgcccagctgttttttgtatttttaggagagatggggtttcaccatgttggccaggatggtcccaatctcttgacctcgtgatctgcctgtaagcaggcttttctaacgggagtggctcaggcctgctgtgttcacccttttctgtgcgcttgtggtggaacgtaggctccaattccagtccagcatgccagggttcatcctagccttttccttccctatacttgcaactccggctgtgacagtggaagcctggcctgtgctctccacctttggagtatgtatttatttcgtcaggccccagcgtctctccagtatcctcaccctcccaacagctgtccccacatgcgacggcctcccccctgcgtccctcccgcacttccatccttttccctggtgggttcctcccagatgggtttcatcaaggagggcccttgggaccaatgcctttggaagggaggggaaggcagtgggattgagaagacagagatcatcccacagtgaggccaggcaggcacccgcagcagctctggggttaaaggctcttcatggctgtccggagttgggccccagtgacctttttacctcctccacagtcagtccctggatggggcccttctgggaagggcagggccaaggcagctttttgcaaaaccctaaagggggctgggcacagtgactcacgcctgtaatcccagcactttgggaggccaaggcgggcagatcacttgaggtcaggagttcaagaccagcctggccaacatagcaaaaccccatctctactaaaaatacaaaaaaaaaaaaaaaattaccactataggcgtggtggtgggcacctgtattcccagtgactcaggaggctgaggcatgagaatcgctagaacccaggatgcagaggttgcagtgagctgagctcttgcaccattgcactctggcctggatgactaagtgagaccctgtctcaaaaaaagcaaaaaaaagcaaacctaaataaaagggccacaactgaaggctttctcccagcaggtggggcaacaagccccccagtgaaggggtccaggcagcacgccatccgccagcttccccagcccgtgccctatccttactcagtcccctctacccctcactgccatggcttctaaacagaattgttcaggaagggcagggaagagaaaaggagcccgctgtttttaaatgatgctataacttaaatcttcatacctttagatgggcttttccctattgtgaaagtttttactgaaacacttgtttccatgaaatcatcccaaactaggaagagaaaattaagccagcctggttctgtttcccccagataaccgctcccttcatccgtcgctccgatgtggcagcgcgtgtgtgtgcttcgtcacctggaggtttgatgagcagtctcatctttgagccttgttctgcagtttgtcctctgacctggcttgcacatttctcctgcgttcttatgtctcattattttatttttctagggactctaagaatctcgatagtgagctctttccaacaaagttgtggggccaccaaactcgtagtggataaaactgcaagggaaaatgtagccgtgaagcacttttattctacatttcccatttttactctccatttcccacaacacgaggaacatacggtgttcccagttgtgctgtttcttttgtttttttttttttttttttttttttcgaaaatgcaacaaaagcaataagcaagaaccgncccaacgtgggtcctggagtccctcttcaaaggcacggagagggaagtctctacacatagggtcaatggagggcctagaaaaaccaacagccattcaaggctgtaggatttaaagcatgatcttatctacagaagattactttctagttctcactacatggaaagtcaagctcgacccatcagagaaactgaagaaaaacaaacacccaggggctgggatatgaaagaccctgaataaatatgaagtaaatttagtagagtatgcagatataaagtacaagttggaatttaatccttaattttttttgccgttgatactttaaaaaaaaaagatttattagtggaaaagtatttttccagtctttagaaagacattcctaaaaagctggaatttcatatttcagtagtttggtgatatgtgaacgaaataaaaacctatgatctgttgccagttgagaagctgaccattactttgtccccatgatagggttaaaaatctgtcaaaaggtgattgaaacctacaagtgcttgtgttttcagccaggcattatgtatatcatattcccataaatatttggataagggctgtagtgcctaattttaaaacaagaacccatcgaatctgctttttgtagctctggttgccagttttacactggtgaattcattacctgcggtttttcttggggcaggagaaagtttttttcttaaaagtgatgagcaacaagtgacaatatctaggttccagaagcatgtctcactctaaattctttgttgtgtgggtgggtgtggggagggatgcgaggagcttaatttttattcttcactaaatagttacgtttaaggaaagcagtattgcacttgatatttayatatgatggcaagacagtgccatctcttcaagcaatgtttgttgacgtttttggattcccatatataaaatcagttccttgtggataactataaaaggcgtttggatttccagaactctcgttttcctagtgcgttgaaaaggttttggggaaaacttccatacccttcatctagattggtgtttcctctaagatcagagacaagtgcttaaggaggacctcagagaaaccttagaagatgtgaaccgagaaggaaaggtacaagcaggcagcagccatggtcaggagaagctgctgtgtgggtggtggggaggtgcaggcaggcagtccgggggtccccattcttgtcacccccccaccaccggaggaatgagccttgtctcagtcagcccaggctgtgcagcaaagagccacaggccacatggcttttgcaacgatgtttattctctcagtgctctggaggcctaaagtccaagatgaaggtgccagggttggtttctccttaagcttctctttttggcttgtggatggccaccttctccctctgccctcacatggtctagtctctgtgcatgtacacccctggtggcttttcaacttcttcttcttcttcttctttttttttttaagagacagagccccactgtgtcgcccaggctggagtacagtggtacaatcatagcttattgcagccttgaccgcctgtgctcaaggaatcctcctgcctcagccttctcagcctccccagtagtgccccaccgtgcccatagtttttaaattttttgtagagatgggggtctcgctatgctgctcagtctggtcttaaacctctgggctctagcagtcctcctgcctcggcctcccaaagagctgagatgacaaggatgaacctccacactcaaacttttcatcttcttacaaggccgccactcctatgggattaggtccccacccttataacctcgtttaatttaattacctcattgaaagccccatcttcaattacagtcctatcgggggttatggcttcaacctatgaatttaggagggacatggttcaatccatataataagaatgaaggtctcctatgtgaggcccctcagttagatttaccgctttttgcggggggcggggggagatttaactggagaaatgccttttattttttcctaatacacaaatagactgtagctttccaaagacctcagtctaataagaaatagagatgcatatgaagtactgttgattccagcgtgcattctccttgcagtatgatttcatccactatctatcactcaatcaagatttgagtctgtggggaattgcggtgaaggtgtgcatgttcagaaaggattcgatttactgcttcggagaaagcaaccgaagccatggagggggttgctggggggactggagagcaggtggaagcaagttttagttcctggagcaatctttcaccatcccaacctagaggagaggagtggccagttaccctcatgggcagagtatggcaagcggcattaccatttcacgttgctccctttacacttgagagatacagcagccttttcctttaactgccactcatccaccggagaccccttacgattctgtttacactgaagccacttgctgccagtgtctgcaaggctgggggtcttcactcggtttccaggtcccaatcatacagtcactctgcatttttaatggtagcttttttctttctttttttccccttataaaatccattgtgtttctgtccatttaaatgtgaccttgcttacctatcaccattctgcacagatgccatttatgaataatggaaatcgtccccatttcaacaatatgatacacagtcttgacaaagatatcctttcagtgttctgaatttgcatggttttcaaggcagaatcctgatcccatatgcactcacatttttcaaaaatgaaatatgatagcaacaggaaaatacccattcgatttcactaacctcatttcgagagccatgcccatcaggtatgtatcccgcaccgctcatctttggtatgaagttgtatatagcaaaatgaaggtgtgctacatgtgggggtgtttatggaagtggattctggtttagcactgttacgacacatttgttgcacactagtgagcacttcttataaatatctctgtgagaaataacagaagcaacatgggaaactgcacgcgatatgctttgtcattggaaaatgaagttgctgccttcggaatgtgtggtacagaataggcctgaatcataatctggtcttgccctcgcttttcttccccacctattttctagatacagaggcaaaacatacagggctgtggtcaaaatcgtacggacatctgaccaagtcgcaaatttctgccgccgagtctgtgccaagctagagtgctgtccaaatttgtttagtcctgtgctgatatctgaaaactgcccagagaactgctccattcataccaaaaccaaatacagtaagtacaaataatgaaaaaagaaatgcatgagcccagagacctaaactgcactctaaggtatttggtttttgtttcatttgcttttttctttttgaaccttttgactagtcttccataggaattgctatggaaggatttttaaggatttgctgtagcagatacatgtgtttttagcctgacatacggaggggatgggatgatttaaaacaggatgaattttcattggtaggccttggaaaagaagaagaggaactgtgtgtactgtcatgagtttcagtggattgattgattctacagctcaatggatggcaggagagcacagtaaaattgatcacagtaacagtaacccagatgactctttcagtccttactctgggatagtgtaatgatgctttcattgcccttcttgatacgggggccacatccttgtcataatcggcttctcatgtttagacgccttcctcagcaccctcactgaagagagccatggaggactcagaagccaccatcactttcttttctgccagttggctttgcctctctcccaggacacagggtgcaggactcagagctgtccccactctcctaccttcagctcttgcctcttccatccccagtcccattcgaggatgtctggccttgggcaaccgcttcccctgagccctgcccttctttctttctgatgaccttctccatccatagtagccactcccagacacctccacctcctgtgcctgagtcctgttctctccctctgacccacagttctgagtttcctgcgtctcccctcagttctctctaatgcaagggggagtgacctggaagttagctctgccagccacgttccagccagctgggatgtgacaagggcttggccatgtggccagtgctctgtgagccacagtcacttgtgacgtttgtcaacatgggtgctggaaccaggaatctgaatgtactggaaacgctgtgsagagtgtgactttctttgtattttattatctctcagtgtgtttctacacacacacaacacacacacacacacagagtccccttgccactctgccttctgatggaggccagctgtgccctcactgatcacacagacctcccctcattctgtgcacagggcctctcaggtagggcccgcaggtgtgttggcccagcaggtcacctggttccggaagagcttgtttctccatcactgcacctttttccaggggagggcttcactgggaaacagcagctcctgagtaagaaaggcctaaccgagggctcgcctttgccgtgtacggtgaatgcttacctgccaggtgggcttctgtgttcttccaggacactgggaatggcagggaaggagcagggtcccacacctcccattcagcattgccgaaatgaactcagagatgtctccggatctcatataataaaactcttaagtcccaagatcctttgggttaatttataatgaatgttactaaaggctgaacagaggctccagtgggaggaggacagaatgatattttgggggagtcaaacactggaaaagcaggggtcacccagtctcgttctaaggctccaaacacatactggcctttggctgcattccctaaaaccagttctcatccccagccactggcttctaagaagccagcctgccctggccctgtcatgcacgcttggggtttgggaggggacagaggcttgctcatttgccccgtacctggagatggccacagagcaatgctcgcccacggcagtttattcctgctcactgagtaacacggtccttatagaactggacacgggacattgttccaagctctcctgccagctgctccttttgagagattgatgagaacaggccggggctcccggagcaggtgtgcctcctgggagttacagggctgctgctgtgcggcttcccgacagtttttccaaatgccatgctgtgatcaaacgcaggggaggaggtgggacatagagggtcttaggcctgaaggaaacctatgcttgttagtcctgatggtctcattttgtaagtaaggaaattggggtgcagaaaggataggtgacttacctgtaggacaaagcccacgactcagtactgtgagaatgcactaaaatcatgctccctgcaacggggctgctgcaaaccaggggtggtgcatttgccattttgctttggcccaccccattcgtagataaaggttccttggctgcattcagttattttgtggctcatgggcatcacatagtgggacggttgaaccttttattaatgagtaggcgtctgggtcgtaattgaatgctggatccttagtggtggttttcattagctgatgatacattttgtttataaaaaacattaatcactactaaagttcaataaataatttttgaattaagatgtacacctgtgtctctgctgtagaattcagaagcaatgtgagtcccagcaaatgagaaggaaataaagtatacaatgatgtaatagagaaggaactctgagaagaggaaaagtgcttggtgaatttggcccacgtgttcaggatcatagcttatcttggtcggaccaagagctgggggagtccctcatgccaggaccacgccagcagatgttcacccagtgcttgctgactgaccagtcgctcaagattcagacttgggagcaggtgtcagagcactccggtggatgtcattgccaccactgtatgcagtgtctggggtccagacagggataaactcccgtgggaactgtggacacctttgtctctttcaccttctgcagaagtcagctctggcttacaacaacataccacagaccctgagctttcactgcgcacacttacctcccacagtcctggaagctggaagtccaagatcagggtgtcagcagctttggtttctgatgagatccttcctgggcctcaggcagccacctgcaccctgtgtcctcatggggcctctcctttgggtcttgggtccttggtgtctctcctggacactcttaggacctcattaatgtcctattggattagggccccacccttgtacactcactttgggggttcgggacatccagatacactcactttgggggtttgggcttcaacactggggacgggccaagttcagcccgaacaccttccagacctgaagctttggagcagtgcttctcctgtgggtctgttttctcagaatgacttygtaaggcacaaatgaactatcagatgaaagaatcgtttcccttctttctctctcctctctctgttcatgtctgtgtgtgtgtatagccttcaaaagtttctcatcttscttcctacagcctattactatggaaagagaaagaagatckccaagccccscatcggggaaagcaaccccgacagcggacaccccaaacccgccaggcggaggaagcgacggaaatccattttcgtgcagaagaaacggaggtcttctgccgtggacttcaccgcgggctcgggggaggtatgttctgcccggggcacctgccagcctgtagctctgtcatctggccctggccggcaagtgtggctgcttcacagcagaggtggccctggagattgtggcaagatggtcagaaacactgaagaagagccccctcctccttacttgctgaaaacaaatgtagtgtgtccagctgctttggctgggaagggcctcgtagggcccacgggtgggaccactggctccatttccgagggtttgctaggtggtctgcactgggcccagggtctgaccgcggggccaccgctacaggcccccgggccaccagccccttaaatgccttttcctccttcccaggaaagtgaagaggaggacgctgacgccatggacgatgacaccgccagtgaggagaccggctccgagctccgggatgaccagacggacacctcgtcggcggaggtgccctcggcccggccccggagggccgtcaccctgcggagcggctcagagcccgtgcgccggccacccccagagaggacacgaaggggccgcggggcgccggctgcctcctcagcagaggaaggggagaagtgcccgccgaccaagcccgaggggacagaggtgatgcccgggcgtggggacagagggcttcccgctgggtctgaagaagcacacctgttacacttcagggccacgatgtggggaaacctgtttaaaatacctccaacagcagcagctgctctagctagttcccaagtcaggaacaaaggctggcacttcacctctgggtggaggggcctttcggcatcagaatggagtgcccagggtggagacagcgcctctttcctggacggctttagtgccacctgggttcttgtcaggaggagggcacagtcctcagtttcctttgaagtctgggtttccagaaattccttccccgcatctcccctgactgcgctgtgtcttgctcccacgtcccctctataggacacctctgtgatgttttaaaatatttaatcagtgtttcaggtctcccctagccccatgggtggtgtgagatcagcagaaagggccactggcaccaccattacagaaacactgggggacactgtctcgtgtctgcttggacgtgccccttgtatttctcctcttttctctaatcagagatgcttcgttcataagcaggcccaaggtttcctgaactagggatgcaagagcgactgtcactgtgcctgccttcttccatctgaaggcacatgagtcattgcagggggcatcatcactgagccaagaactttctcagggactgagagtgtgtgcagctttttcaggtgcccagtgagggagcaaagggaggcagtggcttcyggccaggaacggccgaggcctggagagtgctggagaggaccmagccagctgactgtgccgcagctgagctcctcctgccctttctctgcaggacacgaaacaggaggaggaggagagactggttctggagagcaacccgttggagtggacggtcaccgacgtggtgaggttcattaagctgacagactgtgcccccttggccaagatatttcaggagcaggtacggtggttgccgcgtgtcgattgtttgatgtgctgagactctgcatctgaaatgaacctcgtgtcctagccggcttcctcgtgacacctgcgagggggttcttcggcgctgctcggcaggtgtgcgagacccttctccctccaaggcccctgctgagagctgcctggcagggacgagagacagagcctcattcctgctcctctcaggccccaccagtgccatggtggggggcggaggggtgactcttccaggctctagtgacaccacccagcaggggtgggaggtgcctgttgctgccaggtgaggggtgcgagtccacgctccccctgccatctccaccgactctacagtgggggctctttaccaccaggcaggggtgagagtcccagttccctggctggccctttcagatgccaggtcagtggtgggatggggtgcccagttgccacctggccaggccggaagtcaggatagcacactctgccttggctgctctcagtggggtccgtccagccctccctgtgatgttcagctgcagaagagatgctgctgtctcacggttttttgtcttgctgggccaccccttggccaggcctttgtctggagagaactggttttggttgagcctcctgtcagtgccttttggcaaatctgggttgcagcttcttcagctccaagtctcaggggcatgaagctcacacacaaacagcaaccacaacaaccagagagctcagcactgtgctgtcagctgggggcccaggcccctagccggtctgccctcctttctccaccttccagagtcttctgtttgtgaatttgtatataatgcccatggatcttacttaggcctagtgggagaaggagggaacagtgtatccacctggcctgcccagagcagaagcccgctggctggtgtgtcgtactgaatgctgctttcgtcattgttttcttaccttcctcacttctttctgcataaaatatttttaagaccatggtatggtgatggacaaatgcaataacagtcgatataatttctaccttaaaggagcctatagtccagcagatgaaatgagtatagttagctaaaacacaagatcatatgatgctgtgtcctaaggaagaagagagggtttttatttacattatcccttaaattaatacggaaacaagttgccactctgcacacacaccaccttgcatcctgcctcactggccttgcagaaaatgccaggctcttgctgtactctgtgcttaatttgttgaagtttcttgcgttgtcctggtgtaaatatctgtgttcaaagacctcatgttaaaaaaaaagtactgtttttcatataatgttaaagataggtttattcagtctctttttagatcatataaatcagtagtctagaaagaggatatttccagcattaaatcaggaaacataaaaggtctgtgacttcctgtgtacccagaaaatttcccagcttttctcccaagttcatgcagcaatgaactggaaaaagcaaattaaaatggtctccagtgccacccaaagagagtagttctttcccctgtgtcccgagaagtccaagagatgaagtagttcatcctattgacaaccactagaaccttctgcagacacccactaagttcatgctgaaagaatgattaggccggccatggcggcttatgcctgtaatcctaacactttgggaggccgagacaggcagatcacttgaggtcaggagttcgagaccagcctggccaacgtggcaaaaccctgtctctactgaagaaaaaaaaaaaattagctgggcstggtggtgggtgcctktaatcccagctacttgggaggctgaggcaagagaattgcttgaacctgggagggagaggtagcagtgagccgagatcgtgtcactgcactccagcctgggcaacagagtaagactccatctcaaaaacaagcaaaaagaaagaaagaaaaaagaatgattggaggcagagggagtcacctcctcaccttctcacactggccacccttcctgtctggacaactctgaaaagcaaccagggagagacttccttagacctaaagaacctgggtgatgagcttgtccctttaaataacacacaaacaggaaagaaagacaattgtaagaaatacaagggcttaggtgatcgggggcttattgataagccacatctccattttgaaaacaaaattaaagcaataggttgaaatgctgtgtaaagcgctgcccagcacagcacgttgcctgtctggcatttattgacagtggtgctgcggcgagataagcgttgtattcaaatacgtgacaagcgctggtcatgcatgtttggttgcgctgatcacgcaggtttggttgcactgatgcgtatctgtcagtccctgtgtgcattcaacatacaccgattcagtccctgcgaggtgccttctgatagctaaagatacaaggtgtggcattctgtattactctaatgttttggttttatttttaggctcaaatgcttagttttcacaataaaaaaaagtttagttaggcctgaatgaagagcagatttctcatttctagatcccaggttaggtatgagggcttataccttgaaacgtcaatagctcctgtgtctgtctacactgtgtacaagttctcagtaataagcaagaaagtgaaacaaagctggtatggggaaaagcctaaagtattgagtcttcctttcttatattcctaagcccagttgataacaccagagaaaagtttcatgccttccctaagctaagccttctaggaaatggaacactgccgacactgtcccccttgtagaatcaagttgctcttttttttttttgagatggagttttactcttgtaacccaggctagagtgcaatggcgcgatctcggctcactgcaacctccgcctcccgggttcaagcgattctcctgcctcagcctcctgagtagctggaattacaggcacccgccaccatgcctggctaatttttgtactagacagagttctgccctattgctcttctaatattagtaaaagccttgcctttcatccctacttgtttctcttacgagagagaaaaatagatagactttcattgatcatcatctcattcctgtgtaatttcacatttcacattaggcaagttcacctgttggaataaaaagccattgcccactgggctgtctgaagtacatgggcacttgagtccttttctgtcccatcagacctttaattactaatttttactaattggttcatcgtcatttagcccaaatactccagctctgagttggtgaggcctccggtaggtcaccgcaggcattgtctgagattacaggtgagctagaaggaacccagagactttcttcactggcatgcgaatgagatcacagtgcacagcatggtcatcgctatgtgcacgcaggccctgaacgttataaatgcagagattattataatttgcaaaaattctgaactccccatgaccagcgtctgtgccttttatttctgaaatgttatggcaaccgcttaaaaaatctatactccataatctcatgctgcaaacctgtacattacacagtaaaaatccactcatctataactaagcacatacaacactctaaataaaattttacctatgcattcagctttcatcagtcagagacagcgcaataagcagactgytcaaatgctcaactgaccttaatgaaaaaatttcaggatagtttataggcttagtccagattaagctgtcctttctctacttctctagatctcaatacctccattaggaactaccagatcctcacccgagtgctctatcaaaatcgatttaattttgccctgtgctaagcatgtcgtatatcttatcatatttcatttctttacaattagtccattgatggtagttctgtgtttaacattaaaagtgatctgccggcagctctcagttctataggaacatgtttataaaaatcaaaccacctgtgaggtatgctgttatctaaataatccttgaaagaaaaaatagtcttccagataaagtggctttctgggctcgtcatgattttacctttggtgtctccccagtttcctggaattctatgttccagggaactagctgtgttctttcagtccctcttggccttaataattcttactggtccctgaagtctcagttcgaagccctttcagcacccctataagactggcttggttgcctgtcctgtttgagcccttagctctgcatccatatgttaatatccctgtatcctaatagtctgtttacttgtctgccaccctccagattcatggggtgtccagagagggaacctttcctttgttcactgtgacattccccagaggccagccaagtgcctgccacttagtagatgctcaataaatattggcaagtaaatacatgagtgtgtgcatctgcactgaaatgtggtacatgcattggccaccttcactgaaattttctgtaaagaaagagttacacgaatattttcgtgctgatagtcagtggtgattgaatcaccatcatgcccaagtacagatgttaaagactgagctacagttttcccttcaaagtttaatgtcagaaaactacagttctcatgccaacactttctctaactagctatgtgatcatagttagattggctagcttttctgggcattaattttcaccaggaaagtaaacttcctgggaaagtaaaataagttctatttctattctttcctgttctatggatgtcattgaacataatggttaagccaactgtccatggtttaatgacatccacagaacagaacagaatagaacatcagccctctgcctacttaaaatgtgtktttatgaggcccatggtacctggaagactttgagtccctacacccatgccctcttggtgtaatttgatgtattacatgtggatttggctctgaaagtggaattggcctacaggccccaggccagaggtccccttggtttcttcgcgacctagagccaaacacttayttcacagtactcccaaatccccccagctgcaatcagccttttctgtagcatctgaaaagaaagtaaaataacatgtatgagcactatagagcaagggaaaaatgatataaacatagcatgaaaatatagtgacagttttctacagtttgtctcctgctttcagtgtgtatacaagacagatctgtttactttgtgatttgataaggtcacctttggtcttggttgaacgtggcttcgagttgcttacatcatagctagtgctcatctgtaatttaaaaataaaaaatgacactcacattgatacttttaaagttaatgttgcatttttattgctacagtacttattagggaatattgttgcttttgaatctgatctgaagataaattattcctgctcttaacattagtcttttgaatctgatcagatgatgaatctatgcttgcttagaagattagtctgctcaaggctaccatttatacacactttgcctttttgctttagatattttcaagacagctaaataaaccgttagtttaagaaaataagctgcctgtgcgaaagtcactgacaggtgttgtcggagacgtatgatcttgtgcttttgcttggctattaatgtccttgtggcttatggcagccctgggtataattcttctgcaagtggcagaaattccagtatgtagagctcacttaatgctctcacggtaccactgatcatcattgcctggggcctgcaatctctcagacccctcagtgactccctctggacgattgagatcatcttggtaaataggagggaggattgcggttaaagtcagcagtccggtcaaatgacatctatgtgaatgaaccagattactataggaagcaagctgctgaagagacagagatgtccagtggaagggtcttagagctttggagtgggtctttgtatgcttcctcctgcagcaaattcaactgaacattcattgaatgaatgtcttcatgccctgtgtgtaggtagagaaaggctgaggcaggacacagtggggcaacagatctgtgtacgagcgacacctcgctctggggagtgtgtgtctgtaaakggtgtgtgtgtgtgtgtgtgtgtgtgtgtgtgtgtgtgtgtttccctttatggaaacctgtgctgtcgttggcatatctgtcttgagcatcttctcacccatcctaatggtgaaatgccagaccttggcagggagctgagggagccttgtcttttagtagagattcctttgcttagtgctcagatgaagtctcagcatcacttagggaggacctggccctgcctggggtggagagtgacttgccctcccagcaaggggcgataagcttgggaagcaattcccgcagcaacccacctgttccagctctttctacccaccagggtagrtatgtgagtttcagagtagccagagtgcccttagccaaaagctcttgtatttgtattgttgttttttgttgttgtttagagagtctcctgctgtgttgcccaggctggagggcagtggtatgatcacagctcactgcaacctcaaactcctgggttcaggtgatcctcccacctcagcctctgagtagctggcatcacaggtttgcaccaccatgcccagctaatttttaaattttttgtagagaccgtatctcaccgtgttacccagacttgtctcaaactcctggtctcaagcgatcctccagcctcagccttccaaagtgctggaattataggcgtgagccactgtgcccggctacaaaaagattttagtaacacaaagattagacagtcatcaagccgggctggtatctctaccaacaatcccctgaattgaatgaaacaagagcatcctgttgtcatgtttggccccggactggagcctgctgtgacgcatctgtgtaccccagtgcacactgccccttctctaacctgcctttcttttcctgcaggatattgacggccaagcactcctgcttctgacccttccgacggtgcaggagtgcatggagctgaagctggggcctgccatcaagttatgccaccagatcgagagagtcaaagtggctttctacgcccagtaygccaactgagtctgccctcgggaggtggcccattattgctgggatgcggtgttggtaaaggtttccaggactgaaactttgattttccgggatatgttaaatggtacagccactaagtatcaccagaaaaccagaagcccaggatcttctgcctccgccagcctgtgagctgtttccatgttttcaaagcacagcagcagtcgcttctggggagtgccagttaaagtcatgcatcagaccctgccagacgtgggcctgcttcttggctcacccacgttttgcctttctcctgccccaaatcaggcagctcccttggagcagggtttcctcagatgaggactgcattctttgaaaacaaagaatgtcgccaaggaagaaacctcacgccatgctgtagtgtttcctgtaatcacacgagcacatttatatatgcagtttcccatggataggcgtgtgaccctggttgagtggcacctgcggtttcatcttggtggcaactcctttgcaatgcagctggcagcgacatccttataaaaacatgtgctaaagctctgtcctctgttagaggtgccttttaggaatacggggagtgaaggaaggccggcaggcatctccatgcaactagatggtttgtttgtttgtttgtttgtttgttgttcattttgttgtgttttttgagacagggtcttgctctgtcgcccaggttgtaatgcagtggcgcaatctcagctcactgcaacctctctctcccgggttcaagtgattctcctgcctcagcctcccaagtagctgggattacaggcacccaccaccatgcctggctaatttttgtatttttggtagagacagggtttcaccatgttggtcaggctagtcttgaactcccaacctcaagtgatctgcccgcctcggcctcccaacgtgctgggattacaggtgtgagccactacgccccggcccaactggatggtttttgattgaagcctagaacatctgtagagacaaactctacccagtcttttctagaccctcaactatctccagtgttgttgtttaatcgtagccggatcagggagtgagtcttttaggcaaatgttggattatatatcaaaggaaaagcttagtttcagagaggaggaagggaaagagatgtgagggaagcatttcatcaaccagctacgtcccccttagaaggatcactgcagcaggtcaccgagcaggagtccctctgagcgtcccttctgtctcgttctgccctagctggcagcatatgaaccaggcatgatgcagcaggagcagtgaatctggagtcagccacttggcaccctggtttcgctgagaacaaactctgagatcttgggtgacttctcatcactctggacctccattcctgtgaagtgacaggtgtggaccctgagggtgcggtggtgagcacactgtctcctgctggcattcaccccactcatgctggaaaggaagatccagatcgtacaaaaatgagaaaaagaaagaataagaagggtctggtcccagttctgactcggccattcttacagctctttctggctttgagtttgcttgtggaatttcctgggcagttgtgttaaatccgccaggtcacgtgcagacaaagctgtggctgcgagagttggctggcctcttggaccagaagccatctccatatcctcatgagcgattccatatctccactcagaccctgtggactacagtgttccgctgtggtggctgccaagatgccttcttaaacttatgcaaggaaaccaaaccctcccacagttcccaagcagacactggaagcagaggcttctcacccttcctgctttttcaccacaatcaccttgagctcgtcccttggactagagtctccacagttccagtaaaattctgcggtgggctgatgagctgcttgcatttctgtgacatttccagatatgattctcagtgggattttggaaactttgattgctcaagctcacccttcttaacattctgtaatggttacagatgagaatggaaaacacatattttatggatgaggcgttttggtctcccctgcagtcgatttctagaatcaagttttagagttcggctgatgcatctgcctggggacctcagatgggaggagtgtgtcagttgtaccccgacagaaatgtctctgggatctgtggctggcttgccccgggcatctctcctttaagctcaagttttgaactctctgcggttttccacccctgccttctcagccacatgcttttggccttaaacgctcagtcttgtggagttcaactctgtcaaacgattggaaagggcatccatttccagatctttggcattttccccgcgctgactctttgatgatccttcactgtggccttttcaagctcagctgttcctgttgtatttgagacgagggtgagggaatgtggtggccacaaaagaacagggacttgcagcacaaatgtcacttctgtctcccttttcagtggtagcacggaggaggaggtgctgcgttggagggaggggatcctccaggagctctctggagcccatctaggaagctagagtgtgtggcccgccaggagctcaggaaggatacagccactgtcgcaggggaaagtgtttgcttcccgtggagccaagcgcccaagactctccgtatccttcaccctgacagtttaacttcagcgtttctctgtgcagttgcggtcaccatgggtgagcactgtctgtgcacgtgccagggaggagatggctgggaccactgcacaggagggcgcagcctggcgtcgccatgaaagttgtctctgtgccatctctccggtccttgaggagagcccagaaagattttaggacccaggaggtgcttttcctccagctgttgccagtgtccttctgagcctggattctccggggatttccgtcgtggtggatggacttcacatcagcagcagttctggtacagaattgtaatgtgttttcatttctctgtaggattcacctctcaccagcgtctgtcttaaaggtagggccaatttcatggagcatttttctgtgtgtgtccttgttgcttttgccagaaaaagtggatttgacatgcgtgccccgatgccaccatagcccctaggccaacaatgtcatggtctaaacaccaaaaagtgatgccccgcattccttccctggatggtaccgtttcttctccgtctctctttgatgattctttgggaccaaagtcctctccttagtgcgcctacttcctgtgggcatcatgccacttggaacttattggaactggcccgggagactctgcagtctgcgccgtttgaaaaccctgagaaagagatgccacctcaacttgaatcatgacagcccatcgctcagtctcaccctaaactcatggagcttgtttcagctcctcacttcttgactgtatttgtactatgttgaaaaaatatcctgtccacaaagacataagcctaacaacctagaaaaacaacagggtactactggcattacagaacttctttgcctttcaaaacaaaagcaaaacacagtgaacttcaccacggagctgcacagcgtggggaactcatccatcactttcaaaattagagtcatttgatccaagttggagtcagacacagtatttgagctgcacggcttctgggttctcccaccttatttgatcatattcraaagattatttcctgtgtttgctttgatttgttcctcagtacattaaaatgatccacaccttgaacactgccctctctagaaggttgattttgatcagccttttgaagatgggtgtcgtttccctaacttatctcacagaattttgagtgttgtatttggcaagttctgagatttgccttctgtcttatgccaaacacccctttctaagagctgtccccgcttagttttagaagtactaggggttttcatacttattttatagaacacccatttatatttatttctgtatatagaactaaaaaaaacagtagtgttaaaaatctttgttgtggtttgagcatctttgctgcttttggattgagatggcgaatcaaggcttcacttcctctctcttctgtctttagaaagctgtgatcgtgcgtgcaattatttgaaaggcaacatagtcaattaagaaacctgtagttgttaaggaagaaattgttggcaagatatccatactgcccatatctcgttggtgcaataattaaatagcaaaggaaatctgtattggcaactattataattcaataattcttttgtttactgcccttttctgttcaagaattttctggaaattactccctttcacatggttgaactcttaagttgaccagttctcatagctctatcactagaatggtttgcagataccccaaacatactatgataaaatcaaattgtgctacttttgacccatgtaatttacctaaaagttgtaattgctgacagagtactgccttgaattttggtttaaaacctctctagtttcaatgacaagtaacaactcaaataattccatattgtttgaggaagaggccataatccttctgaattgttggcactaagtaatgggatttggcccagtaagtatgacggtcgtgtcgcctaaccaacgcagagcagtgctttttgtgtggctgaagcgatgtgctgacgaaaaaaggaaaattctaggacaatcgttggctaaaaatcaccttaggatgaaaaatttgaggcaaatttttttaaatgacagaaaaagataatcatctcacttgcttgaaacaggagccagcatgatctctggaagcatcaactatccctcgtcgtgattgttgaaagctctttcactgttttgcattctagtttgaatagtttgtattgaaattggattcctatcttgtgtatgtttttggtgcgtaaaagggaaaaattggtgtcattacttttgaaatttgcaggacgaagggcatgcttttggtttgctgtaagattgtattctgtatatatgttttcatgtaaataaatgaaaatctatatcagagttatattttaatttttattctaaatgaaaaaaaccctttttacttcaaaaaaattgtaagccacattgttaataaagtaaaaataaattctatggtggtgtttgggtctttgtgttgaaggtcattcaatattatctttagcgtctgcattagttattttgttctgaattttttgttttgtttttgccacacactaaagccttatttctaggttgttaacgaccacggctctcaaagtcctgtgtgacctctcagagtcacctcctagctccagaatggaactttctggtcgaggaacttgtgtttattctttttagttgttaaaacattctcgtgtatcctcacacaactacctctagccctcccactttcaatcatttccgttattctgggatttcctgatgccttagtagaaagactgctttattactatgagagcaataattaaataaccacatttacatttatcatttttctttaagtgtcacacataggttttaggcaatgaagttgggataggaagagagacctttgccatcctaccccatctctcggatctctcgcaggcagaacctgtccccttcctctgtcaccacaggttcaggtagcgtctcctagggacagggttaagggagaaggaaagcatctcctagggacagagttgagggagaagaggagaaaaagcactgaggtaacggaggtggaggagtgttgaacgatttctttttttcatacatcccagatgatttcaagtatcttgcttcaccttgttttttactttattgctttctttttagagacaggctctcgctctgtcaccccagagtgcagtggtgcagtcatttacttctctttaaatattatttttgctctgatggcaatcacattctacatatagaaatttttcttttgttttaattatggaaactttttttttgagacagggr

SEQ ID NO: 10692 - DNA, 55299 bp, Homo sapiens
  misc_feature (1)...(55299): n = A,T,C or G, or insertion/deletion polymorphism (see Tables 1-2)
acaaaactaaaggtttgtttgcttaagtcaagcttgagtctggggagttatgtaagtaacatagatatctggttaatctggtaggatagcctttccaagggagtttacattggtactttgaaagaaacattttaagtcgcagaaaggtaacaaaaattaagttaactgtagcatcagcaccagaaagttactgtttcattgaatgtaagataatgtctggctcggtggctcacgcctgtagtctcagcacttcaggaggccaagacggcaggatcccttgagcccagcaatttgagaccagcctgggcaacatagtgagatcttgtctctaccaaaaaaaaaaaaaaaagaaagaaattcgggacgtttgccaggtatggtagtacacacctgtagtcccagctactcaggaggctgaggtgggggcatcgcttgagccagggaggttgaggctgcaatgagctatgattgcaccactgcactccagcctgggcaatagagtgagaccttgtctcagaaaaaagaaaaaataataataattatatatgtatatatataatctttgaaattaggtgtgtcttttatatataatctcctataatgtcttttatatgtatatataaaatctacatctaatttcagagatactaagatgtggggaaatgtacttagaatcaatgaaatacggtgttggtgaatgcaaaacttgtcagtcatatttattgatttcttctgtgtacagataatgggcatttggtatttattcatttatattttttttttggtcttaatgggacatggtgtctgcttatttgaattatttccggtctgatttctatattccattgtagaattttcatttacttaatatttatatctgtgccattgaagagaaccttcaggaaagcatcctctggggaaggccatcaaacaagcaaacagtctagtaatattttgcagtttgacttatgagagcttcataggaagcctctgcctttaggaagtcagttgtatgccttaagattcacagactcgccgggcgcagtggttcacgcctgtaatcccagcactttgggaggccgaggcgggcggatcacgaggtcaggagatcgagaccatcctggctaacagggtgaaaccccgtctctactaaaaaaaatacaaaaaatcagctgggtgtggtcgcgggcacctgtagtcccagctactggggaggctgaggcaggagaatggcatgaacccaggaggcggagcttgcagtgagcggagatcacgccactgcacctccagcctgggcagcagagcgagactccatatcaaaaaaaaaaaaaaaagattcacagactcatcatgcttagtacagccacatcttaacgctcaggaggctggcctggtcatcgttacatcgtgaagttaagtttacaagatatgtggtggtattgaatcatacctggtgattttccacgttccctgattttaagcagtctgctgttctgatgggaagttccaggttgggtttgtgtctgctgttttcaactctgagggcccctttctgagcttcagctcgcttatctagaagttaaatcagaagctttttgttaagatcaaacaatgtgcagtgctgttgcaacttgaaaagtgcttttcaagtattagatacaactgttaattctcttgtattttaaagtattggggcttggttttagctatatttaaacacaaaaatagcagtttcttgtttttccttacctgcttcatgtccatctacccagatcccttccactgggcctggcctcttaatgtttacgttattattcagtgattattcccatcccttgatctttgctcctgtttctttctttgcctagagtatttattttgcttcctgtccattccctaagccctgctgatccttctaaatccacctccaatcccacttggcgagtccctgctccagctcccctcagcgttcagtgtcgtcttagactccagatttccctttcacactgtgttccatgttgtttagcaattggctgtgtcctgcttgtggttcccttattttatcacatgtattattaggctcgtctctcccactggatgtcagtcagcatatggaatgtcatgatattaccaggtgatggagaggaattgtgcacgtggaatttggtacacatccctttttcaccctcttcaggctttgtgttaacttgggaagttacttactcttttctcatctgttaaacgggtactattacttgtgaccattacagggttgctgtgaagattccagaaaatgtatggaaagctctgacaaacaaacacgttaactggtaactgttcagaggctgttgtcttaagagaccctcttgcataggaaaatagctgactctgtcacttcagggagccagtttaagaaaaatgaagggtaatgcaggggccagctttcagcttggcacatctgaaaagttcacgacagcataccaaagggctgctagtgctggctgttggaaatagaaatgcagttcttgccttcaggaaacgctgtttggacacagacaagcaggtgggtccttgcaccatggctggaccagagcacactgaggcaatgtgaagaagtacccagtacacagacttgggtagggagtggaggggaggacatcagggtataagaagagggaggaagggaaggggaggagaatgttccaggtggagagtgcttggtgtggaggttggacagagcatggtatgttctgagaggtcagtgcttggcatggtcctctggcagaaaagggagtggctgtgatgagcaggaggctggctggggccacaggatgatgaataaaggacttgaatcgtgtgctcaggactctgagtgattgtgagcttttcagatcctaagcggaggagcgacatcagctttgtttttaacaaggtcactctgccctttggagagtggatggtggtgggtaagaatggagataggaagttactgcaataataaagattgggaaaatgggcttactctagtttcggggtggccaagcttttttgtaaagggccaaatggtaagtatcttagactttcaggccatcctgtccctgttgcaacgactgaattcaactctgcctttagcaggaagacagccatagaccctgcagagatggatgggcgtggctctgtgccctgcttccacaggagcatgcctacagaaaacaggcagctggccagatgtcgcccaggttgtggtttgctaaaccctgacctagagttggtttgcaaagtcttttggtgctggaataattttatactcttaatagttatattgaggatccagagagcctttgtttgtgctggttatcgctgttgatgttttctatatttgaaattaaaacagaacaacttacaatatttattttactttaaaagaatctactacatgttaacataacctttttaatgagaaacaacttttcaaaaacaaaaagattaagcaagaagaacagtgttgttttacacttttgcacatccttttaaaatatgaggtttaagaggtgacggctggattctcagacctgcttctgcattccgtgtgttccagttgctttattgaaacgtgtaaggaaaatgtggcgtcacacttccatgtgggcagaagaggggtcatcctggaggctcttagcgatgcaccataactcgccaggtggcagcgtgtttgagtgtgccggcctttcggagtcagtgacgtttctgtactctcttccgtcagaaccctgaggtctgtcttgtgctcagagtgggtcttttgctcatggacatgatttggtaacatcacacgggggttgtttggaaatattgttacatggagttgtttttttttctaaatgttaacacattccattatgtaaacttgaagaaaatcctattttttaatgtcatcactgatctcatcagaagaaaaagtgagaaactgtcaaattagcagtagtagagaaaagttttccaaaattctaattttctcttgaaagcttggattttatcattggtaacaaatactgtcagttactttctgtgaagtgagggacgcagtgtgttcattttcaagtcaatttctgccagataccaaattcttaataaccaaagttggtcagttgttctttcaaataaaaatggcattccatgaaaaaaagggctagttcagcttgtgtgatactgtggaatatgtatttggtcttccctagtacacaactcctaaaatcctcgggctcgtcagtgatgtcttcgtaatgcgttggctaagggccggcaacccctgggtagcttcagaacaggggctggtcaccagaaagacctaggcaggattagaaggttgggactttcagccccgatccccaacctcggggagtggtgaggggtgggggagctgaaggttaagctgatcaccagtggccaaacagtcttgcctatgtatggactgggtttgaagatagcttccagatgtttctggaggggggcccacccagagaggacacgggagctctgtgtctcagcccccgtccctcgccctgtgcatcacctcagtgtcctctgtagtctcctttataataaaccgctaaactaaagtgtttccctgagatctgcgtgctcagtgagggttgtggacactctgattgatagccagtcagtcagaagcacaagtaacacaacctgaggcttgccgttggctctcgaagtggggggcagtcttgtgggacagagcactcaacctatgggatttgatgctttctcccagcatcaagatttaatggaatcaggaccccagccagtgtccggctgcagaactgactgcttccttgctgctggggagaggtccccacacctctggtgtcctaagtgtgctgtgaggatgtgatgggagaaactgaattttgttttttgtttttcaaccccaacaactgtaccgtgtgctttttcttgagacagttgtacttggggatgcagcaaaagttcttttgtggcacattttatcacagggttggaattgaataaagtggtgaattattttaactgttcatcagggaataagctaagcaaaactggcctttttcctttttctttcccttttccctgcctgtgcagggcgtggagaggagagctcggggctgctgccacagatcatgctgagccgccagcagctccacctgcccttggctttgctcatccgtggaaatgacaacagcgtgaaaacggcagatgatgtacaaggattatgatgaaaatagtcttgacctcacggaccctctgagaggttcttgaccrytgcaccctcaagggcccacagaccgcactttgagaactgctgcttgaatgcaagctattagcagtaggagtgtcaaggacagggcagacttcaggattaactgttccttctcatctttaccagattgtactggttttgtctcaaaatacaaaaatagagtgtttattatgtaaagaaaatcaaatgatagaacagctgagaacagctggatcaagagcacagagcggaagttcctcttcatcccactgctgtcctggagtcttcctcaggacccactgctcctaactgtatctttgtagatcattttctatgtgtttatttatttatattttaaaacctagtttgtgtataagcaatcttttttaatccacaaatgtggaatcttattctagactttgaataagattttctgtattagtcagtattgttttttgctacttcttttcctttcctttccttttttggaaatagggtcttactcctctgtcacccaggctggagtgcagtggtgcgatcagagctcactgcagcctgatcaggctcaagcaatcctctccctgctcagcctcctgagtagctggaactataggcttgcactgccatgcccagcttttttctattttttgtagagacagggttttgctgtgttgcccaggatggtcttgaactcctggactcaagtgatcctcccacctcggcctcccaaaatgctgggaatacaagcatgagccatggcatgtggcygccacttgccttttttcattaagagtctataattggagatcttacagggaactgggctttctgctcagccatactygagctcatttgacccccggccactgccccttgaratgtaagtactactgtgttgccttcatcatacacatgagacgatcaagtatcaggaagatgaagttacttggtgaaggtctcagagctaataggtgctatacccattatttgcatgcagacmttctgagtcyagagcccatacttaagtttttaaccaggctgcctttttatgtggctcattttatcctttttgatggctgcatagtattcccttagttatttagtccactgtttctaatgacagtgcaggagagtctcgtccatccttctgcccttcctgggtggcagacatccaggagtgggtacacggtgtcagaggctgtgcacatttcttgtttctattctttgaattgctttgattacatcttttgtccatttttctgctgaacttaaaaaagtcagtctgtaaaagtggtttttttggtttgtgtgtttgtttttttgagatgaaatctcgctctgtcacccaggctggagtgcagtggcactatctcggctcactgcaacctccgcttcccaggttcaaacggttctcctgcctcagcctcccgaggtgtgattacagggatgccaccatgcccggctaattttttttttttttttttgtatttttagtagagttggggtttcaccatgttggccaggctggtctcgaactcctgagctcaagtgatccgcccacctcggcctcccaaagtgctgggattacagttgtgagccaccgcacccagcttgtaaaagttctttatgcattatgaatattagtctcctgagtttttaaaaattgttgaccttgagttttaattcctctgcccccattccacactctcctctccgagtacagctgaatttattatacatgtgtctttgactagattttttgtattgctgttgctactctggaaatgaagaaaaagggctgagatccatgtttgggtcagtaatggggtggaagaggaataatgtgtgggacaaaaggcgattggtgaattgaactgaaatatcatgtgaggcttaatgatgggggtggatattttctgagcaatgtgtcgttaggcgattttggcatgcgagcatctgagagtacacttaccaagcccaggtggtagggctcactccgttacaggcctccattattgtctcatgggaacgccatggcaggtgtggactgtcaggagtttagagctcagaggcaggggcaaccatgaaaacaggcaatcctggagtagtgacagaagtcttgctaatgatgttagatatctcagagcatgaaagagacttgagcttattttatctggatctccagagatgataaaaccacaactaaaataggaatgcagccgtgtgaagacacaggctgtgctgatctttttctgtatcgtgcacaacacctaccactgcaccggcacacaggaagggcttttatgaattcttgggtgagtcaccatacctgcctgaaaggggcagcaggtttgctgataattagcaacatttgagtgaaaaaaacacagacaataggtctgcatgtttaaccgcatctaatggctggtttgttttaagtgggtggtgagtaaaagagttaacattaatcatcatagaaatggtattaatgagcaaagatatgaccggcctcacacctgtaatcccagcactttgggaggccaaggcaggargatcccttgagcccaggaggtcaaggctgctgtgagctgtgatcacaccactgcattccagcctgggaacagagtggaccctgtctcaaataagcaaagacattctaattaaagcaataataatgttccatttttcctagtcatttctggaaggagtgtctgtacactcattttttggagggtaatttgacatttctctctcaaacttaacacaagggttaggaccccaaggttccacttgtaggaatcctacaggaaataggccagcatttcagaaagatgtgcactgcagtgatacaacgttgaaaacactaaatgcctaaaagtagtgaggcggttacatgtgttagaacacacactttgtggagtaagagtgttctgggcccctcggagagcagtctgtgacacattgggtgaaaacagcagcttttgcagaagaacggtgaccccaggcgaagctgagtgtggttgtaaatgctgctctggaaagcagatatccaggggtgacatcgggggtgcctgtggggaaagggtggtcacgcctcactgaacagagactttggcttttattctgcacatttctgtattattttatgttccacaccaagaatgcattgtttgtaggtataaggagaaaagtgcccttaagaaaaggtaaagagggagttctagcaactcgaaggaggaaggtttttctctccgtgcacccctaatagtgactcagcactgcttagcaccccaccttctgttgtgctccggttttctggaattttaatggttttaggctgccattttgtcatgtttgaaaataccttaaattttttttttttaatttcaatagttctgttccagaatctagaatggcgaagtagtatccctaaaagagtattcattacaaaagctctagtacataactagatttaaaagaaagcaaaacaaaaactcagctagtaataatgattgaaaaggggggattcgtgccttacgtgtaccagtgcgtttgtaaacgttcctggctttcgtaggcattgaaggctgcgtctcagctttgctcccgtcctttgcagtaacctgtgtacgggaggctccgttgtttgccacctcacattgggataggttgcttttagaataaataattatgtattatttgcataaaataaataaacacccacatactccacacttaacaacggtccatcttgttttgggtttttgaagagatgaaggctacggtcatgttgaggctgtccatctccgttttaactccccaactccgttgcccgcactccttcctcactggaggcactgtctgtgaaattggttcatagcctgtccctgctcttgagtgtttatccaaatagatccatgggttgccttttatcagacagaggccgatggggaattgcrgctctgccgtggccgcgcttctccagctccctgcaactttgtcagaccctagagatctgttcagtgtcacaggtcacatttcttagatgttgacttcgtttatggtaacagatagatgttgttaaaggcatctgaaatattagataatcgttgaagtagtattaaccaaaattattaatctcctctgccatagagccccggttaagttcaggtgtgtaatagtgatcttaaaatggagagaatgagaaagtttttactttaaccattctcaatttgcttactgttcattaaagaattcagtagtaaaaggcgtaatctatttggattatgaaggtatcagcatacggctttctgtgtacgccctaaagtactgatcacagtcaaatatgtcgtaggtaaaatagtaaccatagaaatccattaaatgtctgctgctgggttatttaaaaagtagatggaacctttctctggccacgcgccctgataacctccgtgttccccgcaggacaggctgtggtggaggcgcacacacagcacccagaggcgggctctgtggagttcgcatctgtatgtcagcaacttagggtggtttgggccatgtttcacttgacctacagagagaaatgtgacacccaggttggcatagattgggatttttttttttttttttgaggtctaggaattttttttaattgtggtaaaatatacatggcataatatttatcattttagccgttcataagtgtacagttgcgtggtggtaaatgcacttacagtgttgtgtagctatcaccactacctgttcccaaaacaacttcctcattaccaacacaactttgtcctattaaacaataactccccttctccccttccccggcccctggcgaccaccattctactttctgtctctgaatttgcccagtctagggacctcaggcgggtggaatgacacagcgtttgtagggacctcaggcgggtggaatgacacagtgtttgtagggacctcaggcaggtggaatgacatagtgtttgtagggacctcaggcaggcggaatgacacagtgtagggacctcaggcgggtggaatgacacagtgtagggacctcacgcaggtggaatgacacagtgtttgtagggacctcagtcgggtggaatgacagtgtttgtagggacctcaggcgggtggaatgacagtgtttgtagggacctcacgtgggtggaatgacacagtgtagggacctcaggcgggtggaatgacacagtgtagggacctcatgtgggtggaatgacagtgtagggacctcaggcgggtggaatgacacagtgtagggacctcacgtgggtggaatgacacagtatagggacctcaggcgggtggaatgacacagtgtagggacctcacgtgggtggaatgacacagtgtagggacctcaggcgggtggaatgacacagtgtttgtagggacctcacacgggtggaatgacacagtgtttgcagggacctcacgtgggtggaatgacacagtgtagggacctcaggcgggtggaatgacacagtgtttgtagggacctcacacgggtggaatgacacagtgtttgcagggacctcacgtgggtggaatgacacagtgtagggacctcaggcgggtgggatgacacagtgtttgtagggacctcaggcgggtggagtgacacagtgtttgtagggacctcaggcgggtggaatgtcagtgtttgtagggacctcaggcggatggaatgacacagtgtagggacctcacgtgggtggaatggcacagcgtttgtagggacctcaggcaggtggaatgacacagtgtttgtagggacctcaggcaggtggaatgacacagtgtttgtagggacctcaggcgggtggaatgacacggtgtagggatctcacgtgggtggaatgacacagtgtgtgtagggacctcaggcgggtggaatgacacagtgtttgtagggacctcaggcgggtggaatgacacaatgtagggatctcacatgggtggaatgacacagtgtttttagggacctcacacgggtggagtgacacagtgtttgtagggacctcaggcgggtggaatgacagtgtttgtagggacctcaggccggtggaatgacacagtgtagggatctcacgtgggtggaatgacacagtgtttgtagggacctaacgcgggtggagtgacagtgtttgtagggacctcaggcaggtggaatgacacagtgtttgtagggacctcaggcgggtaggatgacacagtgtagggacctcacgcgggtggaatgacagtgtttgtagggacctcaggcgggtggaatgacacagtgtttgtagggacctcacacgggtggaatgacacagtgtttgtagggacctcacgcgggtggaatgacacagtgtggggacctcacgggggtggaatgacacagtgtagggacctcaggcgggtggaatgacacagtgtagggacctcacatgggtggaatggcacagcgtttgtagggacctcaggcggatggaatgacacagtgtagggacctcaggcgggtggaatgacacagtgtttgtagggacctcaggcgggtggaatgacacagtgtttgtagggacctcaggcgagcgggatgacacagtgtagggacctcaggcgggtggagtgacacagtgtttgtagggacgtcaggcggctggaatgacagtgtagggacctcaggcgggtggaatgacacagtgtagggatctcacgtgggtggaatgacacagtgcttgtagcgacctcaggcgggcggaatgacacagtgtagggacctcaggcgggtggaatgacagtgtagggacctcacgtgggtggaatggcacagcgtttgtagggacctcaggcaggtggaatgacacagtctttgtagggacctcaggcgggtggaatgacagtgtagggacctcacgtgggtggaatggcacagcgtttgtagggacctcaggcaggtggaatgacacagtctttgtagggacctcaggcgggtggaatgacacagtgtagggatctcgcgtgggtggaatgacacagtgtttgtacggacctcaggtgggtggaatgacacagtgtttgtagggacctcaggcgggtggaatgacacaatgtagggatctcacgtgggtggaatgacagtgtttgtagggacctcaggcgggtggaatgacacagtgtttgtagggacctcaggcgggtaggatgacacagtgtagggacctcacgcgggtggaatgacagtgtttatagggacctcaggccggtggaatgacacagtgttcgtagggacctcacgtgggtggaatgacagagtgtagggacctcacgtgggtggaatgacacagtgtagggacctcaggcgggtggagtgacagtgtttgtagggacctcaggtgggtggaatgacacagtgtttgtagggacctcattcaggtgggatgacgcagtgtagggacctcaggcgggtggaatgacacagtgtttgtagggacctcacacgggtggaatgacacagtgtttgtagggtcctcaggcgggtggaatgacacagtgtttgtagggacctcagtcgggtgggatgacacagtgtagggacctcaggcgggtggaatgacacagtgtttgtagggatctcacacgggtggaatgacagtgtttgtagggacctcacgcgggtggaattacacagtgtttgtagggacctcacgtgggtggaatgacacagtgtttgtagggacctgacgtgggtggaatgacacagtatagggacctcasgcgggtggaatgacacagtgtttgtagggacctgacgtgggtggaatgacacagtgtagggacctcacacaggtggaatgacacagtgtagggacctcacgcgggtggagtgacacagtgtagggacctcaggcaggtggaatgacacagtgkagggacctcacgtgggtggagtgacacagtgtagggacctcacgcgggtggaatgacacagtgtttgtggggacctcacgtgggtggaaggacataatgacatagtgtttgtccacttgtgtctggcatatttcactacacatgatgtttcaaaggctcagccatattgtagcatatgtcagaatttcattcctttttttggcagaattagatgtggatttttgatgtaggaggtacgtttctaacctacttttgtttatttaaaaaattattgctgggcacagtatctcacgcctgtaatcccagcactttgggaggctgaggtgagtggatcacctgaggtcaggagttgggagatcagcgtggccaacatggtgaaaccccgttgctactaaaaatacaaaaatttgctgggcacagtggtgcatacctgtaatctcagctactcaggaggctgaggcaggagaatcacttgaacccgggaggtggaggaggttgcagtgggccaagattgcgccactgtgctccagcctgggcaacatagcgagaccctgtctttacaaaaagtgaaacaggaatctcagggttgtgtgtgtttctaataaatgttaatagaagatgaatttcaggaacaagttattgggagagaaacattagcagctttgttttgctaatatgatgggctaggttcaaggatcatttcctaaagtttgagatgtgcttttccccttttgataccagctctcagagtgatgatcgtttctgtataggcaagggaaatacttgtcactgccttcttgctrgtttgactgactctgaaatacttaaagatagttgtatttgttgttgcatgtctagatctgccacgggggagaggccagagaggctttgctgacgtgcagggagtgaccgggggaatgtcccagcctcactttgcaggtgcagttgagaaggcaccatgagtaaaggcgctgccccacgcacccagggtcctaaggcttcggcagttaagagttcatccgttgccatttgatgagggctctgggagtcaaaaggcttccctgaacaaggaacccttgagctcagatgcaaatgagggatgggcctggacygggatgggggatgggaggagcctgcaaaggggagagagggtgggaggacttgacatgggagaagaacaggctggggcaatggggtgtgaaagcaaagggagtaagatgagcattttggtctttactaagggcagtgaggattcaaaacagcatggttggatttgagtttaaaaaatagaactcactggctgcagtgtgcggaggtgggctggaatccatttttgctcagttggggagagtgtatttttaattttccaaagtgactatgttggtgattgtgtcagagcccctggcctgtcgttggtggttataaagcgcttttgatttgcctgtaaatcagagtctaccatggctcacatagttatttgcaaaaagaacttctaagcatgaaattgagcataaaattgcctaggagtaattcagtttgcttaatatgtttgagagaaaggttaatatattcagtcagacagccttttgtttttggataaagacgttctcatttttcagcatggcatgagggaaatagcctggaatattctcagtaaatcagattttcccttgaaaagagtggccctacctctcatagacttcaacggcagtggtttaatatggttcccaaattctgaagtcttctgaaatttgttagacaaagcaagacttaacgatcacagcatgatgcaaatactaattttccgagtaaaacacaataaaagattgaccgtttctctctcatgtcatttacgtatgtctatgactgtgagaactaaagtggccgtatttacagtaaggtaactattgttaatgctgatgtattcttgagaaataaaaagagtgaatgttaagtattcctcatcacaaaaaggagttatgtgggctaatacatttgttaattagctaaatttaattgttccacaatgtatgtatactttagacatcatgttgtacatgatacatacttatctgtcaattgttttttttttttttttgagacagaatctcacactgtcacccgggctggagtgcagtggcttgatctcagctcactgcagcctctgcctcccaggtgcacacgattctcctgcctcagtcccccgagtagctgggattacaggtgcacaccaccacacttggataattttttatatttttagtagagtttctctatgttggccaggctggtcttgaactcctgacctcgtgatccgcctgcctcggcctctcaaagtgctgggattacaggcatgagctactgcgccyggccattatctgtcaatttttttcttaaaaaaaattggaaagtagccaaaaagaaaacaaagtccctttaggtttaaataggaaaatgaatttagtaatttgtggaaaacaaatttatatcagatttttgtttgttggttatttttaaaacttggaataatttagtctacttttagagtgtatttgagaatggttgcaagttgtgaggcccttttagtgacttgatccatttgtttttatggggtagttttacttacaacagcttttgagctgtaattcattgagcacagagctcatcctttgtgaagtgtgcgggtgaatattcagttttgtggccatctgaattggataattctagaacctttccatcacccctaaaagaaacccactrgcagtccctcccattccctccaccctctgccctctggtaaccactgattactttgtttctgtggatttgcctgttcacgtgtcatgtaaatggagtcatggcccacgtgtccctctgctccccggctgcttctccccagcgtgatgccggtcaaggcatatcctgcagcatgcgtcagtcctccctcctttcctggtcaaacagttttccatttttgtttatccgttagttgatgggttgttcctagtttttggctctttcaaatgcacctgtggacattcttgtacatgtttttgtatagacatgtgttttctgtgctcttgggtatattcctgggaatggagcttggtcatatggcaactgtgtttaatgtatttgtggaactgccaaacagtttcccaaggtggctgcaacattttgtaatcccgccgtcaatgtatgaacagtttttcttcacctacgcttgttattgtctgtctaattttagccatcctaatagttgtgaactggtatctggtggttttgatttgtatttccctagtgattaatggtgttgagcatttcctgtgcttatttggacatttatatatatatatttttggaaaattacattttcaattggcttgtctttttattttatttattttagagacagggtcttgctctgtcacccaggctagagtgcagtggtgctgtcatagctcactgttaactcctgggctcaagcgattctcctgcctcagcctcccaagtagctgggactgcagatacacaccaccacagccggctaacttttaaaaaatttttgatagagattgggtcttgctgtgttgcccaggctggtcttgaattcctggggttacagtgttagccaccgtgcccgggcctttctttttattgttgtaagagttcttcaggtattctggatacaagtcccttatcagatacataatttgcaaacaattcctcccattccatgagttgtgttttcagtctcttgatggtgtccttagatgcacaagaatttttaattttgatggtgtccaccttatttttttctttcagaagtttgtgcttttggtattatatgtaagagaccactgtctaatccaagattgtgaagatttattcatttagctcttacatttaggtctctgatccatgtttatatataattatatatagaatttatgtgcagttaattacatttatatataatttttatatgtggtgttaagggttcagcttttttcttttgcatgtggatatttagatgtcctggcatcattgttgaaatagtattcttttaccattaattgtcctggtacacttgttgaaaatcagttgaccgtaagtgtccttctagactctgacctctgatccattggtctatatgtctgtcctcatgccaataccatactgtcttggttactatagctttatggtaaggtttgaaatcaggaagtgtcagtcttcctcctctgctctttttaaagatcattttggctattctgagtcccttgcacttccatatgattctagaattagtttggcaatttttgcaaaaaaaaaaaaaggcagctgggattttcatagggttaataccttgactattgtagaacactttggagatactttcttaagttttccaatcgtgacacaggataactttctgtatattcaggtctttaatttttttttttacaatattttgcagttttcaatgtacaaatcttgtcattctttgattaaatttattcctaagtatttattctttttgatgatattgtaaacagagttgttttcttgcttttatttctgaatttttcattgctaggtgtagaaatgcagttgactttattggccttgcatcctgtgtccttgctgaacctgtttattatctctgataggttttgtgtttgtggattccttaggatttcctgtatacaatataatgccatctgtgaatagagatatgttactcctttttaatctggatgccttttatttattttctttgcttaactgccccagctagaatttccagtagaatgtttactagaagttagcaaatcaaacatccttgtcttgttcctgcttttaggggaaaagccttcagactcatcatgaagtgtgatgttagctgtggttttttaggtactctttgtcaagttgaggaagttgcattttattcttagttggttgagtgtttttatcatgaaaaggtgttggatttgttaaatgctttatctgcatttattgagatgaccatgtggtctttgtcctttaatgttattagtatggtgtattacattgatttgtttttgtatgttaaaccaaccttgcattcctaggatatggtatacttmtcatatttcaaaaatattgtttgttcctgtagcagagaaatttttagttctttctgasttctgtattttagaataatttgccacaaacttttttttagtgcttaagtgactagaaagtagtatgcagaattttctattttgtcacattttatccagtctagtcataatgatgcaagattttttttgctccttagttcagctaaattcagcttcttgtcttgcaaccaggaaaaattaggcatgcggatacattgaagggtgaggaggcagaatttattaagcaaaaggaaagctctcagcaaagatagggattctccaagcaggtttccccctcacaaattgaatacgaggccaccacgcagaggttgaagaagccaggcccctccccagcataaggtgcatattcctagtggctccgccccgtttttcagcgcacacacaggcccttagtctgagccactccatgttgatttatttcccttactgggcatgtgttaagggacgggatttttcaatgtgggcatgtttaggcgacttcccccaccccatgcacaatgacctgggcggggcagagattcccttgggacctttccctgtttgcctgtgtattgcatttggctgtctcctgcctctatcagtaattcggataaactcaattttggatgcttttagattatagtgtctctagagtcttactgggtctcggacataaatagttttccatttttttaatatatggtagaggcttataattcacttctattagtttatgtctggtttttgaacagaatggactttttgcctttgggtgagcttctttgaaaagacacagaaacgtgtgtatatgtgtgtgygtgtgcatctgtgtctgcttgtagaaaatttcttacttccagctgagcgcagtggctcacgcgtgtaattcagtactctgggaggctgaggcaggaggatcgctngagcccaggagttcgtgaccagcctggacaacatagtgagaccctggctccacaaaacattaaaaaaggtagacaatttcccacttttcttgtctgtcagtttgtcgtatccagagtgccctgttgctgagctcaccgcctggcagcctcggtaaactctgcctccttggagggcagctctactcctctttctgcatatgtactaaattcttctcagagaagttttatgtgaaggagttgtgatttccaaaaactctctggctggatgtgttttttgactgttgtgtgtcatcgtttgagtccctgcagtatgcacacagctctgccaggtgccgcagagcaggaaacaaatggccttgcccggcaccttgcctctgcccagcgtgtagaggagagaagtgattgggtsggtaatggtaggaaacgaactcgttgccagagtaggggtgcgttgaaatggktgaacttgccgagtcagggtagcagagcgctggctacagcgagttcatgaaggactgggaggagagggtgtggtgaccacgagtccaaagagctgcctagcttgggtcatcccgctccaggtggtctctgctggaagcagtggcttcttccactgcagggggtgtctttgacggggagattatggctgttctcttttgggttcttctgtttttcatgaaataagcagattcattaatgggaagtggggtgagtggctggggtgctggaagtttgaggggagaggagaggtgtgagacagtcattttgaggagggaggagccgtggtctgggagcatcaaatgaaggaaggagaaactctccccccggggagtggggtgtgagacaacagagagcccccatggagagggcctgggagaagctgctgtcagggattgcaagtttcagactaagaggatgaatggagccttcagagagggcgggtgcgcgggtcggacgggtgcgcgggttggagtacaggaggcccagagcttggcggcggtgagagtccgagtgaagacggatagctgcttgggcctgaagtcagcgggatgatgtttgctgcagaatggaatacctgcagagggcacaggtcccagatatgcagtactgactgtcgcccagcaaagacccccagtaaatacccagccccactaggagcacgttgccaggacgccaggccctccctccctccggggcagctcctaccccagctggcatcgcacatcggacaccccgttcttgaatgtggtataagtggaattgcaccctaagtcctctgcagtgtttggctttctgtaactaacctggggtgttacgcgatggtcatttgttttcattgctgtgtgatgttctgttgtatgaatatgccacagtttatgcatcttttctactcttgacggacatttgagttgattcttttgtgaacgtgctgtgaacattctcgtaagtggttcagtgatgcacatatgtagttctgggggctgtgtgtctggagtggagtttctgggtcacgggatatgcatgtttcaccttagtggatattgtccgatggttttcagagttgctgtacccatgtttgctccaggagctgtctacgagagctgccgtggatacctggaaaagtcagtctcatttcagctggtgtgtgagtgtgacattgcagggtggcttgtactgacccttccctgacagctagggagggtggacaccagttcatctgcctactagcctagggtccgatttgctagtgcctccggtagggcgctagttttccttataaccacytcctgggctgctaggccacctcagttcctggtggccaggtggagaccatcaggaaggggcagtggcctcgcgagcagcacctggtctgtggttatgtgccaggaagtgtgtttaaatgacccactccagaactagccgaagaggacctgcgggaaactttcacatcatgtctgtcagggatcccttttgttttgacaatgactcagtaattttaggtgatgcgttttaagtactgtatcttttttggtaatagactgattgtggtacttgggtattgacagggttttttcaggctggtaatgttatctttatgcttttcaagagcttcctcccgctgctttctggacattgggctctgaggcttaggagaggaaatgggggaaccccttgaaggctgcggcaaccctccagcagaggtggtgggtgccgtgggcggaggctggcggcagtgaagatccagagaagtagagaagtgaaatagtcacatttttattttgttttgaaaaacctagtgggttttcaaaaactattaagttaggaaaagtctcaggatatgagccatgcagccagcaggcctccaaatggccgtccaggcaggggagacgggtcagacgggtcaggagacattgtctctcgggacaagaagagctgagagctgatctgatgcattcatatttgacataccagttaaaggaagtagttagaaatgatgtacgtataaaagaaaagtagaataataatacaacaggcgcctctgtcctcaaccccagaactcacgcctggagttgtttgtctgccttcgttgtgtttctctccagatgcagtttctggatctcctgaaggctgatgaccccagacggccttgtcattgccccctgtactacctcggaaatcttggtttcaggcacccccttggatttctgtctcctgtgcttcccgcagagtggccctgctcaggcgccccctcctgatcctctgagcctctgcctcctcccagccactgggcaggctggaaatgttatcatgggaatgggcaggctggaaatgccatcgtgggaactgtgctgggtggtctggtgttgcccttagtgtttcgttcactaaagcgtaagccgtgtgaagacgggctttgtgttgtcttgaggccacccacgcagtgcttggtttagagccactcagatgtaggagcagcttaaaaagataagctgctggcctcaggtgtgaagtgggcgtggatactgggaggcaggcctgcatttctcaagactcgtcactcttctctcttctgaggggacttccgccataggctctccacatcgcccgtgtcctctctttcactcctagcaggtgaccctccctcatgcctcgtggaaacagtgcagcctgaggggctgtgctctgcccgccacacctgcccgctccattctcacagcagctcccggctgtgctccgtgcctccctccccgccaccaccggcagctgactctccctggggcacatggtcctgacttctagggcatgttttacagatcccactgactccgtttccccttccccatccacagctccttagtctgcttcctcatagcacccgaatgtcctttaaacctgggacctcattcctcgtcacctgcccctcctctcttgccacctgaggccgccccggttgtaactcctgtgctgggactgctcacttttcattccgtggtttcgaaccgtcagtgccaacctcctgtatggcaaccgatgattccgccttttactgataccaccttcagcccacgtgtatccccactccccacaaaaaaagaggttgaaagagatctattgcaagtttttgttacatagtattccgttaacaggtaaatattgtgtattactgaactgtgccttttctttttcacacaagttttcactttcctaggtctaatgattgcctgattttctcatatgcttagttatctgtgtctttagtgcatttttttttttagcaaacacttcaacaggtctatcaaataccaacacatcagatcagctctcagctcttcttgtccccagaccagtctccctggcctgaacggccactctgaggcctgctggccgcctggctcatgtcctgagattctcctcaccattttttggaagtcagatctgccatcttccttctcttggctttttctctcattttgccaaattgcctctcgcagcagtttcctgagaaagcatttgtttgttttggctctttgcatattcgaaaacatttttactgctccctcagatttgatygaaaacttgactaggtctagcatttcaggttgaaaattgttttctcccagaattttgagggtagtttgaggtttcatccaccatgtttcctgcaacctgtgtgatgccatctgactcccttcctctccgcatgtgacctgttcatttgctctggaaatttttagaatctcctttttatccctggtgttgagatgtgcgcggcctgggtctgccatcagccatgcggggcctctgagcctgggaacggggccttggatgcttctgccttgctttctctgttgtgtttctagaantcgtcagctgggaggtgggccaccgaaactgatcctctgattgtcttatccttcctgtcatccatgtctttctttccactctgccctttggaggagatctgaaggttttgatgattactgttgccctttggatttcacatggcactttctcctcctctttccttctttagcatattcttcctctcctgggggccccactgggtgtcctggctgagaccagcccaggtgtcctgccccactcacccgcaggggcttgctaccttgagcacgcagggtcccacgtccagcatccctctcctctcccctccatcaggcggggatgatgatagccctgcttcctggggctcttagaggcctggctacgttagtacagggcttgtgcgtggttaggatagcacctggctcctagtaagcattcagccaaaccctggtactgtagcggctggtagtagtcagcagatctccagaacatgattcgggctttcccgtctctctttgttcagattccatccttgtttttgtttttttgttattttttactgagatggaatcttgtttgttgcccaggctggagtgcaggnnnnnnnnnnnnnnnnnnnncagtggcgtgatctcagcttcctgcaatccccacctccctggttcaagcgattctcctgcctcagcctcccgagtagctgtgattatagatacacaccaccatgcctagctgatttttgtatttttagtagagatggggctttgccatgttggccaggctggtctcgaactcctgacctcaggtgatccacccgccttggcctcccaaagtgctgggattacaggcatgagccactgcgcctggccccacccatctttgttttggtgacttcttgaggctctgcaggtcgtggctgttggtttctatttctgagtgtagcgaggctgctgtttctgtgggcctgggcttttcagctggcagcttcactgtggttggccatgtccttgtaaaacccaaatgtttgaatattgaggccctttccccagggctggagtatttcggagggcacccctggggatggcggccggtagccagtgtctgaggaacaagaaactgtgtgctcccacctggcagggtgaatggggggcgacctggggaccaagcagctctgtgaagactttctgcatctctgtgccagccccttgctgcccccacgtttgttaaagctgctcacatagatgctttttctgctttcttctgacacctgggcgggggtgggagggtaaaggagatgaacacacacgcatggcccaccatgttcggcgggaggtctgagaggactnggggtggctgcggacactttgcggatttgatgggacccggatgttgaatgaggattgcacagccagacagccagctggcagcagtgccacggcaggtggagtgtgacatggcagtggggcctgtctggctgagaagagacccgatgtctccatgggatggccaggaggtgccaggctgtaccgtgggcagaagcactcccctaccccagcagggaaatggaggcagaacgcagccatggtgaagtttatggtagtttaaaatacctaactcactttgggaagctgaggcaagttgatcacttgagactgaagcgggctgatgacgtgaggccaggaattcgagacaattctggtcaacatggcaaaaccctgtctctactaaaaatacaaaaattagctgggtgtggtggtgcacgcctgtaatcccggcgacgcaggaggctgagacatgagaatcacttgcaccctggagatggaggttgcggtgagccaagatcgcgccactgtactccagcctgtctcaaaaaaaaaaaaaaaaaaaaaaaaaaaaaaaaacacaaaaaaaaaacctaacttggtgcctttagtaccatatttatgccttcagcatcagtctggtttttaaaaactgtctccatcagattaatttgatgttgataatttaaacgttgttggttttgtaattttgtgtatttagtttgggtttagagattgagcactgcagtgtttctaattttaggttcacgcgtgtttgtgtagcttaatgaaacttcccagcaccgacagttacaggagtttctcttttaaaagactcagtccattataattaagtttgaaaatcactgacagagctagaatackattaattatgtaattttatacaccctctgggtataaatgacatagatttagacctttttaatccaatacataatattttagtttcatttaagcaagttaggttattttcagtaatttaatagtgacgcttctaagaaacaacctaatccttcttccaaagtctgaagattttgaaaagaaagaactcccaggccagggattcccgtgtgaggccagcgaacagtgccagccgcgggagcttgctgtgtagatgttggtggaaatccttcactaacacgattaaaaygcctttgcagacctgtcagaattgcattctagccacttttggagggagctgtttgagtcacttcagctttagggcccatttcttcttagtaggttgtttacaatagccatttagttgtttttttacttcctactataaacgtaccgtgggccctgggtgtgcccaggtcactgcgagcccttgagttggtgcccagcagggaggcgagcttgtagtgttctagctgttcctgagactcccccacactgcagggtaaggcgaggagtcccactgtggccataggacaagctctgatggcccctcgggaggccacgccaggccttatcctcagtccgcacgcgacacagcagcactgcggagaagccagcctcctccagagtctgtcatggaactccccctgaaaacagaaaatctttgtccaagtcacagacctgggattttttttttttaatttaatagttggtcataaatccagacactcccttcccaacccgaagggttagcctcaggacacctgaggactttctcactgcttagtggtggtgttccttctgccccggggtcttggcctctgttgagctggtgtctggggtctttgttatgctgtcagagatctcaaggcctccctgacagttgtctcacttggtaatgatgtcatcattatcagtggtggtaactgtatccagacaatgacatggaacttctactgtctagaatattacattgtacagaarccaacaaaagttattgcatagaatattaacaacatttttattactattatataagaatcagatttattttaaaagttaacattaggtatgcattataaaattaggcaacattcttcaggacccatttttttcctctatttttttcttttacagatgaattttctaaatttctaccctttatccttttatcaagacaacctagtctagataaatcctggtgctccaggggcccaggcatgggggtggagtaaaactcgcccattcacctgtgccggcaggttctctgcaccagaaccaataagtggccacttggtaattacaagtttgccaagacagttttgctttagtctcggagaaagttgtatatgtttatcgtccttttgctcttttttattaattttttggtattgtgactcctccccaaaaccgcatccggtaaatcgcttctgtattttgttgacagcggacatcatttccaccgttgagtttaattactctggagatcttcttgcaacaggagacaagggcggcagagttgttatttttcagcgtgaacaagaggtcagtaattttcagtccacaaatcaaatgcaattattcaacctttcgcatataacttagaagggaggaagcaaaattattttctcattgtctcatttcattaagattcagttccatcacattagccatacagaatctcctttcagaaattatctaagttctggcctcagctgctgagccccggtgaagtctccaaggcctttgtcttcagagtagggaggagattccgctggggaccccatgaaggatgcagggtggtggtgaggtgcatttatgtgctttcattccataagaactcacgcggctctctctgaaaatccctttatacgcctatgcaggtactggcccagccccgccgtcctgccctgccatgaagtgtgagcagctttctcagcacttcctgcagagaagtctggcaggggtgtgaattctctcttcccttcagggagaggtgagcagcactcactcctccatgcccccttgaaggcttcacctgtctggagggaagggaaccttcagagtgtgggccttggaggagcccacagctcataagcaagcactggcttcccggtcacggcactgccttttcactgatgccttgccagccccctccctcttctttctgttgagcctcctcagaggtcctaatgagcagtgataaaggaagcaagatcatgatttggtagtcaaggattcctggcaagaaccctggctctgtgcagctaagcctggggtctgaaatatttgtcctgccttttccttataaatacagtcccttgcccttcctgtctctgagtttcctaacagatgaaagggacagtttatcatctccaaagtctggtctctaaatttgtgtgacgaactttggtttagaggttggtgggccctggttcccctctctgcagatctgtacacaggaagtgctggccctgccccccaggaaggggagcctggaggaggactgtccctgggccacatgaggaaaattgacaggtgctaaccaatttcattatcaaaacatacctgttgcagctttattttgattatgtccaggtagttaaagatttttttaaatcctgttttctctgatttgggatggtaagaaatccttttgtgaataataagtatatcgttaatatttcttcacagtttgatacatttataattttgcatttttatctcagaagtagaatatcacacaatgctacttaagaaccatataccttggccaggcacagtggctcacgcctgtaatcccagcaatttgggaggccgaggtgggctgatcacctgaggtcggaagttcaagactagcctgaccaacatggagaaaccctgtctctacgaaaaatacaaaattagccgggtgtggtggcacatgcctgtaatcccagctacttgggaggctgaggcaggagaatcgcttgaacccaggaggcagaggttgcggtgagccaagatcgtgccattgcactccagcctgggcaacaagagtgagacttcatctcaaaaaaaaaaagaaccatacaccttacctttactcaacagaagtaaaagtgggttgtggtgtttaaatgttnnnnnnnnnnnnnnnnnnnnttttaaagcaggaggagtttttgtttttttgagatggagtcttgctctgtcacctgggctggagtgcaatggcgtgatcttggctcactgcaacctctgtctcccgggtttaagtggttcgccctgactcagcctcccaagtcgctgggattacaggcatgcaccaccacgaccagctaattttgtattttagtagcgatggggtttcaccgttggccaggttggtcttgaactcctgacctcaggtgatccgcccacctcggcctcccaaagtgctgggattacaggcatgggccaccacgcctggccagcaggaggattttttaacaaattgttgagtcatggctatcttaatgcaagacttcacttttagcttatttaaaaagtctgtcattgtagcgatagccttagggaagatgcctcatccctgcctaacagattttaggttagaaaatggaatttctcttgtttttgtgaatcgttgcttaacctaaataatartagtctcaaatataaaacaaaccctgataaaagtcaagcatctcgttctaaaagatantgggtattatagagtgttaagtgcttttttaagatgaagttgttatgtgagtgacagatttatacaggagcaagtccctactgaagttgttcagccagctgcaacttgacaaaccccaggcagccttttttctttttcttcgtatttcggttcacgtctgaaaggctttcacggtccatccattttagagcattcggctggttgccccatgtgcccttccctgtggacttgagtgtgtctgtgggtaagggcggcagtgcacgtgttcatccatggccggaggccgcggatggtgttgcagccgccaagagggtgaagctgctgcccatcaagcgaccccagctcccagttagaagctgcagcaaggttcacaggcgtccacgtgtgcgkcttagaatcgaaggagcgtggaggattcggaaggctagtgagtgagcaccagattgtggaaggtgcagggcctgagattcaggagtcaggtccatagaggcccgttgggaagctctggctgtgcagaagacgaggtgggaagcatagtcagcaccttgagtttcaagcttttcttacttttctgtgcagattaagtcttacaggaaagcccagccaataaaactaaggcccacagaacgtatgggtgtggctgtgcggcccactgccctccaggctcagctctagccgccaggaatcaggtgaaatcagaaatcagcacgtccaaaaagagaaggtgctcgcttcctcctcttcctgtgtgttacttccctgctctcctgcccgtgtccccatgaggcttcctttagaattctctcctagcagagcggcactccatgagatctgggagtgttggagaaggctgaggggttgcttgggtttggggtgactgggatgggagttggaacccgttcatggcagagagacaagcctgcagcctagggaccattcttgttctggctcttaggagaaaggccagggcagtgcaggcagcactttgacttggacattttatttttttgcttctattccgctgttttttcttggtagatgaatgtcttgggcataggactaatttagttatacagatttttctttttaaataatttggttccacttttctcccttgaaatagaactgtctgttgaggggctgtgcttttttgtagagtggtaggagagggtcaaaggagaacagtttcaacatctgccccgtgcagcacacgcggggcagtcagcagcaaggcgctcagctcctgcccgtggaggcttcggttgaaggaatgcaggaatgccctgcctgtcagactcagtgcggcggacaggggcaggcgaggcactcagctcctgcccgtggaggcttcggtggaaggaatgccctgcacgtcagactcagtgcagcgacgcggggcaggcgaggcgctcagcttctgcccgtggaggcttcggtggaaggaatgccctgcacatyggactctgcagcagtgcgggtgtgggtagcttcttgggatgtcttctcctgatacttgatcagattggaaatatcaaggaacatctgtttagacttgaaagttcgtttagttccattcctttagcatatgtactaaagtgttaaacacctaagatattagatattggttatagagcaagaatgaaagtactggcgtccttgattttgaattatgamatatttaatacttaatagaaaatttcacttagggcatacagaagattcagaggttaatatagatgtacctgcaaacccaccacccagaggttatcccttcatcaaaggaaggagaatgctcgggatacagatgaagctcctgttgtcccctccccatttcagcctgctactttcctcctggtctttttcactctccctctagcttcccagagttgctcatgattttgaagatggcatatgtcttcccaagcatgtttctccacttctgtaacagacwtgttctgtacgtacgtaagcagcacctcactctgggcacctgtgcagcctgcttcacttgtgcagcactgtgcggttgtctgtgctggctcatttatctcagcggcttcgtggtggtccctgcatggccctgtggcttactgttgcccttcgcctctggttggcatatgtgtggcgtctggttcactaccactgtgttggagctgccacatcgctgtgtcacgctcctcaggcccgtgctggctctcctctagagcagactcagcagacactttctctccagggccagattgcaaacatttttgcctctatagctcatgcggccttttcacaaccactcacctctacccagatggtgcagaagcagccagagacagtatgtgcacacatgggcctgactgtgttccactaacacttgccttaaatacggcaggctgcattcrgcagacctgctccagaaaayacggcaggctgcattcggcagacctgctccagaaaacacggcaggctgcattcggcagacctgctccagaaaacacggcaggctgcattcggcagacctgctccagaaaacacggcaggctgcattcggcagacctgctccagaaaacacggcaggctgcattcggcagacctgctccagaaaacacggcaggctgcattcggcagacctgctccagaaaacacggcaggctgcattcggcagacctgctccagaaaacacggcaggctgcattcggcagacctgctccagaaaacacggcaggctgcattcggcagacctgctccagaaaacacggcaggctgcattcggcagacctgctccagaaaacacggcaggctgcattcggcagacctgctccagaaaacacggcaggctgcattcggcagacctgctccagaaaacacggcaggctgcattcggcagacctgctccagaaaacacggcaggctgcattcggcagacctgctccagaraayacggcaggctgyattyggcagacctgctccagagaacacggcaggctgcgtttggcagacctgcttcagaaaatacggcaggctgcattcngcagacctgctccagaaaacacagcaggctacattcgacaggctgaattcggcagacctgctccagaaaatacggcaggctgcattcggcaggcctgcttcagaaaatacggcaggctgcatttgacagacctgctccagaaaatacagcaaggctgcattcggcagacctgctccagatgcatacctagaagtggagtcgaagagtcggaaatcaagttcgttcttttttttttttttttccctgagtttcatctgagatttttttgagccrggattttttagctttaaaaaatatgtatggtcatttgatattcaaatttatagtactgaaattttctctacactgtgctttgttcattaaaacagctctcatgtttccttgcagaataaaagccgccctcattctaggggagaatataatgtttacagcacctttcaaagtcatgaaccggagtttgactatttgaaaagtctagaaattgaggaaaaaattaataaaattaggtggttaccacaacagaatgctgctcattttctactgtctacaaatggtaagaattgtgttctaagtggctgtttgatttagttttttatttttaattttctgtgtgtgtgtagattcctttttattttagaagttattcctgctttaaattttggggggagggtaagttatctagggtagcaagtgataggttgaaaattcaaagtatgcaacaaaaaccacacgtgcactttattatgctgttactctgcacgtctgcacatctttctttattgtacaaaacacctccaattggaaatattcatgttcagagaccccatagcttataacccaatataggaccacaccgctttctaataccagtactcaaacagtagtgatgcatgttatagtttttcttttcatatggagaatgaggtttttattttcagataaaactataaaattatggaaaataagtgaacgggataaaagagcagaaggttataacctgaaagacgaagatggaagacttcgagacccatttaggatcacggcgctacgggtayacgttgcctttgctttatccaatgctgttgagaagttaagaataaacgtttcagtctgctgtctggagagtgctgcgcggtggagtactgtgaggtctgctgtgaggtctgcctcgtgattcctgaaagtcgtttgcactcatgtgtgtgtttaaaagcaaggtctttctcctgttttcacaaaggcagaaagtcacatgtggtccttaggaaacacagcaatactaaggggaaaactcatatttaattctacagcagaaatctttgtggacatagcaaccacccttctctcagaaggttcagaacagcacctgggaggttggagttcagatgaaattcagaacacctcacaggtgcagtagcacaggttgcaggtcgaaagatgagctgtgggccacaggtacattcaggacgcttctcggggaatttctttggggttggtttaggcagatgctgatggttcagaactctccacctgtccatccatgagcatcattacttttttaattgttaaattatttgctccattgttggtagtatgaaatgatcatatttcatcaattctgatgcctaaattttttcatattttaacatttatgaaaccggctaaaactcaaaacctcaatgtcttataattggcctggtgctacgcaccactgatgttgtcttaaattagatggaacatggtgaagggtgtccggcaaactgggctcgagcccaggtgtgtcttggtgagaaaccagcacctgtgcagaggtgtgtcccctggaaggaaactctgcctggtcccaagggggtgccgttactagattggaaaaccgttggttgtttgggtggttgggtggtttggttgcggggggtgggtggttgagttgggtggtttggttggtttttaatgagatttcagccccttttacactattgtttatcaagtgaagactgagtgagtgagcccattccacattagtcttggagagtgctacagaggacgctgtaccgcagaagcctttccctaacacatgtgcctctgggagtgatgttgggtctgttctgatgccatttctccagctttgccgtgtggggtggctacacctggggttgtgcattcctcaggaggagtgtcctcagacttctcacatcgatgttgtcaccgtatttcctatgagttcatcaaagcgagaaaggctgtggcatttgctgaaaatctagtttatagggtcctaatttgaaccaagatgttttgatccaaaatgttggtgatgtctgatacacagtgctgccgcctttgcacccctgaattagtgtaaatcacttttagtgacagtaacacgagttgtgcagttccatcatcatgaaactgctgatcctaaagtagaagtgtgatgggacccccgagggtgggcacttgaccccctccagccttgtccatctcttctgcagccaacaccacctcccacccagttacctgtgcacaccccaccctcagaaacccctgttcctcctgatcagaccctgccacaacccatcagctcacgtgctcattttgggagaacagtaggcctttactaggcccagtcttggttttattcaaggctgcttttgtaggtttagcctaaataaaacgggtataattggtggccctactgaaggtgtgtgagaagtctagttatttcattagttggtgcatggggaagagaccacagacaggtaattctgtacattgacttaggtcggtatttgagatcttacctctctaacagttcagagtgggctatttatgtatctgagcctaactgggtaagagtcagacatgttgctgtttttaaatttttgctcttaaattattttagtgccagaaaagggatataattaaaagaagaaatcttggccaggtatggtggctcatacctgtaatcccagcactttgggagaccgagatgggaggatcacttgagcccaggagttcaaagaccagcctgggcaacatagccagaccccatctctaaaaatgaaagcaaattattttatatgcaaattaaaatgttttcaataaaagaaggaatctttgtaagtattgcagctatcatatgttttgattaatgggaaatttgttagaggattggggtaggtgtgtgtttttaagcctgaacttggtagaactgactcttcttgctctagagaatccaagggtgtggtcagcactacctgggttaaaatgagggaagcctccctacacacacttttccaagttggttttttacagaattcagccagacaagactcagttgagagcttttctttttcccctaagctttcaaggctctcccttttggtttctaattacaagaataacaaaaaatactatcattaattttttgttttgattttaaagcttatgtttttcttccagctggatgttagtgagacacaggcctttttccttttttcatgtgtgatgctattcctcacgcctgagctctcacctctgaccataggcggcctgcagccagcgcccactcctctctgtcctttctatttctgtgcgaattgggcttccctaggaagcctccctgaccacagcactcaacacagagatgggggcgggaggtaccttctactttttgttttaacctcaagtgaagtgtaatatataatacatacctccagataagacatctgccctataagtgaccagctccatgaatgtttgtagggtgcacatgcccatgtagccagccccagaccaagaaatggaatatcctcagctccccagcaccctgctgtgcaccctgccagtacctggagccagtggaggtttgtggggtttgcaccgagaagcatagtcctagtgcagtgagaagaggtgtgtgcatctagctgcaaggagaggacaaagggaggggtgcagctgagccacccaggaggactttgctgtccagcgcctcagtgtggccactggaggacacacaggagagggagccgcaggcctcggtgcctgggcagtttgttaccctgccagctgatcttctcttcagcaggaacatgtcgacctcggtaatggaagcaaggggaagacttggaatagacagtattccattttgtagcatattttcataactctgctaattggttatttgggggtattgcctgtacagaattattacttagccatgaatataaacttgtcctctttcgttatctactataagtgttctaattatgtgctgctgtgatctttgttttgaattcctatttccttccatttttaggtcccaatattgaagcccatggatcttatggtagaagcgagtccacggcgaatttttgcaaatgctcacacatatcatataaattccatttcagtaaatagtgatcatgaaacatatctttctgcagatgacctgagaattaatttatggcacttagaaatcacagatagaagctttagtatccttcctcagagggayactggcgtcttcccgagggtgctctttagatagtaatttctctcgtccctttatacacctgtatctcggagtctagtcttgtaaataccatcgctgcacagcagcctgtgatgtaagttctctgtgatttgaaatgtttgtccctaaaaatacaaatttctttctacctttgggaaaaagttatctgtataatgggaattacctgaagtccactgcctgcctggtttaatcagaggcagttttaaataggctacatttgaaaaaccaacattatgtgttcttttttttttttctaaatttgctaatgaataatagaaaatactggcttaggttagagcagtgtttaatcacccatctgagcagcagcttccagttagaacctgtgttcttctgtggctgtgcacagtctgggtggccccagccctcctcacatgggcccctttccagccagcagccgggagcatggggcttgcttcgtctgcagcctctccagggtccctgccgtcctccctctgctgtccagtggcttgagctggggttccatgtcgtatgttggttttcttagttgtttcagcttgaagggtgaaactgggnctgctagtctgaattggcccacagctgaattctgccctttcttatttttttcagttgaaggatttctgtataggatttctgttggatctgttctarctacacagaataagctcttcrtgtcaggaagagcagcatcttttggaatttggcggcattcttgtgttgtagttttgtgtggsagtgtgggattttgcacagatggtactagcttggttttcctatttatatgattaagtatgtactatcttgctattaagggctttctgtataacattaataatagcagcaagatgaaagcggtgttcgcttgtctgtgtctccccctgggccggggcgttgctgtagtctgagtgtgctcatcccaatccccttaccaggcgctcctttggaattcgggatgtgtaaccagccttcttaatagctaatcccttaaacctcactgcgtggattatttggcgtcctatttcgcgtgactgaatgtagactaattaacaaccagctgagctgagcactgtgccttaaccatgcactcccagacatcgtggacatcaagcctgctaacatggaggagctgaccgaagtcatcactgcagccgagttccacccgcaccagtgcaacgtgttcgtctacagcagtagcaaagggaccatccgcctgtgtgacatgcgctcctcggccctgtgcgacagacactccaagtgtaagtgcgtctgttgttgagatggagtctggctctgtcacccaggctgcggtgcagtgacacagtctcggctcacggcaagctccgcctcccgggttccagcaagtcttctgcctcggcctcccgagtagctgggaccacaggcaggtgccaccatgcccagctagtttttgtatttttagtacagacagggtttcaccatgttgaccagactggtctgacctcaggtgatccccctacctcggcctcccaaagtgctgggattacaggtgtgagtcaccgcacctggtcacgcctggcgtcttttaaagcatctcatttagagccacttgttcttcagacactccaaagacttagagagttcttcctgttccccaagtgcctttgcacaactggggagccctcctttgctggggccgtccgagtgtggctgtgtcagaggctgctgctaataagtggaactcgaggtcatgcttcccacaggcttatggctgtagggtgagtgtgcttttggcaccaccgagaagcggggtcacttctgcccagagcctgggtgtctcctcagaggctgccagcactgagtcccgccaagagccacccgttgcctctgcctctgtgcgtgagacctgggctgaggccgccagcacacaggaggccattcccagctgttggaatgagctcctgttcatgttgagcttggctggattggaagccacttcccttagctgaaagtctagcattttaatccagtgagctttcaagctccttttaggtgagggaggttctggttttgtttttatttttagccataaagaatgggcttgactttatagagcactgtagtcagcgtgtcccagtgtcctgaaacattgctgacccttcctccagtgccagcaggtagacacacgtccagtgacttcctctgatggggaagccgccagtcaatcccaccagactgagccgctgctcatgtgcagcggcgcccccagtgcctcggtggaatgtgcccacrgaccgtgtgcagcagccttttcgcctgttctctttcctgaggttgagtgtgtttttaagaattcgtatttctactagaattcctgcgatgaggatgagtgtttcgtagcatttggcctgtatcttaagcataaaattcttgagtaaataatttcagattccagttctatttgtcatcagagtgatttatttgagtaaatgcttggcgtcggcacagctggcttcaagttaatttcagatgctaagccgacaaacacaggctcctgcatcaagaaaaaagagaaaaaacctaaagcagcttcaggtcaaggaagcacaagccaggtgcagtggtgctcacctgtggtcccagctaccctggaggttgaggcgggaggatctttctgaaaataggaatccagttttgtcacagtagagcttgtgtatattcagtattggagacaaaccttggctggctggctttgaccggcgggaccgtcttggtggttaaaatcaggaccacagcgttgccagtcaaggtggtcactcctgcagacccacaaactgtcgaccctccaaaaagcaggcagtttgcttagaggcacagaccgctgtgtctgcatgaccatataatgctgtttgtgtcttcctgtgatgtgtatgcgatagaatttcacgtgctcgggcctggtgccatgaggacgcggagacactcctacaggaatgcggtggtgctgaacctgggcacacatcaggatgccccgaggagctcccacagatggcagtgcccaggaccttgcctagagattctcattcagggtccgggtgagacttgggcgtctacgcttctcatgcccatcccttgtccatagctggtgctagaatgtcttatccgaagctcttgcccacggaagtcacagaagatcagaaaacctagagaatcagaaagatcagaagacctagtgttgaggccaagcccttccagagtctctctgaaggggccacttcctacttgaacttgaaaatgatttgttctctgatttttaaacagaagctgaaaacattttattttgtttttcagtttttgaagagcctgaagatcccagcagtaggtccttcttctcagaaataatttcatccatatccgatgtaaaattcagtcatagkgggcggtacatgatgaccagagactacctgtcggtgaaggtgtgggacctcaacatggagagcaggccggtggagacccaccaggtccacgagtacctgcgcagcaagctctgctctctctatgagaacgactgcatctttgacaagtttgagtgttgctggaacrgttcggataggtaaggcctgcgtggagatgagctgtcgccccaagcttgctggtttccgagagtgcaaggtcagtgagggaggcgagctgtcctccagcgtcagaggaggacgctcatagggtgttgttttccagaccttttgattgatggatgatagtatcaaggtagagaaaataggatctctgagcaagtttctcacctagcttgtcattccatttatatttagacaagaagtatagcactaggtacaggccggctatgtgttaaatgcttagtgaatgatagtgtattactttttattatgctgataatgagtgaaaaggaaggaagtggggaagtgattcacctcactggaatgaccgcgttgcagtctgcctttccttctggagagaagtagatgaaaacaccccagagccactgcctgtcatgcccagacacagcgtggtcatggctggtctgaaacaccaatgtaatttataatgtgatggttctagtaccttgataatttattttgtatacattctttaaagatagctatgattagtgtggttgagagttacgttttttttattatgcaaaaagttacgtttcagatgatggaagattgtcttgcaccatttttatatagaatttttgttcagaattcaagagaacagaggagtctattggcaataagtgattgactggatattctgcaaaaccctctggcataaacacctagaaatgctggatatgatacagcaggtgtctcttcaggtgcatagttgagctcacagataagcaagggaaatctcacaacggccagaaactaagagggagctgaaaccagaatggcagcctctgaaggcgtctattccgagagcagccttgcagccccggctggcctcaggagcatcagcccatagcaggaaccactgcccctgtgaacagcaggttatggtgcaaagctgaagccttgtcccacacgaggtgacttgctcatggtggcttttcctgtatgtgcttggtaattttcaagagctgaagccttggcccacacgaggtgtagagttggaacagggacccctgaagatggtgtctccctccactggcagatagggtccaaagggcagtttgtctgtctgaggccttgcatgggggtggccagcactgccctgagaagtggaagcaaaacctcccctcacaagggtttgcagtttgggtttgtgccagctacatcatgatctgtaaaatctcacactgtggagctcctgcctccacgagggctgtgtgcgggcatcgggagggaccggcgtgtttccagatctggcttctactctgtttgcagactgacctgccagcctgtagcatctcacrgatgttgactgaagacatgaggttcccgggttctcatggcacagctggcagcatgagcctctcgttggcctgggttccccacgggtggacacttgaggccgtggctgatgcacactgagcttggagaaccccactgctttcacagcgggcagtaaacacacctgcactttgactagaagagacatgacctcattcctcaaggccgcttgctggaagcacagccctgagaagtggcccaggtggagagaatggcattggcaaactccgtgagaacacgcatgctgggtagctgctgccagcacacccaggtctctctggatttcgtcacattaaaatcatctaaacatgagctcacaggtgaaaattaccaagcacatacaggaaaagccaccgtgagcaagtcagcagaaccacagcagaactgaacctccgagaaggcagctgttgagatcctaagttaaagaagataaactaagaatgcttgagatattcacagactagaggaaggaaacagcctgaaccaggagccacatgaccgctaaacgtgacctggagactggaaaggaatcagagggaacatctagaaatgacaagtatgatacatgaccgccaaacatgacgtggagactggaaaggagtcagagaacatctagaaatgacaagtatgatacatgaccgccaaacatgacgtggagactggaaaggagtcagagaacatctagaaatgacaagtatgatacatgaccgccaaacatgacgtggagactggaaaggagtcagagaacatctagaaatgacaagtatgatacatgaccgccaaacatgacgtggagactggaaaggagtcagagaacatctagaaatgacaagtatgatacatgaccgccaaacatgacgtggagactggaaaggagtcagagaacatctagaaatgacaagtatgacagatgaaactgtgtgggtttagcagcaggtccattttggctaaacagatcttgtattagtggatggaaaggaaaaccagaagaaatgcgggctaaagagccaaacagaaaacaagagacactaggaaccgtggaggccagggtgaggcacagcacacgtttaaacaaagtttgggggtgtgaggcttaaagtgacagtggccagcaattttctctaaattatgaaagcctgaatacacaggatcgggagcacagcatccatccatctcataatgaaattgcaggacaccaaacgcaaagagaatatcttaaatgcacccaaggaaaaaacgcaaattacctctgagagcggacaccgagactgagactcggctttgccacggccacagtgggagccagaagccgtgtgacagatccagcaagtgtgactccttactctccaccgccagcttagaatcaagccttgaagtagatgctrgttcaagaatctgcttgtgataaaggcattttcaaatgggaaacaatgtatcacaacaggaaactcagtagagcgagctgtaaagggagcctggccctgcagaaaggggctgagacagataggcagaggaacgcagcctgcagggaagagcagtgcaaactctgaagctctgccacctggacggccttagttatctgtgtttgggggagaaaaattagagccctcaccagccccacacaataaataaataagctctgagtgtttctaagcctaagacatctttgtgagctctggaaacaagggcttctttaagaaggccccaaaagcccaaggaaaacattaagaaattcaactacattaaattttaaacttctttatattgaaattaaaagtgaaaacaaaatccacaaaaggataacgaacagagattaagtatcccagaataggtgcagaattagttgtcaacaagaaggtggcaaacaactcagaaaagagcaaaaaccatgaatggggtttcgcagaaatggaaaaataaatagaaatgctcatccttcttagtgatcagcaagtaaagccagagggacgtcctttcatgcccatcagaatgatgatgggtttgggggagagggtggagaccagtggtcttacccagtacccttcttgtgacctccttggtgacattcagtcgggttgggagcttcttgcatgttcagacaagaaaacgtgctcagatacctgaaatagcaaacaactggagacagcccacaggtgcatcattagaggaatggacaggtaagttgttctctatcataacatatactgaaaagcagtgagaatcaattattagaactacatggatcacctaggtggatctcacaaagataatccacaaagaaaattcaggaggaatgcgtacggtgcaatgacatacaacatgtttaagacatacaagacggttttgttttaagaatctgtaactattggccaggcgcagtggctcacacctgtaatcccagcactttgggaggctgaggagggcggatcacgaggtcaggagttcgagagcagcctgaccaacatagtgaaaccccatctctactagaaatacaaaaattagccggacatggtggtgcatgcctttaatcccaccactcaggaggctgaggcaggagaatcgcttgaaccttggaggtggaggttgcagtaagctgagattgtgccactgcactccagcctgggcgatagagtgagactctgtctcaaaaaaaaacaaaaaaaatctgtatacaaaatataaatgtgtgtggggatgacacatatgtactctagcaagtgaggaccccaactggggatgggataggagaccatctttctttccagagtggcaacacagtgcaggggggtccctgtcttagcagtgacttgctggtgtgcagaggggtcactctcttagcagtgacttgygggtgtgcagggggttcaccaccttaccagtgacttgcagggggtccctgtcttaacagtgacttgcgggtgtgcaggggggttygctgtcttagcagtgacttgcgggtgtgcgggggggttcactgtcttagcagtgacttgcgggtgtgcagggggtttcactgtcttagcagtgacttgcgggtgtgcgggggggttcactgtcttagcagtgacttggggggtccctgtcttagcagtgacttgcgggtgtgcgggggttcactgtcttagtgacttgcgggtgtgcggggggttcactgtcttagtgatttgcatgtgtggggggggttcactgtcttagtgacttgcgggtgtgcgggggttcactgtcttagtgacttgcgggtgtgcgggggttcactgtcttagcagtgacttgtgggtgtgcgggggttcactgtcttagtgacttggtgtgcgggggggttcactgtcttagtgacttgtgggtgtgcggggggttcactgtcttagtgacttgcgggtgtgcggggggttcactagtgacttgcgggtgtgcggggggttcactagtgacttgcgggtgtgcgggggggttcattgtcttagtgacttgcgggtgtgcggggggttcactgtcttagtgacttgcgggtgtgcggggggttcactgtcttagtgacttgcgggtgtgcgggggggttcacttagtgacttkcgggtgtgwgggggttcactgtcttagcagtgacttgcgggtgtgtgtgggaggttcactgtcttagcagtgacttgcgggggttccctgtcttagcagtgacttgcaggtttgcgggggttcactgtcttagtgacttgtgggtgtgcgggggttcactgtcttagtgacttgcgggtgtgcggggggtttcactgtcttagcagtgacttgcggttgtgtgtgggggggttcactgtcttagcagtgacttgcgggggggtccctgtcttagcagtgacttgcaggtatgcgggggttcactrtcttagtgacttgcaggtgtgcgggggttcactgtcttagtgacttccagttgtgcggggggttcacttagcagtgacttgcgggtgtgtggggggttcactgtcttagtgacttgcggggggtccctgtcttagcagtgacttgcaggtgtgcgggggttcactgtcttagtgacttgtgggtgtgcggggggttcacttagtgacttgcaggtgtgcagggggtttcactgtcttagcagtgacttgtggttgtgtgtgtgggggtcactgtcttagcagtgacttgcgggtatgcgggggttcattgtcttagtgacttgcgggtgtgcaggggttcactgtcttagtgacttccaagtgtgcggggggttcactgtcttagcagtgacttgcgggtgtgtgggggggtcactgtcttagtgacttgctggtgtgcgggggttcactgtcttagtgacttgcgagtgtgcggggggttcactgtcttagcagtgacttgcgggtacatggatagtcactgtattttttattcctcttgatatatttcaaatattgcaaaatacccttagattacatatccccaagaacatctaaaagcgttcccagtaacatttgcttagtccattcactctcamaaacacgcccgtcttcctacctggaaacttctgttgagggatgcgatgaaggggagtgaggcgtttcagtgctgcctcagcccratcctgattctccgtgtggcagcgccttcttgtgttctaggtcgccccacagaaccagttatgtgcttacgcctgtgtctctgtctgtgctgttcccttcctgggccagcaccaggctgctgggcagcgcccttgtttgcagtgtggaaacacccactctggggctggcactatctgtcgagaatttaaaagtgatcataaatctgtatgaaagctgatgtgcttttcgttattaccatgcaccagcaattccagtcagtgtcggccatacatcatctgtcgtctgtgttctgaataatggttactgttgagttttaataacataaatgtaagcttcagattcacacattcttattacttaccctttcgtaaacattgtgttttatgtggaaactaatttggggaacccccagtcaatggccctcacgtgccaacttggctgcatacccctgttccaagaccacgtgcacagcttggcattgctggagggcgctgggcacaccttgtgtctcccgcctctgtggcgctgtgggctcctggatggaagcaggagatgggaaataaacatggatcgctgaatgcagtttctcttctctgagttcgtctttttttttttttttcccctgctttgaagttttagacaaggtcagtcagacactaggtatttgccagcagccagggtcagtgctgggccatggaagggaagcggcccgcttctttctcatggcaccttgaagacgcgccagcgtgaaaggcctctcaccgcgcatgaccatgggggcaggacgtgagggcgcgggttagtgtcaaaataggaagaggaggcgagcttcaaggacggctggagaaaccagaagggcattgtttgaacacatctttcatcagaaactggactcatgaagccatgggtcaaatcatggcagcgtttgcatcattcagctatttttctgtcatttttgtagaaaatgtaagattgcagaggtttttaccagtattatgaagttatatcatgaggatgtgtgcggtagtagaatttttcgacagcagagacatttgaaagccattacagttgatcttgaagaaacaaaagcatggacggtattgtattgtctggaatgtgtgtgaaatgcagttgttctaaaattctgccacactttgcccagtggatttttactatttctatccgttgcctcatttgaaagaaactttttgaaattaatagaaaagcagtttaactccaaagaaacattgacagatatgactagtaactgttgaacatgataaggattatgttcaggtcattatggatcattgacaaattgcagaacataaggcttaaaaataaactgtgctgttattcatgagtgagataaataggtggggttgtttcaaaaaatacactaatgttaaaagtgtgactccattattttgtttctcctgtgacatggattcttactgacatgattatagataaagctcggtacacattttcactgcatttctcttctgcccattgtgattgatcattcctgatttctgaaagtaactgggttgtgggggagggtggcgtgcgctgtgcaccccaggggtggggtctgagtccttgctgccgctccccycactgaggagtgctgctgtctgctcttgttttgaacagcgccatcatgaccgggtcctataacaacttcttcaggatgtttgatagagacacgcggagggatgtgaccctggaggcctcgagagagagcagcaaaccgcgcgccagcctcaaaccccggaaggtgtgtacggggggtaagcggaggaaagacgagatcagtgtggacagtctggacttcaacaagaagatcctgcacacagcctggcaccccgtggacaatgtcattgccgtggctgccaccaataacttgtacatattccaggacaaaatcaactagagacgcgaacgtgasgaccaagtcttgtcttgcatagttaagccggacatttttctgtcagagaaaaggcatcattgtccgctccattaagaacagtgacgcacctgctacttcccttcacagacacaggagaaagccgcctccgctggaggcccggtgtggttccgcctcggcgaggcgcgagacaggcgctgctgctcacgtggagacgctctcgaagcagagttgacggacactgctcccaaaaggtcattactcagaataaatgtatttatttcagtccgagccttcctttccaatttatagaccaaaaaattaacatccaagagaaaagttattgtcagataccgctctttctccaactttccctctttctctgcsatcacacttgggccttcactgcagcgtggtgtggccaccgtccgtgtcctctcggccttcctccgagtccaggtggactctgtggatgtgtggatgtggcccgagcaggctcaggcggccccactcacccacagcatccgccgccaccccttcgggtgtgagcgctcaataaaaacaacacactataaagtgtttttaaatccaaacagaagtattgtctttttatttaattttattgcatagaatgaagttatgcagggttcttctttggaactaactgtttgagaaatgtgtgtccttctttggcagcgtgggggtatgtgtgcagcatttctgtccccaagctgctgcccgctgtgtttctgtagaagtagcccatcggatacaccaggtaaggtctgggaaaagccagaaccgaggccacctctgagaaagaaaattgcaaggaagaaccaaaattgctgccatccagtaagcctggtttaaagtagcttcaaattcactacagttgaagaaatacgtgcttgctttctaaggcttttgaaaaagcactttggggaaagtatactttttaaacattgctaaaattacatgcatgctaaatttcatcctgcatttcaagccagcaaaattaagcaattttaattacacgatgccaccagtacgttggtttattttcaaagtaggatctttgataccagaaatcaagattttccaagacaaataatacagagctgtaccaatgctgagtgaccagagcttgcttccgtgggatttaacacacgcccactacgtgtccccgaggggagtggggagtcgggctcccgtgcccctgtggagatggaggtgtgtgctgatcccccgtccgcctgtggagatgaaggtgtgtgttgattcctcctgctgctgtggagatggaggtgtgtgctgatcgcccgtcaccctgtctagatgaaggtatgtgctgattgcctgtgcccctgtggagaaggaggtgtgtgctgatcccctgtgccctgtggagatggaggtgtgtgctgctccctcgtgcccctgtggagatggaggtgtgtgctgatcccccatcccatccccctgtctagatgaaggtgtgtgctgattcctcatgcccctgtctggatgaaggtgtgtgctgatcccccgtccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgtgctgatcccccgtgcccctgtgtagatgaaggtgcgtgctgatcccccatctccctgtggagatgaaggtgtgtgctgatccccatccccctgtggagatgaagggatatgctgatcccctgtcccactgtggagatgaaggggtgtgctgatcccccgtccccctgtggagatgaaggtgtgtgctgatcccccatctccctgtggagatgaaggggtgtgccaatcccccgcgcccctgtggagatggaggcgtgtgctgatccccatccccctgtggagatgaaggtgtgtgctgatcccccatccccatgtggagatgaaggggtgtgttgatcccctgtccccctgtggagatggtgtgtgctgatccccrtccccctgtggagatgaaggtgtgtgctgatcccccatctccctgtgaagatgaaggggtgtgctgatcccccgtgcccctgtggacatggaggcgtgtgctgatcccccgtccccctgtggagatgaaggtgtgtgctgatcccccatccccatgtggagatgaaggggtgtgttgatcccccgtccccctgtggagatgaaggtgtgtgctgatccccgtccccctgtggagatgaaggggtgtgctgatcccccatgccctgtggagatggaggtgtgtgctgatccctcgtgcccctgtggagatagaggtgtgtactgatcccctgttcccctatctagatgaaggtgtgtactgctgatcccccgtccccctgtggagatgaaggtgtgtgctgatcccccatccccctgtggagatgaaggggtgtgctgatcccccgtcttcctgtggagatgaaggtgtgtgctgattcctcatgcccctgtggagatggaggtgtgtgctgatcccccatccccctgtggggatgaaggtgtgtgctgatcccccatccccctgtggagatgaaggggtatgctgatcccccgtccccctgtggagatgaaggtgtgtgctgatcccccatccccctgtggagatgaaggggtatgctgatcccctgtccccctgtggggatgaaggtgtgtgctgatctcttgtccccctgtggagatggaggtgtgtgctgatcccccatccccctgtggagatgaagatgtgtgctgatcccccgtcctcctgtggagatgaaggtgtgtgctgcttcctcgtgcccctgtggagatggaggtgtgtgctggtcccccgtccccctgtggagatggaggtgtgtgctgatcccccgtccccctgtggagatggaggtgtgtgctgatcccccatccccctgtggagatgaaggcgtgtgctgatccgccatcccactgtggagatgaaggcgtgtgctgatcccccatccccctgtggagataaaggtgtgtgctgatcccccatccccctgtggagatgaaggcgtgtgctgatccgccatcccactgtggagatgaaggcgtgtgctgatcccccatccccctgtggagatgaaggcgtgtgctgatcccccatccccctgtggagatgaaggtgtgtgctgatcccccatccccctgtggagatgaaggtgtgtgctgatcccccgtccccctgtggagatgaaggtgtgtgctgatcccccgtccccctgtggagatgaaggcgtgtgctgatccgccgtccccctgtggagatgaaggcgtgtgctgatccgccatccccctgtggagatgaaggcgtgtgctcatcccccatccccctgtggagatgaaggcgtgtgctgatccgccatcccactgtggagatgaaggtgtgtgctgatcccccatccccctgtggagatgaaggcgtgtgctgatccccggtccccctgtggagatgaaggtgtgtgctgatcccccatccccctgtggagatgaaggtgtgtgctgattactaatccacatgggcaagaacaggatgtccgtcattaccctgaatcaatgctaacacagtgccacttgagttcacattaagttagaaattgagaatctaaaggtacctttattttaactaaaaaataatttatatactgtatattgattgtgacacaatttacaaagtctgaggtgtggaacagttatttaagcattagtcaaccctggtccttaagacagttctagtaaaatgggattgtatatatttgttcaactattttgaccaaaaagttcaataaattttaaatgtttaactggattttcactgcgtatttggacacccttttccatcttcctctagaatgtatttcccactaaatagcccacctcctccacccccagggcagagcagaaggtgcagcccaggcgggtcccgtgtgtagaggttccacgtggcactgctgctcccgtggaactgccactgccttgaggtctgcggcgcacgttccctggaggtgtcgtcacctagctctggggcgcctgcgggggaagccacctggccagcagtcctgtccgtttctgtgggttctccccagtgcagtcttgatgttctgagaggcgctggcaattccacgcacctatgtccgcaaaaagcaggatccattcactttagagaagtgccctcaacaggcgcggaggaagacgtgccctcaacaggtgcggagaaaacttctctttcctgcttaaagtagaacagtgtcatcagcttctgaaggttaatgctgagcacagttttcattgatgaggattctgggcccgtggttcaggtggaggtttgctgctctctgggctgatgacccggattccatgaacacactttcttcgtaagtggatttaacgtgccttttttgaaagaaaaatggagctcctatgaaccagtttatgatgccctcgtggacagactcagtctgattttggaggccacacgactggcaggtgtggctggagactgcagcatgtgcgtgtctgtctgtcctgtgtggagccaaatcatcaccatcagtgccagaagcctcccaaagcccagtgccatgggattggtgtgtgtcctgctcccggccggaagaagctggccctggatccgcctggcccggctgctctgcatcacccctttgcttgcttgggaggaagagtgggtctggggctgcggaggctctccgggtggccttaagcttgctttctcctaaacctgtgctgtgcgtccttggccagcggctttggcatcagccagggagtgggggagtgaggtcagagccagcaggagtccgggctgtgctgggtagcagaggtcgcatcttcccagagctgcaggcaaagggacaggatgggcttgctgtatgagggcgtggctctgctcgtcctgggctgggccaggggtgctgagtggggctgtagccgcatcttctgtggcgagctgtcctgtcgttgctgtgctgggatcgccaagggagagggacggaagctgtccgtgagctggtgagacagcaagccaggaatccagccacaggtggggagacaatgcagctcaaactggtggagctgcaagggcccacagaccaccttcagacgctgcccgcggccgacgcttccccaacccctgggagaggcctgggcctgggggcctggcgggccccgcgctcttcccttgggtcccgtcctccgagggggctgcctgccaaagccaagttcagcagtccccgacagtgggcttctctgcacaggtggtgtgcaggggtgggtggagtgtagaccagatgtgagtaaaggcagcacccccagccccacagggctgtcacagctcaggccctgcagagctgtggggtttggctgctgtgggtggcaacccctcctaagtgcctgctgcaggtgggcgctgggccagggctttccctacagccaccctggccatgggtcacagacgcacacaccacagcacccggctgggcactggggtgatactgggcttggctttgagctccgtgcctctgtgccccatacgcccctcagatctctggtgacagtgcggggctgcctacaggacacccagggctccttgatcttttaggaactgcggcacccccgaagctgtgacaggtgcagaggcgctgccgtcctgagccgggcctcaccttccgccttgtgtgctctggcaccagcacccagtcccaagggcacagcggctgcgacttgcctctggccagggcaggtggtggtgtcatacccaggacgggaacccacacttgatgtcctccagggtttttttttttttacattatcttaaggactgacagtctcctaccccatctgctcccatctgtccctaatttcatgcgcctccgcctgagttcctgcacgcatttcctgaataaacacacccctgtgccagtcagaacccgcgggggttttggaagtgagagcccagcaaggcagctggccagggggcggcactgccctccggggagcaccggtgcccgggactctgcttctgaggctggcctgtacgatgattttgtataaatatctccaatcagaacctttttagtgtatttcttaatataacagaaactggtgtcttaaaatacaagactagctgcccggtgatgacaccaaatcgagcagcggggctcgcagtggccaggatccccgacagtggaatgctgaggttagaactgaaaccgcgtttcgtgaagtcatcatcacgcacgggaaacaggtttggggtgaggggcggtccagtcctaagaaagctctccagctccacgcggtcaccttcactcactcaccagatgcagattgcaaagaggcgaaacctgtgatttctttaataatcacagtctccatctggtgagtggttaaagtcacgttccgt

SEQ ID NO: 10693 - DNA, 14090 bp, Homo sapiens
  misc_feature (1)...(14090): n = A,T,C or G, or insertion/deletion polymorphism (see Tables 1-2)
gcaacatccatgaatcaggaagcagcccttaccatacatggactcttcccaggccttgatctttgactttccagcctccagaattgtgagaaatagatttctgttgtttgcaagccacatagtctatggtattcttttataactgcccagattgactaagacagatgatgatgaaaatactaccaagtattggaaattaacatcaaaattctaaatgacaatttattcaaagaggaaatctagagaaattagaaagtcttctgtattctgaaggataatgaaacatacatatcaaatgtatgggatgcagctgaagtagtactagagaaaaaaccaatacccttaaatgcctatattaagaaagaaggtaggtctcaaattagtaaattagcttctgctataagaaacaaagaaaaacaaattaaaccaaagcatggagaaggaagaaaataataattaaatggaaaaaatgaagcagaaagacagagaaaattaatgaacccaaatattggttctacggggaaaaatcagtacactttataaatttctagctagactgatcaagacaaaaagatgcacattaacaatgtcaagaaaaaacgaacatcagtgcacactctctagatctcaaaaagaaatattgataatctcatgtcaataagtttgacaagcaaatgaaatgaacaatttccttgagagagaaaacttatgaaaactgacctgagaagagatagaaaatgtggccagtcatatattgattgtagaaattgaatgtgtaatcaaaatccttctcatataggaaactccaggtccagaaggcttcattgatgaaatgtatctaacaaataatttggaaataacatcaattttacacataccttttagaaattaaaggaggcaacaactttcaatttaatctatgcagccagctttcacagtcaggcgtgagtatctggcttttccaggtgcacagtgcaagctgttggtcaatctaccattctgagatttggagcaccgtggccctcttctcacagctccactgggcagtgccctaataggaactctgtgtgggggctccagccccctatttcccctccacactgccctagcagaggttctccgtgagggccctgcccctgcagcaaacttttgcctgggcatcttagcatttccatacatcttctgaaatctaggtggaggttcccaaacctccattcttgacttctgtgcacctgcaggctcaaaaccatgtggaagctgtcaaggcttaaagcttgcaccctctggagccatgggccaagctgtaccaagcttggccccttttagcagccgtgggagcagttgggacccagggcaccaagtccctaagctgcacacagcatgggaaccctgggcctggaccaggagaccattttttcctcctgtgcttctgggtctgtgatgggaggggctgccatgaagacctatggcatgccctggagacattttccccattgtcttgggggatcaacatttggctctttgttacttacgcaaatttctgcagccagcttgagtttctcctcaaaaaaattggtttttctttctattgcatcgtcaggctgtaaattttctgaacttttatcctctgtttcccttttaaaatggaatgcttttaacagcacccaagtcacattttaaatgctttgctgcttagaaattttatctgccagataccctaaatcatctctctcaagttcagagtgccacagatctctagggcaggggcaaaatgccaccagtctctttgctaaaacgtaacaagagtcacctttgctccagttcccaacaagttcctcatctccatctgagaccacctcagcctggaccttattgttcatatcaccatcagcatttttgtcaaaggcattcaacaagtctttaggaggttccaaactttcccacatttttctgtcttgttctgagccctccaaactgttccaacctctgcctaatacccagttccaaagtcaattccacattttcgggtgtcttttcagtagcacccactctactggtactaatttactgtattagtgcgttttcatgctgctcataaagaaatacccaagactgagatgaaaaagaggtttaactggacttagaattccacatggttggggaggcctcagaatcatggcgggaggtgaaaggcacttcttacatggcggtaacaagagaaaatgaggaagatgcaaaagcagaaacccctgataaaaccatcagatctcatgagacttattcactaccacgagaacagtatgggggaaaccaaccccatgattcaaattatctcccactgggtcccctgggtccctcccacaacacatgggaattatgggagtacaattcaagataatatttgggtggggacatagagccaaaccatatcaccagcattacccaaataaaaatcccagacaagaacatcacaagaaaaagaatcaagaacaaatattcctcttgaacacagactcacaattcaatacaaaacgttatccaattaagatatacataaaatgaataatatgccatgccatattggtttttttaaagggaaagtaaggttggtttaacatctgaaaattaaacaatacaattcacccaattaatagaacaaagaacaaatgttgcacaattattatagtcaatgcagaaaaagcacttgcaaaatcaagaccatttcatgacaaaatagctcagcaaacaaaatcgaaaggaatatcttcaatgtggttaaggacacccacgaaaagtttacagctaccctcatattcaattatgaaaggccagatgcttacttcctaagattagcaacaaagcaaagatgtggctctcctcatttttgtttaaaacaccttacgagcatcctaactagtgcaatatggcaagaaaatgaaataaaagaccaataaaagggccaagtgtggtgcctcatgcctgtaatctcagcactttgggaggccaaggtgggaggatcactttagttcaagagtttgagactagcttgagcaacatagttagacccctgtctttactaaatataaataatttttaaaagaaaaaaaacaatagataggaaaggaagaaataaaatctttctttctcagcttaattacatatgtagaaaacaataaggaattctgaaaaagtctctggaagtaataattaaatttgcaaaattgttcacaaaagatatgtaataagtctcttagacaaacatgacaagatagcaacaatactagtcatcaaagaagtgcaagttaaaaccacaatgagaaaccatcacacatcacctagaataagtaaagttcaaaagacatatgataattctaaatactggtatgaatatggaaaaaataaaaatctcttatattgttggtaggaacgcaaaaaaaagttgcagtcagtttgtaaaataatatggcaatttcttaaacagctacccatccatttaccatatcacccaacaattccacaaatatttatttatccaaaggaaatgaaaatttaaggccatgcaaagacttgtagtcagttatttatagtggtttcattaattacagaccctaaccggaaataacccacgtttatcagctggagaatagagaaaccaacgaataaactggaattccaacaatactcagcagctactcagtgacaaaaatgaatgaaatattattactcttaactacatggaaaaatctcaaatattgttatgacaagtgagagaccaaaggactacataacatatgattgcatgtccatgaaattctagaaatttcattattacagtaacagaaagcacagcagtggttgagtgaagagaagggggtgagggtgggaggcaaggattaaatagaaaaggggcataaggaaagtttttagggaaaagaaactgtcctctatctgggcaatgtggtagttacatgactataaataattaccaatattcataaaacattgtagctaaaactggtgagttttattatacacaaacgccccaattaggaaaaaaaaaggtgggggaagaaggcaaaaatgaagacacttttacataatccaaatcagaaaattcatttcctagggatcttgtactacgtataattttgaaggaagttcttcaggctgaagggaaatgatactagatggtgacctagatatatagaaagggataattaacaacagaaattatgcacatacacagatcacatacacactcattttcttaatgacaatatgaatgcttaaaacaaaaagtattactgtattattgagtttataaagtatattgatgtaatatatacaacaagaatagcacaatggtaggttacatgaaactacactcttacaagtgtcctttattttgctggatgcagcttaatattacctgaacttcaccatgaaaagtcaaggaatcgggtttcaattcttacaacaataaaaaattagtgtaaagaaatatacctaaaagccactagaattaaaaccataaactaaaaaatgtttacttaacacataagaaagtaggaaaggaggaatagaaacaaaaagatacgagacaaattgaaaacatacagcaaaatggtagaccaaaacccaaccattgtaagtgaagaaatgacacgacctgagtcacattagcagaactgctgagcactgtggggagaacagacatgggcaggaagtgagggacagtgttagtgccacaattcaggggtgagagggtggcagggactaaggggaggggagggtgtgagggatgagaggggcagagagaagggctggagagacaggaagtgaggaaaaggagcaagggaaaggactctaaagcagtggaggagcctagcagggggttcttgacatgcattcggtatttaatacattttgtgggactgccaaaaactaatggcctcctcatgattaaaaacataagagtaaaaaaataccaagtatgcaaataaaatgtgcacactgcttagatgtgcataattcataaaaacaagcagtgcttaagcattgatgataggcattttgacttcagtgcaattttgaggctccttgttacaatatacagtaacaaatcctgcttctttgtattgagatgtcctggactcacacagggaaactcgggctatggaatgaagataattttaaatgcaacaacccagagtcatggatccacagtctgggaaagtaaacttagaagctttgtgactcgaattgcaatgctgtttggatacacttatatatgaagcaggcaaaatcaggtcttttacagattagaatcctgatcattcaggggttagattgtgctaaccactgtattaataaacaaacaaacaaaaaaacctggtcactatgagaatctctatcttgtgccttcagccacaacttcaccaggtttaaagagaaaacccctttctctacaccgccattcccaaggcgagctcactctctggcatcaaagttccctggggtgagttttcttctaggatagtccaaggggagaggtaaggagtcggaagtccagttcagggacgaggattccaggatgagcgtgaatgggaaggggctgggcccagcctgggggttctctccctagtttccacagacagatccttgaccaggactcaggcagtcagtgtgacaaagaggctggcgtaggaaaagagaggtcaggacaaagtcccaggccccaggcgtggctctctgggtctcaggccccaagagcgatgactgcactggggagtcacagggttggggattgcccactcccctgagttttggttctcccaaccttcttcctggatacttgtgacataatcccacttctcactcccattgggtgccgggtttttagagaagccaatcagcttcgccgcgatcccggcactaagatcccggcactacagtcccggcgcaaccacccgcactcagattctccccaaacgccaaggatgggggtcatggctccccgaaccctcctcctgctgctcttgggggccctggccctgaccgagacctgggccggtgagtgcggggtcgggagggaaagggcctctgcggggagaagcgagtggcccgcccggcccggggagccgcgccgggaggagggtcgggcgggtctcagcctctcctcgcctccaggctcccactccttgaggtatttcagcaccgcagtgtcccagcccggccgcggggagccccggttcatcgccgtgggctacgtggacgacacagagttcgtgcggttcgacagcgactccgtgagtccgaggatggagcggcgggcgccgtgggtggagcaggaggggctggagtattgggaccaggagacacggaacgccaagggccacgcgcagatttaccgagtgaacctgcggaccctgctccgctattacaaccagagcgaggccggtgagtgaccctggcccggggcgcaggtcacgatccctccccatcccccacggacagcccaggtcccgggtctgagtctccggtctgagatccaccccgaggctgcgggacctgcccagaccctcgaccagggaagaaactcgggcgcctttacccggtttaatttcagtttaggccaaaatccccgcgggttggtcggggcgggagcggggctcggtgttcggggctgacggcgggggcgaggccatggttctcacaccatccagaggaagcatgrctgcgacgtgggcccgacaggcgcctcctccgcaggtatgaacagttcgcctacgatggcaaggattacatcgccctgaacgaggacctgcnctcctggaccgccgcgaacacagcggctcagatctcccagcacaagtgggaagcggacaaatactcagagcaggtcagggcctacctgagggcaagtgcatggagtggctccgcagacacctggagaacgggaaggagacgctgcagcrcgcgggtaccaggggccacgggggcgcctccctcatytcctgtagatttcccgggctggcctcccaccaggagagtaggaaaatgggaccaatgctagaatatcgccctcccactggtcctgaatgggaagaatcctgggtttccagatcctgtaccagagagtaactctgagagcccaccctgctctctgggacaattaagggatgaagtccctgaggaaatggaggagaagacagtccctggaatactgatccgtggtcccctttgacccctgcagcagcctggggcaccaggaattttcctctcaggccttgttctctccctcacactcagtgtgtccgtggctccgattccagctcttctgagtgccttggcctccactcaggtcaggaccagaagtccctgctcccccatcagagactcgaactttccaaggaataggagattatcccagattcctgtgtccaggctggtgtctgggttctgtgctcccttccccatcccaggtgtcctgtccattctcaggatggtcacatgtatgctgctggagtgtcctatgaggaatgcaaagtgcctgaattttctgactcttcccctcagatcccccaaaggcacatgtgacccagcaccccatctctgaccatgaggccaccctgaggtgctgggccctgggcctctaccctgcggagatcacactgacctggcagcaggatggggaggaccagacccaggacacggagcttgtggagaccaggcctgcaggggacggaaccttccagaagtgggtggctgtagtggtgccttccggagaggagcagagatacatgtgccatgtgcagcatgaggggctgccagagcccctcaccctgagatggggtaaggaggggtgtaagttgtctkrtctcagggaaagcaggagaccttcygcagggcagggctgaggcctgggggtcagaacccctcacctccctctcctttcccagagccgtcttctcagcccaccatccccatcgtgggcatcgttgctggcctgtttctccttggagctgtggtcactggagctgtggttgctgctgrgatgtygaggaagaaaagctcaggtagggaaggggtgagaggtggggtctgggttttcttgttccactgtgggtttcaagccacaggtagaattgtgacttgcttcatcactgggaagcaccgtcgacacacaggccgacctagcctggggccctgtgtgccaacacttgctcttttgtgaagcacatgtgaaaacgaaggacaaatttatcaccttgatgattgtggtgatggggacctcccagcagtcacaggtcacaagggaagatccctactgaggacagacctcaggagggcagttggtccagtcaccacacctgctttcctcatgtttcctgatcctgccctgggtctgcagtcacagttctggaaattttcctggggtccaggatttgctgtttccttaaggacctcatgccccatgtcctccctgacctctcacaggttgtttttttctcacagatagaacaaggaggagctatgctcgggctgcctgttagtatgggggattagagggctgctccctgagatcgttgggacagtgtagacaagattcctcctttagccacatctcctgtgggctctgaccagttcctatttttgttctaccccaggcagcaattgtgctcagtactctgatgcatctcatgatacttgtaaaggtgagacatgggggggcctgaagtgggtgggggtgaggcagaggggacatgattctgttgaggggttctctggatttagacatcttgaccatgtggtaggctgttcagagtgtcaccaggtacagtgactgccctggatttgtttatgattattttctcctgtagcttgagacaactgccttgagtgggactgagagatacaaaatttcttcaggtccttcctctgacacacaccattgtaatttcaagagctcctgacttctatatctgcacttgacacgtgaatatatctatgtgtctgtgttccagttagcataatgtgaggaaatgggctactggtccaccactgccaccaggaccaccaccccacactaacctgtcctctcttccccggtcaagttttttttcaacagaggtgaggctgggacatttctattcatgtcttaacttttaagtttcactgagctgccacttactccactattcaaaataagaacctggatatgaatttttcaaattcttgccatgaggttgggttgattgttcaatgaaaggagagcaagactcttaaaacttgagagaggaagtaaaacctgagagccttccagaatccatttttgctgtgctgggcctgttgtaggtggagacaggagagagagggctgtgaggagctgagtgtggacagcctatgctcagttcatcatggaatttgacgtggtcattcattgggttggtcatcttcactgctccattgtttgtgtcccttcagtagaaccttgtttcaccaggacctgtgatcacaggcacacaaacattgcctgggccttgtcctgtctctaggaccgtggacagcaagggcttcatgggctgggtcagtctatggtctggccctaatattttgtatcattatttttggtttctttgtttctgtagaggactatgcctgttcctgttctggtgtctgcgttctgatctctttctcccctgggtgtccctcatctctgacagcagcaggagtcatttttcctgtcattaaccccacaaggtggaaggcagcccctgcacacagaagtctgtggtattaagagatgaattttcaagcccgtgcagcttttaccctatttccagggctctttcttggattgtattttctatcttttccccaacctttttaaaggaactagattctgaaattagcagagaagagggatgccacaagttctcatcttaggtaactttctagtggaactcctcttctgctcagctctcctacccactctcccttccctgagttgtagtaatcctagcactggctctaatgcaaactcatggatctataaagcaaagtctaacttagatttatatttgtttggaaattgggattcatagtcaaagattgttctttcctaagagggaaatataattgcatgctgcagtgtgcagagggttggtgtgaaggagggatgcagggaggaagggagggaggacacacaagcagcactgctgggaaaagcacaggcggcctggatgtcagtgtgaggggaccttgtgctgtcgttgctgcaaaaccgcatttggcctgaggctatgttaataaagatactgcctttagaataggaggtgctctacagtgatgattcattcagccgacatttgctgtctgccagacatatgacagaatgtttttgcatctggggaaagtcattgaagtaaaatcagaaaaatctctagccttgtggagcatgtgttccagtgggaagaggcagacggtacatacactctaatatatgcagagtaaatgaggaaagtgttagaaggtgataagtgctgtggaacaggtgatcagagtatgggttgtgggacagagaaggtagctattgtgccggggttgtcagcgtgggccttgttgggaaggtgacctttgatgaaatatttgaaggacataaaggaatttgtcatgagggtatctggaagaagttttttctagggagtaggaaccttcagtgtcagtgtaccagggcaggatcatgtctgtgtgttctgggaagaacacgggatcgggtatggctagagcagagagtcactgagataaggtcaggggtttggtcagatcatgtgggcatagggctcaagtatgtgggaaggattttgattttgaatgagatagttttaagcagaataaagacatgccacaacttctcttttaaaaggatcactgtagctgctctgctgagaacagaatccaaaggccggcgatgagcaaggcaggtgggaaaactgtaggaaatgagtgcagtatttcaggctggagatgtcggttacttcaactggggtgtgagcagtggaaatagtgggacgtgattggattcctactatttccaatcactttataccgcattttctaatggactaaatctggggtatgagaaagaagagtaaaggataccaaaaatgtcagactgtgactaaaaagagttgccatcagctgagaatgagaagactagcaggagcatatgagaggaggggacgtcgcaggcagtcactatgggagacgtgggatctgagatgccgctgagaaataccagtgaggtagtcgggttggcagttggacagatgaatctggagacatttaggagaaatagacttgggaggtgatgtcatataacagttatttaaagccttgagtctgaatgacgtctccaagggagtgattggctgtagaagagaacaggaacaaggactgaacactaggcctctgttgctaaaggatctgatcagacaacacacctagatcagactgcacagtcctgaccccacatctagaaggtacatagaccagggagttctagactttcctgtggacaggaatcacctggacatcaccttaagtctaagctgatctggaatcgagaatgagatttcctacttatataatgttgctgttggcgctgatgctgctggtcttcagatcccacttttggtagcaagaacacagaccaggattcctaggctatgcatcagcctcgcctgtgaggcttgttaataagcaattcctgcactccatgcgcaacattctgacacaggggcatctgtggagaggcctgagtattctacaacaagcccacagcaaacctggtgctcagccagatttgatatcactgagatcagtagttggagaatgcccaggatggggaggggtctcagacccacatttaagtgttgctttattctgggttttttatttatttatttatttatttttaaggaggatgtgtttctttaattataagacaggatgctgagagataaatgtcattttctctatcatggggtatagccagatggaagattgagaagtggctcacagctcagcagaatgaaaaaatatctgaatgctgctttctgaaactactctccagaatgatttcacactcactccttggagcaaacaatgacttgcaaatttttctaatttaaacataaaggagtgtacatattggtattagtattcattttattttggggaagggcactgtattagtccatagtccgttttcacactgccgataaagacatacccaacattgggaagaaaaagaggtttaattggacttacagttccatttggctggggaggcctcagaatcatggtgggaggcgaaaggcacttcttacatggtggtggcaagagaaaatgaggaagaagcaaatgccaaaacccctgataaacacattggatctcaggagacttattcattatcatgagaatagcatgggaaagactggcccccatgattcaattacctccccctgggtccctcccacaacatgtgggaattctgggagatacaattcaagttgagatttgggtggggacacagccaaaccacattggacacagaaccaggtttgaagctacacagccaggaacataatccacagccaccctaattcagatctctcataggaaccactgtccctgctcctgagcacagatgctactgcatatacctctgataccctgatggccgacactgggccctgtggcaaagactgctatcactgctgctcctgagaactgctccactactgctcctcagccatctttaccaaaatgcagtatttactgtcccagcctctctgtgtcatctcatcctgattagaagcccacatgtggttatctaaattgtgcagccaaagcctcttgcagtgtttaactgcaataatgttggggaaagtgaatttttctcctttgtagaaggaggtagtccctgccttctaataagactcttcaacataggaagagaattcagttgctggaggtagaggggtgagggatggaaaaagaatgacaaatttcaattcctagaatcatgttctgagactagaactttatctagtacattgcaggcacctgggtttggttgagtgtataataaatgacatagttcaacttattcccttgacagtttgttttggggtccagcttttgtctaccccagttttcacacacagatacgtggagaagcattgtgtgatggtaaaatgtttacttgaaagcctttttccctatctttgtctcttgctaggattaaaaacccgtatctgtaagacatcagaggatccatgtatacactgacattttatataaatttttaatattttgttctatctgcacatgctcctagggagagttatctatacattcaccagttttaatgtgactgctcacagaagcctaaaaaaccatcctaatttagatgccattttactcaaactattgtatgaacagctgataaccatactgtttttagaagacccagtgacatggtataaatgctcatcttttgcttgactgttactagtctgggatgagataaagtagaggtttacttgcatagttcactcacaatttctatatgtatagtattgtgggctgctaacaaacagtccacagaccagtgctagcccacagactgcactttgagagtagcattggtctagatgtacttgtattccagcatctacctcggtgtcagattaatggcaggaattaatcagtagcgaatggggattccatttccggtaatagggtgaactaggttttaaagctgcctcttctaccaaaaacaactaaaaaagagatgaaatgtgaaaatcacccaaaagtatagaaatataaaaaagggaataatctttttggtcaaaatataaatgtgggcaggatttagaaaaagggaagttgcttttatcttgagggcgtttgccaaatctggaaaaatcttagctttggttttctcagcttcatatggtatagtgcaaaggaggtaattctcagaacttgtttgtatagggagtataagaggagacacy

SEQ ID NO: 10694 - DNA, 40911 bp, Homo sapiens
cgtttttccctgcaatgactctccagtgccctctactgacaaagcttcagggccagatggcaaagaaaacataattaaaagattcaggatcatttttggagctgagaggcagtaaatccataactcacaaactggggaatggagggatcaggctgacaatacctgaatcttccatcaaatctaccatcactaatagtgggatgagatcatatacctctaaatgtgataccataggtacacagcactgcttttgaagtattctccttaaaaaattgaacccagccgggagcggtggcttacgcctgcaatcccagcactttgggaggccgaaacgggcgagtcacctgaggtcaggagtttgagaccagcctggtccaacattgtgaaaccccgtttctactaaaaatacaaaaattagcctggcatagcggcgggcacctgtaatcttagctactcaggagactgaggcaggagaatcacttgaacccaggaggcagaggttgcagtgacccgagatcgtgccactgcactccagcctggatgacagcgagactccatctcaaaaacaaacaaacaaaaaccccaaatctgataaagccttttaagtaaataaaaataaaagctaaggaatgattatcacagaaatgcagagtgatgcttacctctatagcagagagagacggactagtagtatctgggttagggacatatggtgaaagatattgaaaatgtttgattgcttagaatgagagatgactacatagcatcctttattatcttatgaatcttatctaagatacacaggaaatagaggaacaagttaattgataccatgaggaagcaatcaaccaaatccagtactgggaacattctatgggataaatgaactggcttctccagcaaattaatggaatgaaaataagggaagggtagattgttataataagattaagagacataataataaaatgcaatgtattgccaaaatataatttttaaaagtcaatgacagtatcctatacaaagtgagcatgtatcaaagatgtactaacaagagactagtaaaaaaagaactagttcaaagagaatttggaagattgaatatacatacactggacatacatcttctatacctccactgaacaaaattcattgacattgctattgaccaagaatcatttccattgatatcacttttctacaagttaatgtctacccctaaggagtactctaaataccctaaaatactaaatcaaagttaaactaccctagagaattagataatttttacgtaggcctattagaaaatgctacagtgtcggccgggcgcgttgtatcaagcctgtaatcccagcactttgggaggccaaggcaggaggattgcttgggtccagaagtttgagaccagcctgggcaacatggccagaccttgtctgtacaaaaaatacaaaaattagccgggcatggtggcacacatctgtcccagctactcaggaggctgaggtgggagaattgcattagctcaggaggtcgaggctgtagtgagccatgattgcaccattgcactctagcctgggtgacagagtgagaccctgtttcaaaaaaaaaaaaaaaatttttttttaagttgaatttgtcattatatattatacaatatattttcactaacttttgagctaatagacatttaaaagtcaccaaatttggaatacaaagtattttaaatgacatcccaagtcatataagagattggttcagcctacgctttctgttcaaaacccagtagttaatgctattagcattcaaaatgcctttttttccttttaaaaaggacagttaaacctgttattttttatcctgcagccagttcttagcacaaaagcaggcagattttagtagcacaaaattatttattagcttatgcctctaccagaaaacagaaatgttggcttaaaattgtttcattgatgtaacttttaccttttcctttacagatattcatttattcattctggccctaataccaaggtatccttcacacaaaagattcaaacagattctttgcatctttaccaatgggagtttcatgttttcaagtttttgtttgtttgtttgtttgttttttgtttggaggcctctttccaagcactctagtattcttaaaatcctgagattctgaatggtatgatttagctcaatatgtttatactaaacttaggggaaaaaaactaatatattttccttacccatcacaaggtttatgctgagacttcaataacaaaaaacagactaacaagagaaaagcatgcacatttattttatccaagttttacatgacatgggaactttcagaaacgaaaacccaaagaaatggggacatttgtgtagttgtatagacagtcaggcagatgtatgattgcaaggacaaaagtgtatgagctaayggtgataaactgagaagttggaaaggcctgtctattcagtttcttcttggcatacctgtgtggcagtccctccctcagggcataggagaggatgcctgttatataaggggcctcagatgaaggagggagaaggagggagcaggtcagagagtgaccttcctagattttgtggcctgcttcagggaagaaggggcgaggggaactctagtttctatggcctgcttcagggcagaaaggagcaagaggtcagagaaaccttcctgtttctgctattttctcaatttccaaggtgccatattttggggtggcatttcctgtaccctgtcatatacaaactcatttttagacagcggcctttagttcctcctgaggttaaaccagagctgctcaaggaatatacctactaaatcttcttgctccatttaagatatttatttcaaatgcaaataattataccataccctttggcctagtcagcactgattcactatttcaaagctttacatttaagcctcataataaccgtacgaagcagatctagctacttccatgttacagaagaagaacctgtggcacacagaggttgagcagctgccccaaagcctcacagaatgtggcagactggagaattcaacgcagaactcttacccagccccatatgctgccttggcctccatctggtatgaccacagaaatggagagctggaggaaggaatttcaactctgcttcagaaccttaaatgaagcaggaagctgtagaggggcacaaagctacaaagctgctccaaagctgtctcctccaacacaaagcagaaattgtgttcccagcatccatttctgttacccttacttggacttgagaagctgtatcaatcaagatgtagtgtggtgggagagggactcagtgcatgactgatacccagccaagcagggccaggcagctttagaaatgcccacactggggaattgaacaatgagaacacatggacacaagaaggggaacatcacacaccaggggctgttgtggggtggggggaggggggagggatagctttaggagagatatacctaatgctaaatgataacaaacctgcacgttgtgaacatgtaccctaaaacttaaagtgtaataataataaaatttttttacaaaaagaaaaagaaatgcccacactgagctcatttcatttaacaaacatttatttacatggaagccatgtgcatggaagacaggtgttgtctcaactctcttggggcgtacactgagggggaggaagatcgaaaataaacacattgacaaagaaatgaacaaggtgctttcaaatggcaacaaatgcatgaagaaagggaaacagaataatgcatgatggggaactggtttcaactgggtgagggaggaagacctttctgagatgtagacatgactgacaagaagcgggcagccatgcaaggggctggggcagggagtttcaagaccaggtgtaaggtgaaagcacagggaccgagggagaagtggcatgagggaggtcagagagttaagcagagctgtcatgtcaggagccccagcccctgcaagagtcttccatgcccctctaagtgtgctgagaggatagagaattttaagtggggtggtggatttgtggctggagtctgcccagaatggtctgtgaataggccaaagacctcaggacagggagaaaacgcttagtggcacagcattattttttattttattattattttttgagacggagtctcgctccgtccccaggctggagtgcagtggggcgatctcggctcactgcaacctccgcctcccgggttcaagcgattctcttgcctcagcctcctgagtagctgggactacaggtgcgcgctaccacgcccggctaatttttgtatttttagtagagacggggtttcaccatgttggccaggatggtctcgatctcttgacctcgtgatccgcccacctcggcctcccaaagtgctgagattacaggcgtgagccaccgcgctcggcggcagagcattatttaaggagcatgttaaacacactttcttcccacaccaccaactaaaaaagcaggtatcaagagggtctaggtaggtgctgagaccacctccagagcacaggcccgccagagttgtgctcagcaggtgaggtctacactcctctcagcccggaggggcagcgtgagttatactgctggacaaaggggaaaaagacaaaatgctgggctggggtagaagggaaggacgcgggtgttaaatgtgggcgtggtttcttctgaatgtcccacccactycactatacattgcttaaatgcagtgcaaatttccctacccccagcggaggaggggtgaagattcagcaggttttagggtctaggaccctgagctcctccattcatgaatacccaaacaactgtagcccaccctctcaccactgcctaggcggacgaccagtgtccccagctagatctctacccttaggagcagggcactggctgacccggagaacctgcgccgcctcttctcagcctgctgccagcccagtgcacgagctgaatgccgctgccgcctggctggccgggaaagacggggatcttgacgcggcggcgcctgggacacggcaaccgcagcacagggcatggccctgcggctggaccggacgcggcggctgcaggcagagcaggaagagagcgcaggctgggcagcggcgtacgcttcggcgacgtcagcttccggggccgtggacgggggcgcgcccgagcctcctggaaacctccccaccaaggacctggggaacccaagtctcggcccgctttgtagcctctggtttctaaattcagcgtcgaggagcgaaaacaacccccctgaactgggcccagacccttaagctcctggaacctcagtttttccttccgtcgaatggcgacaatggctgtctggttgaacgttattttacctaggaagtaataattttcgtaaataggtctctgagagtatttgcttgctaaaatcctgctttgtcctggaagcaaatttaggccacgttaggggcggggacttcgtatttaatgttgagcacctggcgagcgccaccttcgcctcaaagcgccctcggaccctggatccagcataaggccagagttgggcagtgaggggtctcgagaggtggaaaggggattattgccctctcaagagtcctacgtaggtgactcctaagccttagcatttactcccttagaccgtgtaacaggccaccccaattacgcgccaaactcaggctgcggctcttggcgcagcctcggtcccgcctgatttcagtttccatttcgctgcccctggtgccccaccgcccgcggctgtctggggatttgcccggtgatcagtgacgtaaaagagactaaggttcccattggacggcgaagttcggcaggagccaatcccggggctggtccgggagaaatctcggcgaagggccccgaatagccgggagattacggggcggggacgagctgtcgcgctggttgctcgtgcaggagcgggacccggaacagaccgccgtgagagaggaggggcgccggccgggattcgcggcccggagctcgggaccggtgagtagggggtgcacatgagacatacagcgaagcaacagtctcgtacgctcaccgggtttggggcgacccaacgcagccgccgggcccgggttcaaaacggggccaggcccccgggcgggctcaggagggggtcaagttcgctgcgtcctccctgccagccagatccctcctgtttgcttgtccttacattctccccctcctcttgggtctttctcgctttctggtatcctactcagactcccatccattctagtctgcggaaccagaagtaagcggggcctggatgaccgtccggttgcttggagcctggtagataggcgactaatccagctccctgaccaaagtgtcatgctttctttctctttctttytttttttttttttgttcggagtaaaccggtttagccacaaatacttggagctgtgctttcactccttccagctcattagcatttttcttactgattttctccctatttggccttagaaaaaaagtgtaaatttaactctgtggagtaaatgggagggacacacttccaaatctccagtagatttcaaattttgacccacgatttgtgtgtacttcaaaagaggggagaatgacattcgtttatgcatgccttaacctcctgtttttaactcttagctgaaatcataatccctaacatgtttttccccaagttcaaaaaaatcacctttaaaaaaaataggctttttatgtttcaaaaattgcaattttattgtttaagtagactttatttcttacaacacttttagatttacagaagaattgagaagatagtacaaacttcccacatgctccaaaccggrtcccctgttattaacatcttacctcagtgtggtacatttgttgcagttaaccaatatcaatacattattattgaccaaagtccatagtgtgttcagatttccttagtttttacctcagtactttttctgtttcatgatcccatggaggttaccacattacatttagttgtcatgtctccttatgctcctcttggctgtgggagtttctcagacttgttttgatgaccttgacagcattgaagaatactggtcgtgtatgttgtaggatgcccctctattggaatttgatgtttttctcctaagactgggcttatgggtaactgggaggaagaccacagaggtagattgccattatcatcccatcgtatcaagggcatgtactaacatgatttatgacttaatattgatttgggtgagatagtgtttttcaggtttctccactgtacagttagtctcttttccactctttgcgtgtattgtcctctttagaaggaagtcactaagtgcagcccatacctagggagccaagagttatattcccccttcttgagggcaagtatctacatattattgtttgcagttattctgcatggaagatttgtttctctcttctccccaatttattaatttattcaatcattaatttcagtgtagactcagggacatttattttatactttggtttataatccaatactacttaattttgttgctcaaattactgtggctttggctgttgggagctcttttcacattggctcctgtgctctttcatagtatttttatagagctttttgctaatgagacactcgtacttatgtgacyttgcctcaacctcaaatagcctggtaaacttggcaaaatattttccccttgttaagaggtaaggagactgaaggcctaaggcagtgggtgacttcttagatatcacttcctgcaggggagtaacaggttggactcagattgtgtgtgaccaccacagaagacactgcaaacccccgaagagagtccatggtctgtattgaggcttcttggaatgacttcagacttggacccccccaggatcagaatagaaaagacacrgagaatgggaarttggtttgagaagacaaaaacataaattggctggcatcaggatgaattagattttgccagctttatagaaatggaattttgttcttccccccaaaattgtgtgtgtgtggagggaggccaagagakatctaggtaatgtgtgtgggcaagaatgtctaatctaaagagagccctggaagcctgctgctgaagcagaattttaatgtgggaaaggggggtgtgtagtgaaagggggaagaatggagatggcagggctctggaattagaggaggtcattcatttcacaaacatttgcagaccccctactttgtgccagatattggagataaaaaggtcagtgaggcatgacctttgggttcacattctggtgggagagaagacagataaaaatatcaattacagccacttatccatagcttagttttccgtggtttccgttacccatggtcaacctcagcccaaagacagtaaacagaaaattccagaagtaaacaattcataagttttagatgtgcattgttctgagtagcatgatgaaatctcttgccctcccactgttccttcatcacaagaagggtaagtacagtacaagatagtttgagagagagagagaccacatgcatataacttttattacggtatattgttatagttattctgttgtgttattattgttaatctatttctgtgcctactttataaactttattacaagtgtgtatgtgtaggagaaacaggtttcagacatccactgggggttttggaatgcatctcctgaggattgaggggactcctgtatgaatgtatctttagcggatggggggtgctactgtatgaagcactgtgatagtgctattgtagaaatacagtrtatgcaaagctgcaggaggagggatacattcaactcagaggtgggatgggtacaggaaacacctcacagataaggggacaaattgtattcaagccttcaaggatgcgctggactggagagaagagcatgtacaagggaatgggtggagagtggggagtgaagaaggggctgtcttcctggttcagtgtatctaatggccagagaattaggtaggacgaggagggatttggggctggatgggtaagttggggctagccggatgcagggcaggggaggatgtctgtgcagtttttttttttgttttgagtcagagtctcgctctgtcacccaggctggagtgcagtggcgtgatctcagctcactgcaacgtccgcctcctgggttcaagcgattctcctgcctcagcctcccgagtagctaggactrcaggcgcgtgccaccatgcccggctaatttttgtatttttagtagaggctgggtttcaccatgttggccaggatggtctcgatctcttgacctcatgatctgcccacctcggcctcccaaagtgctgggattacaggcgtgaggcaccgtgcccggccacctgtgcagttttgacctcagctagtaggagtttttttggtgtgtttgtttttatttttatttttatttttatttatttattttattttagagacagtctctccctatgttggccaggctagtcttgaacccctggattcaagggatcctcctgcctcagcctcccacagtgctaggattataggcatgaggcaccaaacccagcctcagctaggagatttgaagcaggagaataacaaggatgagatcctgtgtgctagaaggatgatcctggcagcactttttaggaaatatgccacatctcaccaaatctaagatgctatttgtcttaatccattttctgttgctgtaacagaataccacagactgggtaaattgtaaacaacagatgtttattcagctcacggttctggccaatggactcttgcaagaaaggcattaatccattcatgagagttacaccctcatgacccagtcacgtcttaaagaccccacctcttaataccgttacattggcaattacgtttccaacacgtgaacttttgggggacatgttcaaaccacagcaccaccaaatcttttatgtgcccttattttatgctccacatcaaaaaaatattttgccagttaaattatgacatgcaattgatcacatttcagagatgctaaaatgtgatgtcacaggtgtctcaaatttgatgaaaagcactaactcccttgctgatggcttagattcctccctttccctggattaatggttaggatgtctccatctcactaactcatagatggtaagttaccaagggaaagaagaacagaagctgggtgggcccttccccttctctccccaaagataaacatttacaacatttactggttgggtcgaggagcacaatatctggtctgctgctataggattccttggcctgttattgggcctgtctcatgctgtttccttttggggagttaaatacacacacacacacacacacacacacacacacacacacacacacacacagatattctatatcccatcctccagagtggcaaaaattaaagctgatattatcaggtgttggtgaggctgtggggcatcatgagtgctcatagcctgctgagcagactacatagcactatagtcactttggaaacagtttggcctgcttagtcaaattgagggtacatcttgcctgtgtgtgctagaacatgtatgcagaaatattcactgaagcagtgtttgtaattgtcccaaactggaaacaactcatatggctatcagtagactgcattaaaaattgtatagttagagagcagcaattaagtaaaatcagctcataatcacatggatgagcctcacaaacatgttgacagccccccacccaaatacatgsaaaaaaaaaaaaaaaaaggaaaaaaattccattcatttgaggctcaaaacctgagaaaataaactctgtttatggggtgtatacctaggtctaaaactaaagaaaagggaaggagtgattctcactattacaatttactccacaacaaccattttctcagacacagctttttcttctcctggtttctrtaagttgctggagcgaaaccttggatacgatgatttgctggtgacgtgcagcccactgttcttgctgctacagggaatatgaagaaattgcttctctctctaccaatttactaccatcttgctggagagaaagggcaggtggctaagattgttcgcattccttcagcagatgtgtaggaagcatcttctttgtgtcagatactctgtgcttgtgctttgttttctcagtcagtttttattgtctactctgtgccaagtaatatgtagattctggggataagacagacacaatctctctccttgtttcatggaaaaagctggtgttaagcgagtaattacactaataagtcaggacttaaaactgcagagaagtacagggtgcagcatggggtgttttggggctgtataactagactacatgtggacccaatctgacaggtcaggaaagaattgccagaggaggtggctttcagctgagacttcaagctagaaaaggcatttgctaagtgggaaagggatggtgttctaggcagaaggaattacattgtcgaagggcttagccaggaaagagcatagcactttgaggcatggagagcggtttggtttggctgtgagtttgaggtggggagtggcaggaaatgagcctggagacacaggctgggccatgattatctgggaatccagctaggatctcctgggacagcctcctcacagaagaaaggaaggacaggagttttgactttattcctggagcaccagaaagccattgaggggtttaacctggttggtcacccgggcagattggcagtttaacacgtgaccgagtgtgtttgaggatcaaaaggccagagtggctgcagcactggggcagcaaaggggagaggaggtttatgtaaatcaggaaacccttgagggtttgatgatcccacagttggatctgatttcagcttctaaaggattcctcaggtcactggatgtaagttctggtaggacagggagtttgccacttttgttctctgctgtaacctcggtgcctgacacatagtcggcacctaataaacatctgctagctgttgaataactttcaacatcctgctgcttaaaccctcaatggcttcccagggctgttaggataaagtccaaaattcttaacctgggtcacagtcttgcataatctgttccctcctgtttctccacccttcctctgctcgcctcactgcactccacctgtggccaattgtcagctcctcaaattcaccgctaccctttctccggcggatgatttcctctgcctgtgaggctaaccctccacagcactccatatgggcagggaagagttcattttccaggcaccaaagtgcagtgtatggtggaatggaaggagcccagagctgggaggtgcacctcaccccacctcgtgctagtgctggccttgctgccagccagctctgctgctgggcaaatgagtccgaggctctggcactcactktcctcctctgtaaataaggggttctagtgattcacagtcctggatagactttagaatctcctgggaagtttgttttttaataccagagcctgggccacctctggagatcctaagtcagttggtctaggtatgttttgaagactcaccagtttgaagactacaaatctgatgtgtagtcaaggtttgaaccattccacaagatgawaaaggattccttcctatatttggtgcaaagcaccaagtgacacttaggaatattttagacaagagagcttggttcatgattcaacattagacagatattctggcacaaatatgaagaaccctcaattttcccctgtgggtcagccacaagaccagggcaatttaacgccttgtctcatccacctcccagctggctgctacctcctgcccctctttgagccctgtggggatttctagcgttcagagccctggtagtttttgtggcctgcactgtgcttcagagcaccactgatgctcrgctccgtggggaaagtaagccaagtgtgaccacaagaacgcatcatccacagtcactgggatctcctgggacagcctgggatccaggcctttggcctggccagtaggggtgcagtcactcctagtatgcacatccagatcacttgctttttgccccgaattctggcctctccaggtttgttagaggtgtctcacggaagtttaccccatggagagtttgcttatctcagattaaaatatggggattaatctgggacccaggagcccttaaatggagtacccacagggaatggagctctaggctaagtgctttgggattacaggtgctttgctcttgtttggaggtccagacatatgcttgagaagcagcttgggatactcaagagaggcctgaactggtaccctggaggccaggatgaaaacccaggcctctccatttactttcttgggccccagagtccacatttgggattcactgtctaccagggcacctctctgggtggcatctaggagccggaggcaggccagagtttcacccaggctggagtgcagtggcgcagtcatggctgtctgcagcctcaacttcyygggctcgggagatcctcctgcctcaacttcctaagtagctggaactataggcatgtgccatcgcacccagctaattcagctaatttctttttttggagacaatgtctcactatattacccaggctggtctcaaactcctgggctcaggcagtcctcctgccttagcctcccacagtgctggaattacaggcacaagcccccgtgcccggctttcagctagtttttgtagctcatagtgattattcttggagccaataatcgtgcatgcatccacatcttgaaattacatggtgtcaccttgaccagtctgttgacatatgcagattaggtatttatgagatccagagacttataggggaggggtggatttcagggaaaagggaacctcttagagaaaggtagggagtgtctgcagttctgcctgtgaggagggtaccaggacattgcagggcttgtttgttgcatcttcctggttctatagaattgcagctagcttctggtttattttttcatttttattttttgagatggagttttgctcttgttgcccaggctggagtgcaattggcgtgatctcagctcactgcaacctcygcctcctgggttcaagcgattctcctgcctcagcctgcccagtagctgggattataggcatgcgccaccacacctggctaattttgtattgttagtagagatggggtttctccttgttggtcaggctggtctcaaactcccgatctcaggtgatccacccgcctctgcctcccagagtgctaggattacaggcagaagccaccgcgcccggccgcttctggtttattgaagagacagaaaaataccccctcacccccagcagggatgtgtgacctctggtgcaagggagttcatgaagtgacttcttcaggttcagaattctcatctgagtaaagggagtgggggtggagtgggtcatctctgaggttttttttttttggctctgattttggtttctgtctgcccaggagtcaggaatggagagaagggtaatggtkttacctcttattgtggaaacctgttgagatcacagagaatatactgacggcataaaagggcagaaccatagcagggtgcggtaagttggggaagagtttttggagagggtgaattttgcaytggacckgacagaattgtgtatggggaaggggagcggttattctggtctgctcacatctctcatactcaacctcatttctcctaattctgaaatcttgagatcctctatcactaagaaggaaaactactgtccaacagggacactttattgctcacccyatatgtgaaagtttgtcatagctaaggctagggtgcttttggtcagtatcagcagaatatatgccccctttcttttgtcagcattactccgcttacaragcccttccatgtagatgacctcatctgagcttcctaacaaaggagctggtattagaccccattttacagtgtgcctgggtagggaagagagtgtagtggattgagcagaggccttggcaccagacactgcttcctagccatgtgctcttgggcaagttgcttaaccctgctgagcctcagtttcctcagaaggagtctgtataagcaagggragggattggtcatagaagtggtactgtgtttcatttatctagttatggcagactctcaaaaacaaatggttctatacaactaacattgtctgcaattcccctgaatccattcacttgttcagtaaatgtgtattgagcttctacaaggtgtcaagcaccatgatctctgtatcagtgatttaaccatttttgatggttactacagacctctttaagaatgtgatagaaaactgtagctccctccccagaaaacttttctagctttttattttgctttgcagtgagccaagatagttccactgcactcgggggacagagtaagaccctgtctcaaaaaaaaaaaaaagaaaggaaccatttcaaattaggtgggagacatggagctctaaatactacagcatccattgcctagaaatacaggtattctcagccgggcgcggtggctcacacctgtaatcccagcactttgggaagccaaggcaggtggatcacctgaggtcaggaatttgagaccagcctggccaacctggtgaaaccccgtctctactaaaaatacaaaaaattagccggatgtggtggtgggcacctgtaatcccagctactagggaggctgaggcaggagaatcgcttgaacctggcaagcgaaggttgtagtgagccagattgcgccattgcactccagcctgggcaacaagagaaaaactccatctcaaaaataaataaatatattaataaataaataagaagtataggcattctcatacataacctcagtaaataccattaagaaaataattttagacatggtgcagttgctcatgcctataatcccagcactttgggaggctgaggtgggaggatggcttgagcctaggagtttgagaccagcctgggcaatatagtggcaactcttctctacaaaaacctttaaaaattagccaagtgtggtagtatgcacctgttgttgcagcaactcgggagcctgagatgagaagattgcttgagccagggaggccgaggttgcagtgagcccagatagttccactgcactctgggggacagagtaagaccctgtctcaaaaaaaaaaaaaaaaaaagaaagagaggaaataattttttaatatgatctaacacccagcctacttacaaatttcccacaatagttccaagactatttttataaccttttttttctttttacaggatccaatcaaggttcacrtattgcatttggttattatttctctttagtctgtaaaaatcaaaagcagttctttcgaaggtttttttttatgacattgactttttaaaagactaggccagttgccatgtgcaatgtccagcattctggatttatctggttctttccttatggtgtggtttaattcctccatcggtactttttcagttrtaacatacttcagagtattcctttcctttatattttttataaactggaagttagatctaaagtcttgactagattcattcaagtcaaacatttttggcacaaacacttcataggtaatgttgtgtgattcatatagtgccatgccagaaagcacatgccactttgccccgtctgctgatgacgctggatttggtcacttagttaagataaccactggatctcttccttaygaaggtatgtcaggaagtaatccattcattggtgctttggcaccatgggtactatctcatcccccaaaacttttcacctaatagttttagcatctattgatgatccttgtgctattataatggcagtcgcaaaatgattttctaattctgttatccctcttctacttatttgctgattaatcttacagaaggttattcttctgtaatccccagacaattttaggtatctagtacatatgcaataatttttagacagtttcaggaggtttagagaccatcaaaccccagcatggagcctgggtgatgaggtgtcctgttttgcatggaagaagagctgtagctgagctcttcatagtccttttattgttcttattttgcaagtaaattgcaaaataagttcccaacccaaagataacacaggctatccttcaacaaagaaaaacctcagcttttaaacttctaggccatttggcaaagaggcatgataaagggcttgaaagcccacagacacgcccagtaccactcctttttcctctttccaaacacttgcagtatgttacaactgaaaaactgctgagccaggcttatttcctcaacagtaaagccaaggagttggaccaggcaattcctagcatttctttctttttttttttttgagatggagtctcactctgtcacccaggctggagtgcaatggcacgatctcggctcactgcaacctctgcctcccgggttgaggtgattgattctcctgcctcagcctcctgagtagctgggactacaggtgcatgctaccacacctggataatttttgtatttttagtagagatggggtttcaccgtgttagccaggatggtctcaatctcctgacattgtgattcacctgcctcggcctcccaaagtgttgggattacaggtgtgagccaccgtgcccggccaattcctagcatttctaccagcattactaacatgtaggaacttgatattactttcacttgacagttaaattccttgaatccttcatttgagctttgaaggtgcttgattttcccctcattatgtctcttaaagtcacacatacctagatccattagtgcttccagttggaatttattatcagcactataagaatctcttatatttatgtagtccttttacgttataaaacactttttatgtattattgtactagaccctcaatgagtggacgttatatccctgttttgtttactcttgggtcttatagactgggggttttatttctgtcccattaatgtcactactgacagaggccactgaactctgttgtgatggactttcaccatacataatcattaatagtattgatttgcctgtaattcaggttgcttcattccagcctcgcagtcacctctgtgccctgctggttgtcttcccagcgcygctgtagttgccttccatggatctataggagagcaagtcctccaggtactgccctgtgacgatgttgttgaactctgtagcacgtgtgtcactgtggctggttctgctcacttcctcttttgctgccacttttgaatttaactctttgtttgtggtttggacactcactggatttggaaaccaggggttgtgggttctctcctagatttccgtctgtgtaccaggcttgtgcttagcacttttcccataattctttcacatgacctgcttagaaacccttaaaggtaagtatcactcttcccattttacagatggatacactgaggctcagtacttaagtgacttctgtattgtcacacagagtcaggggcaggaggctgctcttgggttagatgtgctgaggctcataacctcagcctggaactgggtcaggactacaaaggtaaacagaagcagagtcctttctgtgtgtccccgctccctgtacaagccaaggcctcacagcacatagcagccacagccacctgaggattcctgccatctagacgaggcagtyacagccaagaacaagtccactgaggctaagctgtgctcctctggagggctgtgtttagagtccagccttctaggggaagcaaattaaacccaaactatagaacagcccagggaaatactcacaaagggaaatgctgacagtcagactcctgaagcttcctgatgcttctcgagttttggtaaagaacctcagtgctgtttgtttgtttgttttttaatgttttctggttttttgtttgttttgagacagtctcttattctgttgcccagtctggagtgtagtagtacaatcatggctcactgtagcctccacctcccagattcaagtaatccttctgccacagcctcctcagtagctgagactacagatgcatgctactacactggggtattttaaaaaatttttaaatttttttagttgagacagggtctcactatgttgctgaggctggtttcaaactcctcggttcaagtgatcctcctgcctcagccacccaaagtgttggatttacagggkgagccatgtcacattgccctctcttagttcttgaaacctgaaaccttgaggagcaaacaaaaggggtctcttggccaggtgcagtggctcacgcctgtaatcccagcactttgggaggccgaggcaggtggatcacgaggtcgggagatcaagaccatcctggctaacacggtgaaaccccgtctctactaaaaatacaaaaaattagccaggtgtggtggtgggtgcctgtagtcccagctactcgggaggctgaggcaggagaatggtgtgaacctgggaggcggaggttgcagtgagctgagatcrcgccactgcactccagcctgggcgacagagtaagactccatctcaaaaaaaaaaaaaccaaaaaaaaaaaacgggcggtctcttgactctgtcaggacccccatgactgctcgtgtgtcttgtgctttgcacagttgagtgaaggagcactgtgtccacagtagacattgtagatttatatrtgtatcattatgagtttcccagcaggtagtgagagattttttattacagttggtgcattacagcgattttccaacagatagaaggaaagggtgttgaggctctcccaacagcaaggtataggctagtggctgtcctgctcttcactctaccaagctaatctttctgggtttccatatccttatctgtacaatgaggaagttggactagatctataaggtcctcttctcgttgacattgtgtgaaccttgtaggagctggtggtgtctgtcgattgactgagtgctggagctggcagccctgtgcaggctgccacctttgcccctttactgtgcttgctcctgactctaygtcgcgtctycaaggagaagaagtcctcaccagtgaacggagacctctctgaactaagrataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggtaagccctcttcacccccgagggtgccttgccaccttctctggatgctccaccttgcagtcctcagaggactcagcctgagtctcccttcctgccccagcccagagcatccacctgttgccactgcttgtttttccacaggaaaaaatcctgaaccacctgagtaccctaaggagrgacagagacaaaattcagggcttccaggcaaagggagaagctgatatcctggccgcgctggtaagtgaggctgtttcaggaagccctgaggcggtgcgcccgtgtagggcagggtgagcctgggcaagtaggcggcagctgggaggtgtttctaggcgctgctcacagggaggatgggtgtcagcctggcagtagcagacctgggttttagcccaagtgctgtctttctgagccgtgtagtcttgggcctgtttcttgtctgagagacaagtgggctgcctggatgtcagctagagtcccttccgttttctgtgactgtcaccttgaaggcagggcccatgtccagctgctggttctcttctgccaggggactgaagaaggtgtggcttcattcttcctttcaaagagagagagagagacaaggttgcctgagagtggagagggtttagaaggagggagctggctccagggtaagaactgagagggaagggctagaaaacagctaaggcaggtctgccaattctgatggcactgtatgtagtgaggtccaggcccaggatcatggttgccagtacagtgggacctcctccatatctgtgggttccgtagcggcgaatttacccaaccatggatcagaaatattcagaaaaaagaaaaagcgtctctactgaacatgtacagattttttttcttgtcattattctctaaacaattcagtgtaacagctatttatatagcatttacattatattaggcattataagtaatctagtgataatttaaagtatatagtagattttatgtaactattattccattttacataagaacttgagcatccttggattttggtatccttggggagggagatcctggaacccatcacccactgataccaagggacaactgtagttagaaaacaggcagcacattatgtacttgattagagwtggggttggggggaactgatcaaatggttctgattttctgggraactgtgtatgttgaggaagtgggcagtggaggagtagtggggtcagggccagtggtgagtcattaggcctagggagagggaaacagtaagctagagacagccaagtccaaggacccctccaggccctcagtgtgcatggctgcccccagctcagcaccagtcaacagggccactgaggactcccccaaccccagctggggaggagatttggaggcaggaaaggacatagtccctaagcacagacgtcacacaattttgctgaggaaacaggatgcagtcttacatggcaggggtggggtacatatagatattttagactgaacagtggggtgctgaagagagggctggtcaggcttagatgacattaatcaagcaaaacttcctggaagaggtgacagattttgtccaggagggaaaagtgcgtcggctcatgagtgagacccacagagtttctctaggggccccagagcgtactggtttagctagaacagattgtggctgaccagtcaggtggagacagggttttgaccatatagtggtggggtgaactgaactaattcattactggagtcttctttgagaagcggagtgtggaccaggaaccctctgtagctcctcccactccagatcctgtagaattcctgaacgggggtagcgaggtgaacgagccagccttgcacacctccagcactgggccctccaccctgagcagaggtgtcagcccttctccccttcctgccccctgcagaagaagctccaggaccagaggcagtayattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggtgagaggccgtccctgggcagggcgccagggaccaggacggtgggtcccagccctgccattcacttgcaggaccttagaagacttgggggctcagttttgtcatctgaaacatggagatgataatccttactgctgccaattagtctgtagattgcatgagcataaaatgaaataactggcatgctgtcacttcaaaaaataaactttttacacaaaactgttcaaaaaactaaatggtatagtagaaaatggaagggaagattattaatatcatttaccatcctccatcctcatcactgccatcacaagccctcttaacaagtcattggcagacacttagcagctggtggaagctttttatggtgttgtggttgggggtggctgagggrgggctgaccagcagctcctctcaaagacccagaggatctggaagagatagggtaactggggaagggagacagagatggccaggttttctttggcccatgggattaccacacagagaacaagatggaaagcagacaagggggcctcggggcacctcctagaggagggggctttgatagtgagaaagggagggtttggggctgaagaactggctgtgaagctgaaatggcaccacatctcctcccccccgggagcctctggggatcacacttaccctgaagagggcccagtcccctttggaggggtagagggctcaaccttcctgctctcataggctgggaggggaggggctctctgatggtattcccccacttgcactgtttagggtggctgggtctgtctgtcagcagcagagccacccaggatctctaggaaggtggagtcccaggctaatggcagggcaatagctaggagggagagatagcaaggcagactctgcagtatgtgcactgggacagactgcagaaggaggcggccacctgctcctcattgttgtgaattcagatgtacagaatgaggactggcagggattttagaccttccagttcagcccctactgatgaagtcactgaggtccagagagtgggaggagtttgtcccaggccatggggtgggtgtcaggtcacagcttgagcccagatgtcctgactcctgggctctgagctcttgttcttattttgtccagaatgtctctctggccccctcttttcctccagatgtcattctgttctctcagatttctctcgtcatactctttgactgggtcattttctgcatctccttttgcccgtttctcttctccttcctctcctcacgcccctgccatgtgtgaatgcctactgtgtggaacagaggcacacagctgaggatgtggtggggctgaaatccattgtgtttgcccggaggggtgccttttcctaatgcacccagagaagtggccctcagagcagaagcctggccctcaatgactcagagcactcagattgcagctctccctggggtgggataaggtcaagggaagggagagaaaatggtgtcagcttgaaactagtataggaaatgttattggtactggtaggtttctttttttgttttgtgttttctcttttaattttagtgctatataatgtatatatttatgggatgtagaggtttttgtttgtttatttttgagacagagtctcgctctgtctcccaggctggagtgcagtggcgtgatctcagctcactgtaatctccgcctcctgggttgaagcaattctcctgcctctgcaacctctgtctcctgggttcaagcgattctcctgcctcagcctcccaaatagctgggattacaggcgcacatcaccacacctggctattttctgtatttttggtagagtcagggtttcaccatgttggccaggctggtcttgaactcctgacctcaggtgatcgcctgcctcagcctcccacagtgctgggattacaggcgtgagccactgtgcctggcctagagtgatactttgatacaagtatataatatataataatcaactcagagtaattagtatatctgtcacctcaaacacttatcatttctttgtgttggaacattcaaaatcctctcttctagctttttgaaaatgtatagtaaattatagttaattatattctccctgcaatgctgcacaacactagaatttattcttcccatgtagctataactttgtatctgttaaccaacttctccccaccctcctctccccagcccccttcccaacctctaatcattactattctactgtcttacttccatgaactcaaatttattatggatgaatagtactccattgtgtatatatgctacattttctttatctatctgttgatggatgcttagattgagtccacatctcaactattgtgaatagtgccacaataaacatgagtgtgcaggtatccctttgatatactgattttcttttctttggataaatacctagtaatgagattgctggatcatatggtagttctatttttagttttttgagaaactctcatactgttttccgtaacggctatacttatatgtagaaaaacctaaaggccccaccaaaaaacccttagaactaataaacaaattcagtaaagttgcaggatacaaaatcaacataaaaagtctactgcatttttaatacaccaataacaaactagctaaaaaagacatcaagaaagcaaccccatttacaatagctacaaaagtaaaataaaatacctgggaatgaagttaaccaaggaggtgaaagacctctttaatgaaaactataaaacactgatgaaagaaattgaagaagacacaaacaaatggaaaaatattccatgcttgtggattagaattaatattgttaaaatgactgtcctacccaaagcagtctacagatttaatacaatccctgttatcaaaatacgaatgacattcttcagaaaaatagaaaaaaaactaaaattcatatggagtcacaaaaaaccccaaatggccaaagcaatcctaagcaaaaagaacaaaactggaggcctcacactatcttacttcaaaatatactacagccagttgtggtggctcacacctgtaatcccagcactttgtgaggccgaggcaggcggatcacgaggtcaggagtttgagaccagcctgaccaacatggtgaaaccccatctctactaaaaatacaaaaattagctgggcgtgatggtgcgcacctataatcccagctactcgggaggctgaggcaggagaatcacttgaatccaggaggcagaggttgcagtgagccgagattgtgccactgcattccagcctgggcaatagagtgagactccattaaaaaaaagaaaaaaaaaaaatatatatatatatatatatatacacacacacacacacacacatatatatatatacacacatatatatgtatatatatacatatatatgtatatatacatatatatatatactacaaagctgtagtaaccaaaacagcatgtattgatataaaagcagacacatagaccaatggaacagagtagagaactcagaaataaattcacatatttacagccaactgattttcaacaaaggaaccaagaacatacaatggggaagggacagtctctttaataaatggtgctaggaaaactgggtaaccaaccatacgcagaaaaatggtattggtagattttgtctgtgtgcttatttgagtttgattgtactgcgtgggaactggacagctacctccctaattagcattaatattttcccagagattatttggctgtcaaagtatagtaagaaaaagacctaaaatagggtccagaagtctgatagagaaatacaggtgaggctggtgtggtgattcacacctataattccagcactttgggaggctgaggcaggcagattgcttgaacccaggagtttgagaccagcctgggcaacatagtgagatcctgtctcaaaaaaattaaaataaaatagaaatacaggtgagagggagaagcagcaggacaaaatgtgtaaaatagaagagaccttttgatagaggtgataggaaaggaaagacaaacctatgggctgggagcatcaagaagacattaaagggattggggtgacaggagaggcccagagagacactgcatcctgccctggtaacccgggcaggccctgcaggatcaggtggcatgcttgtaccctgcttctcctgctgtacacccccgtgaagaactttcttgatgctctctsttagtaaccgggcacatcccctccgggagcttgccatgactcattgccgcagccccactgctcggctctgcctgtttcatgacagcttcagatgtcttgggtgagaagagtcctccaggagacttgggcggatcacttccctccagaggccctgtatgtggctgtggatgggggctcctgagtctttcagcctcttctcckcagggccagccctgccctggctctcgggacccaccctctctgggctgctcacaacctttaacctttagaggactcttctttctcctgtatgattctctccctttctactgttctaggaacttccatgtcaggaaatatgcccaaatgggcctctggcccacactccagctactgctccattcatttgctcttttatgccacctttgtcagcagagctgtcaggacacactgtctgttttgttgcctgtcctctgaagccgccttggacttacatgttttgaggggcatgttagaggacttggccagaaatgtgctaccagtctctgggcacttgcttcatagcggggggttgggatgtgcctctgacttcttgtcttattcctctggagtaaagctcacaactcttcccaaacttttggaagcagtcatcagcagccacaatttgttaattccatttgtttcccaaatctcaccctctccaggaagccagcctgcaccccaccggcccctgctcccatcccccttcactctgctctcttttcccgtggtgcgtatcactcacgtagtatgatgtatttgctacattgrttattgtctgcttccccctgctagaatgtcagctctacagaagtagggatttgtctctctctctcttttttttttttttttttaactgttctgaggcttctagatgagtgcctggtacctaggaagcacttaataaatatttgtggaatgagtgaaaggaaggcaaaaatcaattaatacagggtattaaggaggcttttgactcacaaaagggaatctgagcatstcagaatagccctcttcccactcaccctgccctaccacctgtctgtcacagagatagcaccaccattctcccccctgtacaaaccatgctctgttcttgtttatccttgaccagtatgtccagttgaatctgtctctaaaatacctggaatgtattgcttctctctttttctccctactgccaccaccttagttcaggccatctttagctctcccctggtccacggcaaaagcctccggaccaacctccccatgttcctcttgcctccttagtcccttctctgtggggcagccaagtgagtggtcacttagggttttggctcactgctgtacagtgacgcaaacagaatagaagtttatttctgcctcagttaacagttcagaggtgcagggtctagagctatcacagtagctgtacataagcttatccaagggactgggttacttccatgtggttcttccaccagcttctagggatgttgtcctctgctgcgtggtcaaagttgggctcaccaccaccatgtccaaaattcagttggggtaaaaaggaagtagaaagcaattttctttttttaaaggacaatgcccagaattatggtcattgctttctatcacattccattggctggaacttagtctcatgaccagaccttgtcgtaggggatctggaaaatgtagtcttcccaggtggccgcctgaccagcaataactccgggggttctattattaaaaggaggaaggggagagtggactctggaggttacacagcagtctcagccacatgtagagcggatcacacatatcatgcccctacttgaaacccttggtgggtttccactgtacgtggagcaaaagtgaaactccttaccatgcatatccagccctgcgcagtctggcctctgccgttctcaccaagccctttcctgttttaccttacctctcttcatccggccagtacttcttatccgtcaattctctgcgcaggtatctcccagagaggttgcccatgtcatctcccagccattgtggcttctgtcattgtgccgattttgtttgttttcttgttgttttatgcagtgaccccactggaatgtcagctccataaaaaagggaccacatttgttttgttcactgatatgtcccatctctgctacagtgttgggtgcagatgcattgaagtcttatttgattcatattgatacttgtgcttttttctttcccttctaggacacgagagacttcctaaacaggtaaaagagtctcctctccatggcgtacctcatcccccttgtttatgttcccccgcttctgaccaggtgcatttgaattcatggggagtggtatggtgccagaggtactcacatcccatggttcatcctgatgccyttctgaggagcaggacacatcattgagaactggagacttgctctcctccttatgagttctstgtgtagccccagctccttggcccactggccttatttgaggtgggacagagcagagaggttagaaacatggcttagtagacagagcgccctggatgtggagtctactgatgttctgaagccctggttcagctggtgtctttgggccactgtttttctgtcacttgtttggggataatcatacctttcctctccccttcataattgccatgaggattgagagataagtatgaaggaaagtaagaagagctgagtaacagcttgttatgtatgtcatcttcttaggtatccacggaagaagttytgggttgggaaacccattgctcgagtggttaaaaaaaagaccggagaattctcagataaactcctctctctgcaacgaggcctgagggaattccagggtaagggttggggagcgcacaaagggtgggagtcagagcagggctacctcgtagaaagagcgcacccagctcctttccatcaccttgtcgatcctcactcttctgagggcctcttgtcttagacatggatccctatcaggaaattgatactgcccgagcaagaaatgggctcataaattttcgggacttgagtcattgctgtccttttttctccccagggaagctgctgagagacttggaatataagacaggtgagtgtctagagggtgtttcccagatgtacatcaaatatagaaaactccgcctgcagagattctgactgctcacttttcccccaggtagccccttttgcaacaggaagaatttcccagctgcacaatagaagcccccctycctctttgcactttctaatcagcctactctttagtctgcagtagaggcctctgcttgctagtctgatccttctctgccctgtgtttgcttttctttttcctatcctcacaggtcctaccaccagtccttttcctgtggccgagctttctctcatcttcctggctgcatggctcctatattcagagcaaacagcaggggcaacctaagaccagaggccatatccaccacaggccccactattgtgccccctctcagccctgcagttaggttgtacactgcataccaaccaccaaggagcgccatccwcatagaccaagatgtgaatggtgccccttggattgtgaagactggtggtctcctcctggctcactttcacacttgctttcgtgagaaccattgaggaggtcggcctgtctgggagcaaacgaggccctgagagcttcatctagttcacaggataaaatcccatagcagaactgagttagcagtggttaaaccttaggtggttgtagcttctttattaatgtctgagctgtctgtgaataccgtcaaattttacctatcaggttattctaattatagagaatcctatgaggatgatggtgaggattatcccactctgtcagtacctgttcagggtttcttgaaccatcttacagagcaggctggtagttttgaaactgaaattgaacagtttacagagaccctgaatgcttgtgttacaacagatgatgctttgcaagaacttgtggaactcagaggccacatctgtcccaaatttcttttctttttttttttttgatacggagtctcgctgtcgcccaggctggagtgcagtggcgcaatctcggctcactgcaggctccgcctcctggggttcacgccattctcctgcctcagcctcccgagtagctaggactacaggcgcccgccacctcgcccggctaattttttgtatttttagtagagacggggtttcaccgtgttagccaggatggtctcgatctcctgacctcgtgatccacccgcctcggcctcccaaagtgctgggattacaggcgtgagccaccgcgcccggccttttttttttttttttttttgagatggagtcttgctttgtcttccaggctggagtgtagtggtgtgatctcagctcactgcgagccccgcctcccaggttcacgccattctcctgcctcagcctcctaagtagctgggactacaggtgcccaccaccatgcccggctaatttttgtatttttagtagagatggggtttcaccatgttagccaggatggtctcgatctcctgaccttgtgatccacccgcctcggccttccaaagtgctgggattataggcgtgagccaccgtgcccagccccaaatttctcttacatgggagctcacctgtgtaattacctgacatcatctgacagttagcacagagagtagcaccttccgccaatttctacttcaaagatatcggactgaatatgacattaaagatcaagctgcaaaaggggatgaagttactccaaaacaatttcatgcatttgtaccctttctgggagagctttatcataacctggagatcagaggaacaaatggacaggttacaagggcagatattcttcaggttggtcttcaggagttgccgaatgcccgaatgccctcttttctaatcccatggatgacagcttaatttgtgcaataaaattgctgaagttgacagggtcagtttwggaagatgcttggaaggaaaaggaaggactgatatggaagaaattattcaggaaattgaaaatgttgttatagatgcaagctgtggcagagacatgaaacagatgctcttgaagcttgtagaacyccagtgcagtaattggggtagagtccatgcaacttcatcatacagaaatacaacagccaaaaaagatcccaattactatgtgaatgaaccaacattttatagtggtcattcacatagttattgtgtttcatagtgttcctttcactgcagctgatccggattaccaagaagcatatcaagagttacttgaaaaagaggactttttttctggattatgaagaaaatggaacagatttttcagggactggtgatccacacttggatgatattaatgatgagttggacccagagatccagagatagaggaagcttatgaaaagttttgtttggaatcagagcgtaagcgaaaacagtcaagttaaatttcagtatatcatgtttataaagcagtttagttatggtgatttagcagaatacaaagccagaaaatgtgtcacacttataccaaattaaggatgttgagttatattactaatgtatgcaactttaattttgtttaacgctatctgccaaaataaattttattccctctgacttaaaaaacaaaacaaaacagtgatgctgtttttttttttttttcccttgtccccacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctrggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgaygactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccrggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgtthtaagagactgttccaacggctytgggcctcagtggtcacttgaccaccattgtctcagagctgcccactttgtgtgtgtcacatgctgcctgagtcacaygtacatcttatttctgcctctagttttgtaagctcctggagggcggataacatcttatactactcttgtattctcatggcacctagtgcagtgctgggcacagagtaggtgctcaataaagacttgttgaatgaacagcctggagatctgtatttgtaggtctatatctatattatatctcaaatgccaccagacctcagtctggctacagagaaattccactgatagcagtagccgaaggttttccttctgtgccttctgtaacagtgtaactttgctttctgttctctgcacacatgctgtcatttctggaagtccctcaaaaagagcctactgcggaacacagacgagttgttgcgtggctccacctttttattcctcctgcagtggtgcccttgagctgaggtccagcgttttggagcaagtgatgactctccctgagaagggagacctccagtatagcacacccaaaaattcttccttggaaaataagcactgcctcagaggaaatagaatgtgcagagattcagccttgcatcctaacacagtcaactgtttttcttgtcctttctgatttttttttttttttttttttttttttttgagatggagtctcactctgtctcccagtttggagtgcagtggcgccatctcggctcactgcaagctctgcctcccgggttcacgccattctcctgcctcagcctcccgagtagctggaactacaggcgcccgccatcacgcccggctaatttttttgtatttttagtagagacggggtttcaccatgttagccaggttggtcttgatctcctgacctcatgatccacccacctcggcctcccaaagtgctgggattacaggcgtgagccatcgcgcccagcagtcctttctgattttttaaattgccatcttaaagatggaaaagggaggattatacgaaactacctgtaaaattacgctagtggcaaagagcatatttcctctctgttctctaagttgtgggctcatgtaaattttccctttttattttttatattcatagtttttcattttgtataactctacttgcacatatggtaaactttctacagtgcttcttacaaataggaacatttccctgccccatacctccctccaaagacccagttcatacctttcagcaaactattttgtgtttgccttgctgggattacaggtgtgagycaccacaactggctgaatttttattattttagagacatggtcttactctgtcacctaggctctagtgatggtgcactcgtagcttactgtggccttgagctctggggctcaagtgatcctcccacctcagcctcccaaagtactggaattacaggcgtgagccactgtgccctgcctgaattatttcttgttgacttttcctcctattttctgtattctctcaaatctgttatctccaggcttcatatgtctcctgaattcatttattaagtacccgtgatgtgccaggatgtttctaggttacaacagtgataaggttaacaaagttctgcactcttggaggttatattccagcaaatggtgacaggcagtatgttaaaattgaaaaaaaaaaagtaattagcactatgcaaggaagtgaaataagtctgtgatagatagtgacctagtatctattttataatgtgtgatcagaagggagttccctgaaaagatggcatgagagctgaaatcagaatggtgagagggaaggtctaagatcacatcagctagagggaacagcaaagtcctaaagcagggacaaactgggtacagaaagagtgcatttagagtatggttatgggagaacagaaagagccatagattttctcttttttttttaatagagacggagtctcgctctgttgcccaggctggagtgcggtggcatgatcttggcttactggcaacctccgctgcccaggttcaagcgattctcttgcctcagcctcccaagtacctgggactacaggcgcacaccaccatgtctggctaatttttttgtgtttttagaagagacggggttttgccatattgaccaggctgttcatgaactcctgacctcaggtgatccacctattttggcctctcaaagtgctgggattacaggcatgagctttaaaaagaaactttttaaaaactgatgcatcccaagtacccagaataatgcctatcacataagtcttgacctgaggccggactgatgtggcgctgctgttgctgctgctactgctgccacctggcaaaaaagagatgggagactgagcactcccatgcacccccctggacaaatcccatcgccactgctacaggctgctgtgagaccagggcttgagaagactgcactccctgtggctacttgtccttgctcttccacctgagaggggtcctgccctcccggtggcaaacctgtagtcattattctgagagctcaaccacccgggtctgcattctgcccctgggcctggctggggctgctgccgccaagccaaggctaagttgaggagggagagtagagacggggcacttccgcacgttcctaggacaaatcccaccactgctgctatgggctggtgtggacaaaggtgtgagcagatgacacttcccacagctacttgctcatgatgcgccagctgagagtggccctgccttccctggttgcaggactacagtgcagccaccacagccagcccacacctgagcattctgccagtggtctggggacctctccatctcttgtctatcacagctagcacctgaatgcattgcagggggccctgaggacaggtctgctggcctgatcccatccccccagtacacaagcacatcatccaggggcccggaaattgcccagcccaatctaccaccactggcatctgaatcattcctgtcaggatctgaggtcagtccaactcaatctaccaataccaccacaactgacacccacccacacatgctaccagtgggtcagggtactagcctgcccaacttgtcacagccaccaccaacaccagcacagactgcttgggtcctagcaggttgttccaccactgctactgccattacccatttcacaccagctgcccaggagcctgagaagttgcccacatgtctggcccactgctgccactgctagcatctgagcaagtcacctgaaggcccaataattggccctccaagacccactaacgctgttgtcagtttaagccactctgtgggccctagcacaggctcattcaacccaccgctgccatcactagggcctgaagactggcccacctagcatcttagttcccagccaaacttcaccacagccttcactaataagtgcaccttaagtcaatgaggaagtcacagataccactgatgttgtatactgccaaataaatcatacagggatcacactactataggcactcaaaatcaaagccaaagcaccctactcaacaaacaacacgtaaaatcttcaggaaaaaaatcctcccctatgaaagcaatttcaaaaatggaagaagtgactgttgcaactaaatgtgcagatatcaatgtaaggacacagaaaactaaagaacaaagaaatatgacaccaacaaaggaacacaatacctctccagctacagttatcaatcagaaagaaattcatgaaattctagataaagaattcaaagtactgattttaaagaaactcagtaggctgggcacggtggctcatgcctgtaatcccagcactttggaaggccgaggtgggtggatcacgacgtcaggagattgagaccatcctggctaacacggtgaaaccccgtctctactaaaaatagaaaaaattagctgggtgtggtggtgggtgcctgtagtcccagctagtcgggaggctgaggcaggagaatggcgtgaacccgggaggcggagcttgcagtgagctgagatcgtgccactgcactgcagcctgggtgacagagtgagactccatctcaaaaaaaaaaaaaaaaagaaactcagtgatatataagagaattctgaaaaacaatagaaagaaaaaagataataatgtaggatatgaatgagaaatttaataaagcaatagattgttttttaaaagaaaaatagaaaatctggatatgaagaatttattaaaggaaatacaaaatacctttgaaagcttcaacaatagaactagattggggagaagaaagagtctcagagcttgaaggcagctcttttgaaataacctagtcagacaaaaataaagaaaaaataattttaaaaaattcaatttactttgcctagataaaaaaattagcaaagccttcatgatatttgggacagcataaagcaactgaatatatgaattgttagtatccccgaggatgatgaagaaatgaaaggattagaaaatctatataatgaaataatagatgaaaactttccaagcctagcaagggatttggacatgcaggtataggaggctcaatgtttcccaggcagatgcaatgcaaagggtcttctccatagcacattataattagactgtctaaagtcaaaataaagagcaaattctaaaaatagcaacagaatagtgcctagtcacctaaaaggaaaactcatcagactaacaaacagtggatttctctgcagaaaccctacaggccaaaagataatgggatggtatatacaaaatgatgaaagaaaataactgtcagccaagaatattagatccagccaaattaaagtataaaggaaaaagaaataaagtctttcccagacaggcaaatactgagggaatttgttaccactagatcagtcctacgagaaatgctcaagggagtcctaaacctggaagtgataggatgatatttaccatcataaaaacacacaaaagtataaaactcgctagtaaagcaatcacacaaaggaagaagagaaaggactcaaatggtgcctctaaagaaatccaccaaaccacaatgacaaacaagaagaaaggaacaaagaatatataaaacaatcagaaaacaacaatatgacaggaacaaagtctcatatatcaataataatcttgaatgtaaatggaataaattctttacttgaaagatgtagaatggctggatttatttaaaaagataatacacctgtaagctgtttcaagaaactcagtaaagtttcttaccagtaaagacaaatatagacaaagtaaagggatggaaaaagatattccatacaaatggagacaaaaagtgagaaggagtagctatacttatatcagatacaacagactttaagtcaagaattgtgaaaaaaaaaagccaaaaatgtcattatataatgataaagggatcaatccagcaagaagattcaacagttctaaatatatatacaccaaacaccagagcacccacattcataaagcaaatattactagctctaaagagagagacagattggaatacaataatagtgggggactttagcacctcatgctcagcattagacagattatctagacagaaaatcaacagagaaacattggatttaaactggactttagaccaaatgaacctaacatttacggaacattctattcaacaactgcagaatatatattcttttcatcagaacatggaaccttctccaacatagaccatatattaggcgacaaaacaagtctcaataaatttttaaaaattaaaatcatatcaaatattttctcagactgcaatagaataaaatgagaaatcaataccaagaggaactttggaaactatacaaatacatagatattaaaccacatggtcctgaatgaccattgggtcaatgaacaaattaagatagaaggccaggcatggtggctcacacctgtaatcccagcactttgggtggctgaggcggatggatcacctgaggtcagaagttcgagaccagcctggccagcatggtgaaaccctgtctctgtgaaaaatacaaaaaaattagctgggcgtggtggcaggcgcctgtaatctcagctacttgggaggctgaggcaggagaaccgcttgaacccgggaggtggaggttgcagttagccgagtttacaccattgaactccagcctgggagacaagagcaaaactccat

SEQ ID NO: 10695 - DNA, 16106 bp, Homo sapiens
cattctgatgatccatttctatgcaaaacatagaatctaaagctgagacatagcaatagaggaccagagaacagacacagcaacgaagtttccatgaggcaaatcaggagggtaggaatgagattttgatgtgcatcctggccaaattccagaactagcaaagagaggtcagttcctaattccaatcaaagcaaattcagtcatcttattttcacacagaagtggtctacattgatttttaaatctctttaagggattagggagcctctgaaatgcaaaggaaactaaactgatagtaatgtaaaatgaacagtgacctatcataccagcaaacactgtcaaaaacagaaagctaatggtgggactggaatctagaacacagaagttatgtttatccagtgctacactgtgcaacagggtagtcacttgccacatgtggcaatttaaatttaaatgaaattcaattaaacattccattccacagctgcaccagccacattttaaatgcctcaacagccacgtgtagcaagggctactgtactgaggagcacagacacagaacatttgtatcagtggctgacctagcagtatccagggtaaagggtgttctgctagtaaagcaaggtgggcatcagaattatcacaacttaagcataatattcctgagggcatctatttccatttatttgcttctctgcttaccaactctgaacccctgctttcccaactttctggtatctgggaagaaaataaactgactagaaaacacaaatttcattctgcttgacaactgtaattctcactaaatttataaatttgctttctgatttatcaatgagtgccaaaaacatgagtttgagaaaggctgagtttgattatccctgagtggatccaagcattaggaaggtcttgcttaagtgggtgataggaagtgacaaaaaaagctggaagaaacatgacagactataatactcccttccctaaccttcctccttttcaccctgctcacctgggccaggttagaatccgtcctttgtaaagcaccctgtacctttctattgtaacctttatttactacattatctgtttatagagtgatctatgccattagttgaaaattattcaagggcagagacttctctttattcaccttcagtaactaacataatgcctagcatgtaggaggctctcaaaattaagtttctcattcaaataaattgtacagagcaagttacacttttaggggctggctagtagttatctgatgaaggtatgatattaaagaccatatactaaactatagcaatctcatcaaaataaccttggagggctgggaacagggagaataagagaagtagattagaacaattctttattcaccaccattgcccaaccccggtctttccaagtggggaaactaacatttatgaaacaactaatacatacctacacttcacaaaaaaaacagtccttccataaatgccatcaaatattattgccattttaaagatgaggacactgaacactagaaaggatatgcaacttgaacaaatgcaagtcaactaaaaaagttaagctaattttcaagtgcagaactatctatctgtatctgatacaaatgggaatattcactgaaccctggagagaacgagcatttgaaaaaaaaaagggttcacttaagagatatgattttatcataacagcattgaaactttaatctcttatttttcctatttgacttcttaaaaagggtggcattgccaagaattttctttgatatggtttcacaattgtattcaccttctctccattctgagacttatccataagaatactcactttaatccgacttctactgcatggttggaaaagaagatacgcaataactctttcaaactcctttatctcttttactctctcatgcttctcatatgtaagtagctggctctggcttcttctcaagattctctccttgagtctttgttctgcaagttctctccctcgaatcatgcgttcctggtgatccttagtctgcatctgttccctctcatttacctgctttcttctctgtgcgttctggatgccatgcccttctggcataatttttggtaattttgtttcattggggggttgtagtacttgtctaaatgrtttgttcttaaattctccagcctttcctgtytgatgtatgtgcctttctatgtgtttcatctctctctcaggtaccaaacagtactgttttagtccttctacgctctgggttgttttctcctccatttttttctagatttcattgcctgtctcttctttcatcatttccactattattttattataataagactctgctttggcaagccagtagtcaagagaaacagcttgctccctacagagtatttcacactcctcctgatatttctgcattatcaactgtcttgctgctgttgtatgcacaccacctagattcygtcaaartgaagtcagaaatttataatgtgatcatctttttcctttgaacacatttaaacaggagccaagcccaccctccctaatgacaccaggaaaagctacatgctctttactttagcttagttgttattttattcccatcactcccaggtgagcctgggagctctgaaagtattaagtactcaccaccacaaatcagtaactaggtttaaaaatgtatggtgttggaagtttccaaaaatgatactttgttttgcaactgtggatatagctgggtaacatttgccagtgtagacatactacctgaatgtgtcacttgggcagaaggattttaaacctaagattccttctctgtgtagttccaaactgtatgatgtgaagataatttacttaccaagatctttttttccagtggagactgctgacctgcagcaatcctaggatctttagatgatgtaccccaggccaatctggaagataaaaaaggcaaggtagattcaaatgtaggaggtgtcagaacaaatctgctaatagggaggactacagcagggccatttcccccatgggaaaccactgcattcctatggtagaaaataatgaatgctcttttaataagaggatctttcctttcatatgaacaagcatacttttcctgtggactcagcgtgaaccactgtgaatctcgtattggggattgtgagtgggaagagacatgctccttggtgaggtgttgtccaagtacatctatgtcagtctgctcagtcctcaagcctcctttgtgttctgagacgattgtaggttctagttttctagacgattctaggtttctagttttctcttcctgcagtttcttgatccgggccctctctgactctatcagcacatacagcatttctgccctctaatcttttgttctgaaattctgttatttgactgctcagccctctgcttgcctgactaacaatgccaatcatccttcactctaaatccattatgagactattccctgttgaacccctcaggatggcaatttgtggttactctgggtttatttatagaggaggctgatggcaacacaaatgaaaactatcatcttttatgtgtcatccctggtctagcctgagtttactgtgatgtcgtatttaagccactgaggatgcctggcatttcctctgtatgtcttttataccatttagagttcaaaggatggtctttacagtctgacagagctagatctgaaatctaattctaccacttcctaggtgtgtgactcagggcaagtaacttctgtcagctttctcatctataaaatggagatgtaagacaaaaatctgcctctcagggttataaagaacaaatatgaattagatgtaaagagcttggtaagttctcaataaattctatctatctgtccttcacaggtcaagctcctgattataaagtctttccagtctactctgtcagtgatcttcccttcctctaaatacttgacatattttaattctacaactcatttgaaaattaatcgtggtttacactgtgatatctgtattcacatatcacttttaacattttgatgctgaaatttaggctcataaggaatgaaaactgtaatttatatctacaaatatgatgcctctatattgttggaaaggatctgatatcaaatatttggtctcactgacctcttaggaacattcttatttgtctacgtaagcttattttgagattgtaaacgtatgatcatcttacttttacttctctgtacatggcttctagcacaatacttaacattagagtctgtgatcccaagttctcaaaattaatgatttgctgattgctgatgatccttgacacataatatctgagcatcttttttaaatatctgccataacattgtatctatttttattaagccatttcccagtcttccttgaagtttacagatatgtttgctttatatgcatgttctgggctctcacattttgtacctactagcacagttttattatattctaattattcattcatgttccttgaggtcagagaacacagatttcaactttgcaggctcagcctcagctcaaaacctggcatagttgctcaataaatctttactgattagactgtgagcttttgttgggaaaaggatatgccttttaatgctttgttcctttactgcaattcacaggggatgttggctgtttttcaaattaaaaacagaaaactgaggagggtagaatttcaagttccattttcaaaggagacacacagataagtgagaataaaaactgtctacgacaatcagctcaacaacacgtctccctttgtaagacagaataacaagcaatttcacagttaagtgatagggcttgtcactcttcagcagtttgctgagttttaaccctttcactatggcgttctctccattattacagagaaaggcagatgggagcctctcccagcgaaaagactacagcttgtgtccttcataggagaaaacagtgatggctccagaacttttatatgaatgaacttagcacagctatcagagtggatggtggtgggagggctagcaggaaactagtaaacaactacaagctgccccttcagggaaagtttctacttggaatataagttacagattaatgaaaatagaaagatttcccaaagatacttattctcatgttttataaaagatcagggaaatgtcagctgtccacttaacggatgacataatgaattaagagttcgataggcggcaggcacaactaaaagccaaactcgacctaagtcttatgaaatcctacttaatgagctttcttgactactgctagcctcacttatctggcaggagtcgaaggagaggaagccccaagctcctctgttccaccacctccaaagtcctgaaccccttctcaagtgtaccacttcatccctgcttcctttcgtcccgtgggactaagcattcctcgggccttcactctcaccacttgctgtccctcaaaaagccgactcacccctttccaagcgcagtgaaccgtccgcaaagcacgaggccggttgcgagctgcagaaagcccacgctcgccagcgggacccaaggaacgctagaactatacgtcccagaacacttagctttgtttttaactacggtgcagccgcaaaagggaaataccggctcaggacccaggggagttgtagttctctaatccaaagaaatcattatttggcaacgtacggttttcagggggatataccccgcgactgcgttcctgtaggatgtgagacaaagagaataaatatcccaggattgggtgctggtgggaaaatctgctggaagcgcagcattggttaccaattttgtgctcaacctctcagtaccagggtgaaagtggagacgcaatctcccttggaagacgttagtctccatctctaacgctcccgagacacggttcgcaattaattatgacgtcacagccaatcgtcaacgcgaaagcctgacgctctagccggctctatctcgctgccccgccgcgggcgcagagctggcgctctagcccacggagttggttaactcctctcaccggcccctggaaagggttccaagtcctttagtacccgacgctgtctgggaattccgggcgtttcggctccttggtcgcagaggcaggaggcgtgcgtggcaggagggttcgggttatatactcctaggtcctgggacagaatagttacgacctctgggacaggaactcttctctsttttgttaataaacttccaactccctcctcagacccgaccgcatgtctgtcatggacctcgccaatacttgctccagctttcaktcggacctggatttctgttcagattgcggctcggtcctgcctctgcccggggctcaggatacggtcacctgtattcgctgtggcttcaacatcaacgttcggggtgagaggcttgtacgcaggggtcctggcggagggcgcagggtcggaagcttggggaactcaagatcggttgggttgaggaggggatcctagagcaggacatcaggcggttgtacatttggtctagcgatgaaaactgagggaaaggatgtagggcctcctggcctaaccagccaggggaaaggggaggtttccggtgtcagctstctctggttgtctccataaccagttcttacttgcctgtgcagactttgaggggaaggttgtgaagacttcggttgtgttccaccaactggggacagccatgcctatgtcggtggaggaagggcctgagtgccagggacctgtggtaagctaatgagatcaagaactggctccataaggtgggtaggaaagaaatggaggagtgattgcaaagctctggagagttttgtgcccaattccaagagggaaaagagatgtaaaccatcgacgtttgagaggcgtgatcgcctgattcctgtgggaagtaaggggatatgaccaggcctccctaacccaccagtttcttcccaggttgacaggcgctgccctcgatgtggtcatgaaggaatggcataccacaccagacaratgcgttcagccgatgaagggcaaactgtcttctacacctgtaccaactgcaagtgrgtattctttcccctccctctrctcagtctgtttgctaactaaacaaatccagtgatttatttttttgtacgaaawggccgtttcccttggtcccatcccttawttctgtgcagttctggtaatagggagatttgtagttgttttttatttttttaagttacacttttttaaacctttttataaccagtgaaataaaccttttaggattttttttttttttttttttttttgacagggtgtcgctctgtcacctagcctggagtgcagcgaggcaatcttggctcactgcaacctccgcctcctgggctcaggtaatcctcccacctcagcctccaaagtagctgggaccacagacacatgccaccacgcctggctttttttttttttttttttttttttttgtatttttagtagagatggggtttctctatgtttcccaggctggtcttgaacttctgagctcaagtgatccacccacctcagcatcccaaagtgctgggattacaggcatgagccaccccgcctgacctacttttaggatatttaaaaggaaatgaagaaaaaaaaaamaacataagaagcaggtattgtttagtggtcagcatcttatactgcagtcttcaaccgcagtcaaggtagctttctttggagagaattagtcacacatgacttagagaacatgggctttctgaatgcttttaagacctcatttttgtctttggtgttctgcagtcactatagtatatcaaaatacgattttcttttattctgtttgggatttgttggactttctgaaactgagagtggacttttttttcatcaaccttggaaaattatcagccatcatctcttttaatattctctttcccccatgttctcagtcctcacattctggacctcgaattagttactagaaagaggtttctctcttctgtcctccatttctctcaccttcttttcatattttcaattgctgttctctttatgccaccttctgagtaatttcttcaggtccctcttccatgtcactaattctgtcttcagtttatttcaagtattattattttttactattgttattattttgagttctatttaattacttttcaaatctccttaatttttaaataattatcagttctttaatcatattttaaattgttccttttattattctttaaatatatatttaaaatattaaatatggttattatattctatgtctyataattctgatatctgcggattttgtgtgtctgatgctgctgtcttttgtttctgctgtctctctcatagtgctttttttctttgttttgtgatttttgactataaattcgagttttttagaacttgaactgtaggaattctttgaggccttgggcgagtgctgtattctcagcatttgtgtttcttttctaggtgccttgaagcactatcaagctggaattactttaaataaattcttggcttcatgttttttggagcagacagatagtatgaatttgagctgcaaatccatgtaagggctagcttacagttagaaattctcaggagagagttttctctctttctacctactgagacagtcaaattccccttctatagagttgaattttttcttttcttgttcacttttacaagaaagggcagccttttgcagttcccaaatttatgcacgggatctcctatcagaccttatacattttgtccctcatttcctatgcttccagtgactgtcaaaacagtataaagggcaccatagtgtcactgtcacgtttcatagggacattagttttaacttccctgtctggatttctggttttacagaacttttaaccagtgtgcagattgcctttactttcttgccatctcatcaaaggattaaaaatattcatagtcagatatatcttttaaaagtatttttttcctatcactggttgtcattttaccaaaaaaaaaaaaawtttttttaaataaaaagaagattttttttcccagcgtgtggcttgcctattttcttaaccctctttaaatgagcagaagttttaagtttttataaggttcagcttatccttttttttttcttttacagctagtgctttctgtgtcctaagaaatctttgctttgaggttataactcattggatatatttttaatcccagaatttttagttgtcttggaattagaattggaagtttstttaggggagccagtcctcaatgatgtcataaataaaagtccttccttgattatttgattgcatatcttatcttatactactagaaactcatcttttggtgaatataacaagtcctttctttcctcataggttccaggagaaggaagactcttgacctttttcctgggcaactctrcagtccctccctcctttcggaaggtgmaggatactgggtttttagatgccttgtccatcctgtctggttgcaatgttttgctcccagaagagaatcagatcatcatgtggggattaccattgttcctggagtactcctacccttagttgaatttccttattaaagttatatttttctrtaagaccctgacatatgtatgttacttataatctgtcttattccaaaaggaatttaaatgagtttccagagawatatttatatgaaaaagaaaagggggaaaaattaggacaaaaaagtagagtcaggaatgaggctaatataaacaaaaagcaattgtaagtattgccatactatttaaatctatttggttcctgagtttaggttaagaaaaactaggaatttggatagtgagacatttaacrgaaattttaaccagatctctttagcatataaatttggacaacaaaaaatctgatactaagtaatgccactaagtgatcactataggtgagtattttattagtattgagataaatacaatacacagttgacccttgaacaacacaggtttgaactgcttgagtctacatatatgtggattttcttctacttctgagacccataagatagcagcacatttaagccctccttttcctcctcctgagcctactcaacatgaaaatgtgatccacttctacttaatgaatagtaaatatattttcttttccttatgattttcttaataatgttttctctagcttacttgattgtaagattatatgtattataagtatataatacatatacaaaatatgtgttaatcaacggtttatgttattggtaaggcatctggtcaacagtaaagttttgggggagtcaaaagttatatatggatttttggctgttcagagggtcagcaccccttacccccatgttgttcaaggatgaattgtatatctattataatagattcttatatagaaagaaagaaaaaagtaaagtcacaaggaatcctactccacagagataaccaaattatactgtatatctgtgcttgtgtatatgtatgtggctctgtatatgtgtgttgctatatatgtgtttggtttttttaatggactagacatgctgaactatatcttgcttttttctgtttgaactaaaaactttcaaggggaacaaatgcatactcaggtcccgcattccttggctcaaatagtgatcaaggggttactgtaataattatcatataattgtgtggccctttatatatattcagagctctcaaacatagctatcttgtttgacccccacagcaacctggagaatgggcagggcagtcttccccactgtacgtttgaactgttctggcagttgactttcctgacccactcctgaaatctgaaacaaacctgttcatgtttctaccctactttaagcctttctctggcccataacagtgattggattaagcttaatttcttagcaaagcatacaggttcttccatataaccactgcctacctgtcaagcttcatctggcactccctcagatccaagcggtacaaaactccatttcctgtagtgcacacatctacaactttttaagctgctcttctaaaaaaacctacttgtcggccttcctggttcttgttttaccactttcttttgctctctaagaaacgtgcatatatttttataaaatagcctatactgtaatttacgaccatttctctgcttcatcctactcatcaccccagagagaacgaatatgttggcagtatgtaactacattcagatttacaaatcagacatggcatttgttaatgccccagtgtttcatatttttgttagttttcagcatgcctgtctttcctactagagctaaaaggcagggtctgagcgtcttacgcgcctccatcttcaaggcgtagcacagtgactgaaaaaaactgacgttgaacgtgcactaaactgaactgctcaaacacctacaggcacagggcgaggggtagaaccacatcgcttgactcttaagtgtgtttccaactgctcccacttcccgttttctttagagaaacccagaccaaacaaggaaagggaaataggccacggtagggtcattactattgctccttaagcttcctcgccggtccacctacccagacaaggcaaacggaaatctgcagcaggactcagcttggtgcacacaactccgccctcgccacacccactctgcagcgtctggcccggcaatacccatctgggcgcccctcctgcttcctctaggctgtgagtacgcgtgctgccccagactctccctcctccacccacacccgcagtgacaccccttccgccaaatttgtttctctttctttcagcgcctgcgcgctgtcacgttacggcggaactaatccagcgacgcctgcgctttgacgcatttggtgccgtggaagggaaaaagggggactgcagtatgcgtcacacccggaagcggcgagccggaagtggggttagccaggttatccccrggggtggagaagcggaggcccaggaggagggggaataaagaaggtggaggatcctggctaccamtctgaatccgataccgcttctcttagacctcagcgacagaaaaagggaagggtgtctcatcccccttcctcctctcctccctgtcctgagccttagccatggccgaggcaggggctgggctgagcgagaccgtcactgagacaacggttaccgtgacaaccgagcccgtgagaaaggcgggggggcggtgctgtttaggggtctgggagatactgggagggaggggacagggattagaagagttgttggaggagctaggcctagggatatgggaggtgtggggttgaatatctagggctgggagaatcggaaggtattggagctatttggagtggcagagatggtgcaggaggcaggtcaaggaactkgtaatagggaggtacagttaggatataggtgttgctgcttggggtggttwtgtgtgtaagtaataaacgaaagggaaattgaggattaaggagccaggaagatgttgggaggaaatcaaaggtagtgtaagaaagcatggttggaggccaacttatcaatattatcaatattgatattcgaataaatatttattgaatggatgaatgtaaaaggaagtggcaggaatgaggaaacaagaaaaggagatgaaaagaggtattttgagaaatcagagagcaaagatgtaaatggagaaacaagaagtatttatccaaaaacatgttaagttgccttcaaagggagaaggttgcattgggcttaatactcttggattaaaggaagtttagtaattaatagattagtaatacttgctactagagatgccaggatgccagagaataggtggataagaggtagggagggctggagcttgagaatgagagaggttttgtttgtttttttaagagaaaaagaataggggatctggaaaaaggaagggagatcaaagattaggtgctggggactgaaaaataattttcatgtattaatactaccaaggatgatttggggaggaagacggagaaacagcaaggattatattttcctttgaagagttgctgggacctttcctaggttaggaattgtgtcttctcttatactggtggtataagaacaggaaataatacttattcctcaagggactatctgaggtaaaagacctgttctgttttatcttctgtcagctcctctggtgctatgcctatggtactgattgagctaaagaagaaaagagaggaggttccctgggagggagtgggaaaggttagtaagaggggactagataggtatgctcatccttaaccttctaggagaaccggagccttaccatcaaacttcggaaacggaagccagagaaaaaggtagaatggacaagtgacactgtggacaatgaacacatgggccgccgctcatcmaaatgtgagtaattgttggcccgcagtagccctggagttctggctcccttcagcatatcttgtatctactcatatccactggctttccagaagcccccagatgttcatagttctgtcacttttttggtggtgctgtggtatcagggaaagaggtagggaagggctagaactggaattgcctaggtctgacagcaagaagtgtcagaggtgggagaagtggggctttgaattcgtggctctctaagaggacaagaggggtggggcctgagtcccagagggtgggcctggggaagctggatcctggaaggtaggagaaaataggaattttcactgagtttgagtgggaatggaactgactatatatcttacccttcctcctctttaactgggctcctccctctaaatctaggctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatcyggttttcattttccggtccttttgccatacacagttacagagatcagtcaaatccataccaccactragatctcatttattgccacagatgcacaaaataaataacccaaaatcacaaaatgtgttaaatatgggcccatttatacttatggggaagggtgtgagactatacacaaggatgagtttggagatgtctgaagtattcccaggttgaggaggagagaggggaaatagcaccattggttcctttccgtgagtatgtgcggggagaagtttcaagaaggttcttatggaaaaaaggctgtgagcatagaaagcagtcataggaggttggggaactagcttgtccctccccacccccggatcctgcaaaagaggtacaaagcttcccagagggccacagggcccagaccagagtcaagcctcttgttttaggagaaacctcagtggacaggcagggtagcccagtccttagatctgtggggaaggccctgagcccttctggagctaggagtggcaagagtgggagtcaagtatttgaccagcagagcctctatgtaggaatcatggtcactttaccaatactgatggggagggcctgttccccattgcaggcctagaatggtttgaatgggagaagtcaggaagtactgtagtagctgtaggggagagaagattctgagagccagaaggcaggaatggatttggttttgagcagggacgtggaaacgtggagaccaggtgaggtctcattattttggggcgaaaatgtgggttgctattaatactcctgcaatgggcgtgtgaatgtgttcccagaaatgagtggggaattccacccccaaaaagcagctgcagggccagtggccgggccaaacttctagttggagacgagactcagctttccgctggtacaatgcggagcggagcacgagggtcgcaggtgcagaacagcgggaagatgcgctcccccagggggccaggcgcctggaaggcgtaaagcaggtcgagtgagcggccgtcgtagaaggccacgcggccccgctcccagtccaggtccacgcgaatgcgccgcggcgggggctcaacaccgcccagcagggtgggttcgggtgccgtgagggcccacaggcggccgccgcggccctr

SEQ ID NO: 10696 - DNA, 25646 bp, Homo sapiens
  misc_feature (1)...(25646): n = A,T,C or G, or insertion/deletion polymorphism (see Tables 1-2)
tacaaaaacatacaaaacttagccaggcgtggtgatggccacgtatggtcccagctactcaggtggctgaggcaggaggattgatgaacctgggaggctaaggctctagtgagccatgatcacaccactgcactccagcctgggtgacagagccacaccctgtctcaaaggaaaaaaaaaaaaaaaaaagaattctagtggtgtggtgtggaagacacattctcagcagactaaggttgtatctttataaccacaaggattgaaaaagaacggaaggacaataactttctcataaggtgattcaatgttatttagtgctgtttctgtgtaccatcaaaaatcctcttactacacacagaatattataacaccatctcattgtccacatgagctcagaaattggtcatcaaagcagaaaagtctttaaaacattgatctccggccgggcgtggtggctcacacctgtaatcccagcactttgggaggctgaggcgggcggatcacaaggtcaagagatcgagaccatcctggccaacatggtgaaatcccatctctactaaaaatacaaaaattagctgggtgcagtggcagacgcctgtaatcccaagctactcgggaggctgaggcaggagaattgcttgaacccaggaggcagaagttgcagtgagccgagatcacgccactgcactccagcctgggcaacagagccagactccatctcgaaaaataaaataaaataaaacattgatctccaagaaagtagatcatatctgctctctatctgaccacattgttaaacttggttatgtttgcaggttaaagaggaaatgatggacaacagaggcaactctagtctacctgacaaacttcctatcttccctgattctgcccrcttgccactgaccaggtccttctatctggagcccatggtcactttccacgtgcacccagaggccccggtgtcatccccttrctctgaggagctgccacngctgccttttcccagcgactctcttatcctgggmaattacagtgaaccctgccccttctctttcccgatgccttatccaaattacagagggtgcgagtactcctacgggccagccttcacccggaaaaggaatgagcgggaaaggcagcgggtgaaatgtgtcaatgaaggctaygcccagctccgccatcatctgccagaggagtatttggagaagcgactcagcaaagtggaaaccctcagagctgcgatcaagtacattaactacctgcagtctcttctgtaccctgataaagctgagaccaagaataaccctggaaaagtttcctccatgatagcaaccaccagccaccatgctgaccctatgttcagaattgtttgagttgctgtttccaaatagaaatgaataatatcacaaaatggggtctcttacggcatcattcaatagtttttcctaaatgtaatttccatgtgggcaggaaatagctcaaatgctaacctatgctgggtattactcgcttgggcttcaattgtactaaacatgatctcatgtaggttgaggagctgctctgcttctttcacgaactctaggggagcagggggccccagagtttctgcatgtctcaccctgcccttctcacatgctcggccagaggctgagcatgtgagaagctctcacggaagcttgtgaagcgtgactgctaactacctgatgccggtcgtcacttcgctgaagcgtcgtgctgagcaatcacaatgaacttctctttatttgtcaacatttggagatttttacttattggggattgacaagaagtcaccaccatgggaaagtgtcttggggctaaagtgaaagtagtttacaaaaccttgttgttatttgaaattatttcagatgcatcattttcctgcatgcagacttcttcaggcagcttagtatagggtctaagaaggcagagctgtggccgggcttggtggctcatacctgtaatcccagcactttgggaggccgaagcgggcggatcacaaagtcaggagattgaggccatcctggctaatgcggtcaaccccgtctgtactaaaaatacaaaaaattagccggtcatggtggcgggctcctgtagtcccagctactcaggaggctgaggcaggagaacggcgtgaacctaggaggcggagcttgcagtgagccgagattgcgccactgcactccagcctgggtgacagagcgagactccatctcaaaaaaaaaagaaagtcgggcttggtggctcatacctgtaatcccagcactttgggaggccgagacaggcggatcacgaggtcaggagatcgagaccatcctgtctaacacggtgaaaccccgtctctactaaaaatacaaaaaattagccggcctggtggagggcgcctgtagtctcagctactcgggaagctgaggcaggagaatggcgtgaacccgggaggcggagcttgcagtgagctgagatcgcgtcactgcactccagcctgggcgacagagcgagaccagacctgtatctgcagtataactctgctacctcttctctatgtctcggttcttctccacaaaatgagaataacaacaacagcaattcccatgtgtttatgatgatgattaacagaccttgacatgtaataagtattcataatgattaaaaacttttttttgagatggagtctcactctgctgcccaggctggagtgtagtaatgcaatctcagctcactgcaacctccgcctcctgtgttcaaacaattctctgcctcagcctcccgagtagctgggattacaggcacccaccaccacacccagctaattttttttgtatttttagtagagatggggtttcactatgttggccaggctggtcttgaactcctgacctcatgatccacctgcctcggcctcccaaagtggtgggattacaggcatgagacaccactcccagccaaaaacattttttttagagatggggtcttcctatgttgcccaggctggtctcgaactcctagcctcaaccaatcctcccacccctgccttctaaagtgttgggattacaggtgtgagccactgtggctggccatcattactgattattattatcattatcttgttttgtccatagcatcaccattctctaggttctctaagctagaaaacttggagctgccaggcctttccttcatacctgggaaggacagtccctgccccgtatcttggggtctgccttcaaagtgtgtctatttctgcttccatggccagcttcagctcttccttctcctttaactcccaggtcccatctgtcccaaggcccagtcagtgacctatcccacactgtctatcacactcctctccactgctatgcctctatgaagtcttctccaacttcctatcctagccgttacttcttcctttattttgtataaatatttctcttgtggttgctatcctgctatctttagacactttacacacctatctctgtcttcttcagtagactgcaagctccttgaagataattcatccagccttattcatcttctattcctagtacccagcaaagagcctcaaatcaggaaggtgtcggtgaatatctgttgtcactgttttcttattccaatcccgtcacctgtgtctgggttattggtagcagtctcctgtctggcctcttgggatgcgttctcaacaggctccaccctcactctctctgaaggtatttcatgtcacttcatcgcttaagctgcctgatgacttccttctgaacgccaccttgtttaaatttatcagcttagttttcaaagctccctactgcaaaacaaagcagcaaacataagaagccgtgttttctcatttctccttgccagcaacatttcacaaagcccctgactcttaccgcaggcagctctttcgctcttcagaaagaagctttgaagacacgacaggacagagtacacgcccctctccctcctccaccccgtcatctcctgcctgagtcactacattccttaaaagataaatgacccgagttttggccttttcctatatgcaagataacatctgatgggattagcgatgatgcctctgtaatctataagcaggattactctcacacccacactctgatgtgagtctgctttaatgtgactcctaagcaagttcaatgtgattttgcatgtgctgaacccatttcccccaaacagaaaatcacagtctcgcaaatgtatccttctctcttctctcttacttcctacctaaactggaatattctccttttcccctcctccactgaaatcccactgtctcattcaagaatcattctttcactgccagagacttcatgggtattttttaatttattttttattttttgagacagagtctttctttgtcacccaggctggagtgcagtggcgcgacctcggctcactgcaacctctgactccctggttcaagcgattctcctgcctcagcctcccgagtagctgggattacaggcgtgtgccaccatgcccagctaattttttgtatttttagtagagacggggtttcactgtgttagccaggatggtctcgatctcctgacctcgtgatccacctgccttggcctcccaagtgctgggattacaggcatgagccaccgcgcccggccatgggtctttcttagactctttgtgtgccaaataactccgccttggtatacggtcctgggcagcagtcattctcctgactatgaagtgatgcttcgggagggcagtcatcagttaagaggcttttggttgcaagtaagaaacagcccaatccagagtggcataatcaataaggggaattattggctcacagagctgaggcctagagtagcagcactgcctgcaggcaggactcagtactgtcaccgagaacctattttcagctgggcgttggggtgcatggctgtagtccgagctccttggaagactgaggcaaaagcatcccttgagcccaggagtttgaggccagcctgggcaaccctgtctcaaaacaaacaaacaaaccaaccctctatttcctgaggtctatcctctctttctctgggaatagcttcagtgttcccaaaaggctgtcagaggctctcagaactatcagctttcttattcaggcataggaagaaagagaaagcctatatcccaggattcccaaccaaagtctccagattcctgctgattggagaggttcaggaacacgccactgcctgaccaacccctggggccagacggggatggaaggggtgactgacacccactctacccctggaggtgggtactttggcctccctatccacatggatctgccaactgaaacaggacctggtagaagcggggtatgaatgtgggggagacacatccaaacgtgcctgcataccaggcatataaccagtgcacagtgactggcagaggcctccaaatacgagcccctcccacaagcagaatctggacttctgttcctttgttgccagtgtccacacctctcactccaaatggtcacaacacctctgctcctcaacagagtcctgcctgttatagacaaacaggcccacacctttggttattttggtttagactagggacaaattctatcctagagtccccaggccgccagtggctcccccattcctgcctctagtgtgtacagggaggacgccctcagtttctgcggaggtggctcctccctcacaggagtctcctgggatccgtgagggcttcccaccaccactgactcttccagcagtggagcagcctgagctttggagaactgaggctacactggcctttttcccttcttcctcctcctcttctctccaaagggaaacctggagaacaccccctcccccatcacttcctgccccacccctacctcccaaggcctcctgtccccctctccgcatgctcggtgcactcactggccacagacgacagcgtccccaggctgcacccatggtaaccggcgtggcaaccaggagtcggttgggctgagaccctgagccccaactgtcagaaggagcctgaggctgaggtggaggctgggagtttggggctgtgggtaagtccttgtggggtcagacctgtggacttgggcaggggcagaccctcacggggctctggtgggctgcagcagtgcggcttgatcttgggccctggtggcagctgtctcctctgaacagggctggaaaggggatggacggccctgagatctcagcttgcctgaggccagaactagccttgtaggtggccggggaggaggaaggaggaaaaawactaacataagttgagctgctgaatacgccaggtgctttccatgtattctatcctgagtgtaactggagagcagaggttaagtgagcacacagccagcaggctgtaggggaggatttaaagctgggctgctctaaactcacagcacttgctcttccaatcccttccctgtttcctgagtggaggttcccaaggcaggtgactcaaagaggaaactgtgagagtttgtggragcaggtagggccgtgcatggactcaactgtccccagaggcagctaactgcagagctragccctgcctcgccccggtggccactgcttgcttcaagctgcagctcaggtaatggtggtgcctattctcaggtggatcctctgaaggccatggaatcctccacggggcccaggatgcctttgctcaaatactgcagcgtggccacaagcctgaaggcccctggctgggacggtgctgctccaccttgggacctctccttcacctacccctttgccctccaagcrccstggctcaccgggcacaagccccttgcaaggtacctgtctctgcccctctgggggaagtrgatgcccttttctttttcctttgttcttggctgttggtggtagaccttggtggacagacttgcttcctgagaaggtggaaaggggtcttcattgtttggcctatgattggcatatctgtgtggggtctgtcactccagcctacattgtgctcccagagccctccagggttgatctggctttagcagagttgcagatgctgcagttggcatgagtaagagaaggcagttagggatagccagttaccaagtttatagctcattttaccatcaatgctgagacttggctgggcgcagtggctcacacctgtatacaatcccagcactttggaaggccgaggcaagcagatcacttgaggtcaggagttcgagtccagtctgaccaacatggcaaaaccccatctactaaaaacacacaaaaaattggctgggcatggtggctcatgcctgtaatcccagcactttgggaggccaaggcaggtggttcacccaaggtcaggagttcgagaccagcgtggccaagatggtgaaaccccgtctctactaaaaatataaaaattagccaggcatggtggcgggtgactgtaatcccagctactcaggaggatgaggcagagaattgcttgaactcggaaggtggaaaggttgcagtgagccgagatcgcaccattgcactccagcctgggtgacagagtgagactctgtctcaaagaaaaaacaataattagctgggcgtggtggcacatgcctgtattcccagctactcaggaggctgaggcaggaaaattgcttgaactcgggaggcagaggttgcagtgagccgagacagcgccactgcgctcgagcctagggaacagagtgagactctgtctcaaaaacaaaacaaaaccaaaaaaaaaaaaaatgagacttgctcagccaccatatgagaaatcagctaatgtggggtctccaggtccctcttcaggttccctcggtacccctcctttgtccaggattttcctgaataggatcctcagtctgctttctaaagcgtggatacaagaggccaaaggcaccacagccctatatacacatgtggagcgtgtcatctccagggactcgcattcctgctgcctgatccattctgcccacattagggacatgccagcttgaaagatccttaatggctccctttcgtgatccacccggtggaccatcctgttcaaggctagagttaagcatgggactttagatgccaacaagcacaggaaggaggctgaggggggctgagggcagctcagcatgggtctgcaggagctcctcagcacgaacagcctgggtgcagtgacggcatgttgatggcagcaggaggcagacaggccccctttgcattcagccttgcccacaaagtaaaatggcttcttcaaaaacccaaaccctgactcaacaactcccctaggccaactggccctgaccacaacattttctggaactagcatctcctttttctgtcccacagccccttagctcctctgggttgtccctgcccaaacacttcctcatccctctgaccccacagcatcaagtggcattacaatttcacaccctcggcattactatccaagcttccacgcctcatcctggaatcccacacgccgccttaggattgacctacctggcactttttttttttttttttttttttttgagacagagtctcgctctgtcaccaggctggagtacagtggcgcaatcttggctcactgcaacctccgcctcctgggttcaagcgattcttctgcctcagcctcctgagtagctgagactacaggcacccaccaccacgcccacctaatttttgtatttttagtagaggtggggtttcaccgtgttgtccagatagtctcgatctcttgacctcgtgatccgcccatctcggcctcccaaagtgctgggattacaggtgtgagccactgctcccggcccctggcactcttttcttttcttttttttgataggggtctcaccttgtcacccaggctggagtgcagtagtgtcatttcagcccactgcaacctctacctcccagattcaagcaatcctcctatctcagcctcccaagtagctgggatcacaggctcacaccaccacacccagctaattttttgtatttttggtagagatgggatttcaccatgttgcccaggctggtcttgaatttctgagctcaagtgatccatccacatcggcctcccaaagtgctgggattacaggcttgagccacacttttccagtctgttgtctagtgtaggaacaagcatcaattaacttgaatgtatcaaggcgaattacattttggttgccttgaaccaactcccaatccaccaaggatggttcccttcactgtcctctccttctgcccctcccggaggtttaccttatccttccggaagtcatagattgccactttccatatggatttctgttccgcatgcctcatgtgctgtggtgtacctcagatgtacctgcgaaacgtgtttcttgatgtgtttagggcttgttgctctctatccactaattccatttgcttttttccaggcatgcctcttcttgcccatgtctccacgttgccgacccagcatggcaggggcctggctggctgggaagagctggagatgctgccaacacatgggtcctagcaagaagggaagcagatggtttttactaccgggcccaaataaaggccactcccgaggcaagtccctgaccccagtatctccctggcgtgctcctctgggtggccttgtcatacctgacatgccttagctgtgtacatctagcaggctggtttcttgcataagcacagctctcccatggccatgttgtagaagtgaacatgtaataccattgagtgtattagtttgctagggctccctaacaaagtgcaacaaacggagtggcttaaaccacagaaatgtgtcatctcccatttctggaggctggaagtccaggggttggcaaggttggttccttctgagagctatgaagaagaatcattcccatgccctgcttctggcttctcatggcttgctggcaggctttggtgttcctcagcttatagaggcatcgccttgatctctgcctttacctttatggggctttctccctgagtgtgtgtctgcccacatttccccctttataaggacatcartcacactggattagggacctgccatattcagtcctcatcttaattacatttgcaatgcccctatccacaaataaggtcacattctgggggctaggacttcaacatatgaatttggcagggggcaaggcatgttggctcatgcctgtaatcccagcactttgagaggtggtggtgggaggattgcttgaggccaggagttcaagaccagcctgggcaacacagtgagaccctgtctctacaaaaaatttaaaaatgagccaggcatggtggcacatggctgtagtcgcagctacttgggaggctcaggcaggaagatcacttgagccccaaactgatggcatcattgcactccagcctgtgggaggagggtggaggtgggtaacgggacacaattcaatgcataacagagaagaaagtgtactttaaaagtactttgttgcggaaaattcagtgtgttgaatgaacactagcctaagggaaaggtggaacgagatatgtttgctcacatgcatgggtgtgtgctggtacagagaagcacactctcgccatgctgggggccaggcctggcctgtacttcagtggctactcacttcttttttttttctttttttcagagtcagacttactttgtgaatgtagattcatgaagggaagactagtgtaaattctttaaaaatatgaatttcagaatttccaatcaaaagtcagtttttggccaggtgcggttgctcacacctgtaataacagcactttgggaaaccaagaagggtgggttacctgagatcagaaattcgagaccagcctggccaacgtggtgacaccccgtctctactaaatatacaaaaattagctgagccaggtggkgggctcctgtagtcccagctgctcgggaacctgagacaggagaatcgcttgaacccaggaggcagaggttgcagtgaaccaagatcacgccattgcactctagcctgggtgacgagcgaaactccgtctggaaaaaacaaaaaaaagtcaattttcaagtaactaatatgtgaattaaaatgaaattctagcaaagctttgctcaaatataggttctgtccagtgatttggtaaaaataatttataaccagagtttatttctcttctaaatcacagagtacttgaaacagcttgtacttttaagtagctgcagcactgttctctcacttttgctattcatttgcttagctaaccctttcctcgttgactgcaagggcagtgctgagggcagctctgtggccacaatcgctccttgcctacatgagcctcataggtgaacaaccatcctgttggtcttggacacatccctggttggtcttggacacaggagcgacgcttcttgggggtgcrggaaggaggagattgcattgagaaaaggtccagggaggacccaggtaactcctggcaattgcaggtcaaaaatttggtaggaggaaagaaaaccaggcaaaggaagggaatggaaaggcagaggcaggaagtgatccacaagagttgcccgaggcaggaagagattcaggggagcacaaccgtgccacacagcctgcctgtcttggctttgactggcttgaagcagcatctgccctgtcccttctttaggtgcctgtcactgtttggaaggcagcccctgggcctgatttggggggcatcgtagggaacctgggtgctccctattgtactttgtaatgccaggtcttattctgagtgttttctttcccacagctggagagacagggggtcctgcttgtggaattcgaggctccwcttgtcgcaggcccaaagctgccagcccagcagcagagagtggtcttagaagaggatgtcattcytctctcaccatctgtrggatactcactgagaccaggggataaggtgctggcactctgggagccaggccaacagcagtatggccctggcactgttcttttgggcttggagatgagagatccccagagaggtaagagaagctgctctgacccatcagtgcccagaaggagccaggctgtaatcaggccagaggagagagccaaggctgcgtctacagcttaggggtttctaaggcattaagaagagaatttttcccccttgcttgctgcttaatcttgagggcagcaacagatgcctcaagatgcacagtgtatctttcagattattaaaaaaaaaattgtaatcagggtaaatggcctaaaactctcatatctatgttggttagctaaaccatggtttagctactcacaacccagccctcaccaggtcctccagggaccagacagtcctcttctgcagggtcagtcagcaccattgtaattcagagaatgacagaatgaggcttctactgagaatgcattttggttttgacaagaaaagtgagcccctgcaggccacyrtagtccaggaggcagggaggctcaggcaagtccttgggaagtggaggtaactatggtgcaggtgaaggatgttcctggcaggctctccacggagaggtgcatgtgaggagccacgcagccagagcagcggggccaggctgaagctctgcctttgcctgtgtgggtaggagaggctttatcccatgatyaggacgtggaagctacttcggaggctgaggcaggaggatggcttgagcctgrgaggttgaggctgcagtgagctatcactgtgccactgcactccagcctgagccagaccctgtctcaaaaaaaaaaaaaaaaaaagaaaagaaaaaaagaaaaaagaaaaaaaaggagataattggtaattataacaaaatgttgccattttttgttatgtagcatcaaaggaaaaagaaatcactgttcatttctggaatggcaaagctgctaaagtgcccctaggtgggstccagtcggtgtccctgaccatctggaagaaggctgtggagaggctgcacaagtctttcaccagggagcaccccaggccccttcactgggccccttgctgctctctgctagggccaatcactgggcgcatcactaatgagcttcctccggatgctccattcctgtgccctctctgccaccatcatgcctgctgccagctactgtgccagggctgcctctgtggctgcccgccatgtggcacgacttggtggcctctaaccaggacctcagaagtcatggccagagaacttccagagttggagsccacagcacagcttttgcccctggaaggtcctaaagaggagaaagtagcaatgcacgctcccctggctgtttcttcctcctcatcctcctcctgtgaacaaganggtgtggagaatgatctggagatgggccctccccagagactgatggtgaacagtgcagtcaacacagatcccatctttcttgagatgcctctgagacagagtggcctctgccagcctgagtggaggtattggaagagaaacgggcctgagccatgccytgggaagccaggtataccaggggagtgggcttgctttctaaggcaggggctggggccccgcctcccttccmtcccacatgtcccttaggaatttgatgcacgtgtccactctgttgggactgcagtaatccttgggagtctggtcatgctgaagaggaggctgtggcaagagggaaatagcaggtttccatttcagctatgaggcccaaaggagcagaaggatgaactgatctttgtgctaaggttgcatccctatttaatacctgcctttttctttcttcactagtctctactgatagagcactgccattgtctgtttttagtctcctccttttttcttggaggccttggtttttctctagatgaacagtccaaatgcctccaggtgttgatcagagttgatgcactgaagcatagaaactggtcttgagcattggtcgtgaggccccactctcctgctggttccctcagtaagtgagcggggaggacccgggcactgcgatgtgcttcttatccctcatggccaacagggaagccgtgtcctgttgctgctggcagtctgcagccagccccacactgcatcgcctccagctgagaactgtgtggcgggccctgctaggttcggggagcccatcctatctaaattcccaacggagtctggaaagagcagaagcctgtcagagctgtgtgaaggaggtggcctggaaaagtctggcccttgacaagattctgggagtcctggggtcactgaacgtatctggggcagggaggctgtgaggtgaaggaacaccactgctaagggcttagatctctaggcactgcccacactgggacccactgggggtccctggttgaaaccatagccctatttctaggacagccactgagccagaaggactgctcagcccatgagggtttttgttgttgttgttgttgttgttgttttgagacagagtctcactctgttgcccaggctggagtgcagtggcatgattttggctcactgcaacctctgcctcccaggttcgagtgattctcatgcctcagcctccccagtagctgggattataggtgcatgccaccatgcctggctaactttttgtatttttagtggagatggggttttgccatgttggccaggcaggtctcgaacccctggcctaagtgatctgcctgcctcggcctcccaaagtgctgggattacaggcgtgaaccaccaagctggcaccaatgaagatttaaatcttgccccaagggtaaggattttattagtgttcagttccaggaagttgagaaattgtttgtaatgagmagctttcctggtgactcctctgaacccctgggctttgggaggggtggggaggagtgtgtctgctgcacttggattttatatgaggatttttcccctatctctcmtaggcccagctgtgctcttcctccactctccaggaggaaactttgtattgaaaacataaaatggggaggtgggtcctgggcttctgtgaaatgggttactccaatcttgcaatggcaagccttggcagcagccactcagaaatggcgatttcgctgggcacagtggctcacccagcactttgggaggccggggggtgggggtggggggtggatcacttgaggtcaggggtttgagaccagcctgaccaacaaagtgaaaccccgtctctactaaaaatacaaaaattagccaggcattgtgatgcacgtctgtaatcccagctagttgggaggctgaggtatgagaatcagttgaagctgggaggcagggtaagccactacactccagcctgggcgacacagcgagactctgtctgcaaaaataaaaaaaaagaaaagaaagaaatgccggtttctttctccattcgaaagaaatgaagttatggagaatttagcatgaaaactctagagtttggcaccattttctttatattatcacttgtagagagggcataaagaagatggcaccgaactctagagttttcatgctaaattctccatagctcccaatgcctcttgctccagcacagcttggagaaagaagagctgtacctacccaacagagaggggtctgtggggagcaactgagacagtgccaagcccagcataggggagagggacaaccagaggggccatggaggccagacataccctagataccacgtctgtgttcccattgctgtgacttgctccatagcaaactctagaagggttccaaacctgattaagtccaaacaaatttcccctggccctaagtttacacagctcttactgctactgcccaaagccacttacacctacagtctctctccatcaccacatttaaagagatccactccaaagttattttctcccctgaaataaattctattaattgactataaagaagataactatagtatcttcaggtacttggccgggctttcctgttaaatactggatcttgtgttatgctctagggaaagttcctggggctgacccatgagcatcatcagtatgttcccaaatatatggagagcatgcccgagagggggtgtggagacatggccatcccccgccctcaccacatgtgtgggactacctgctcactagtgaagagaagcacagaaaaccagggtcagggctgaaacaaggcaaacaccagagctttgcttttctcccctccaggttttgtatcttttaaaggaaatgtgctgttttgcttctcctaaacatgcttgatgtttaatcagttcttgctatcaggacttgatatccgttctgtcgagtgctgatgcttgacactcaattttgagctttgcctctcacaaaagctcttgcataggtttctctgtcctccacactttcccttactttcagttacaggcagtgagaggttacaattagatcctaatagtcctagggaggccagattgtgagctgctggcagggaggtactttctgcctcctttgactgaaacaggattcaatctgtagttttaaaagaaacgtaaaaagcattccttcccttttagattggtctattcctcaggaagtcacatctcccattatttttgttttgccccaattttttttttatttttagagacagggtctcactatgtcacccaggctggtgggcagtggcacgatcatagctcactgcagcctcaaactcctgggctcaagcaatcctcccacctcagcctcccaaatagtygggactacaggtgtgcaccaatgcacccagttcaatttcttaatatttgttttctatcagcttgtaatctcttctttgtggtctgtgttatcagtgatcagtgaaggtgtcgaagctcctttaactggtggcagtcagttacctttgcttgccctactggcagtttagaagacacatccaataacttcttcacaactccaaatcttgggtatcaggtaatgtttcccaaaagcataaggtccagaaatgataacaatttttttctctaaaaatagaaaacattacatggacacattgcatgatggcaaaagaaaacaggccaggtgtagtggcttatacctgtaactgcaacactttgggaggctgaggctggaggatctcttgagcccaggagttcaagaccagcctgggcaacatagtgagaccgtttctacaaaaaactaaacaattagctgagcatggtggtgtgcgcctgtggtcccagctactgggggctgtagtgaagagcgggtggcaggtgggaggatgacttgagcccgggtggctgaggctgcagtgagctatgatcatgccactgcattccagcctgggtgataatagcaagaccctgtctcaaatacataataaatgaaaagaaaacaatgcttgagcttacagatacttcagtgatccttgttttagttctacttatgccatcaaaatggtggcatattcaacctaagtaattgacttttgggtttaggaacaagatattccaacatctgcaaagaagaaaaggatcacaaacagcagagagcacaaactgnagtagtggggactaccaaggagctggtctcgaaagcaacccacatgaagccaccgcrgaccccgccaggggaagctgaacacagaaagcggagtcagagccttgcaatatgtcagtggaacaagaattcccgttagactaagagccctgaggatctaggtaaagcagaatggctggaaaggggcttcctaaggactcctcacatgggtcttagaccttttgggtcacatcccctttgagaacagtaaaacctatgaccccttgtcctagaaaaatgcacataccctcaattttgcatgtaatttcagaaggcttatggaacccatgaanttaatcacaggcttcttgggggtgcaaggatccccgtttaaatgaccctctgttctatggtattgggtaggggtctgctttattaggccctctgaatatggagtctattcctcactaagaatgataatatagccctacttaaactttatttccattatataaaatactggcacctttcccaaggaaaggtttgtgttcaaaatgagagaatcaccaggcaacgaaactgggagatgtcacagtactgctgtggcagcttcaagacatttgggacacagcaatgacttttttttctgagacaggatctcactctgtcactcaggctggaatgcagtggcataatcatggctcactacagccttgaactcctgggctcaagtgagccgcccacctgagcctcctgagtagctaggacctgagtagctaggcacatgccaccacacctgactaaattttttactttttgtagagatagggtctcactgtgttgaccaggctggtcttgattactaggctcaagtgatcttcctgccttggtttcccaaaatgttgggattacaggtatgagccaccgcactcggccacaatcaatgactttttaaaatcagtgacttttgattcttaaaattgcagtcagcataacaatgtatggaatttttcccccttttataggtaaagaataaacatggtaaatattcgaggagagttatacagagtggctgacaaggccttcttcaacggaaggaggcagaggacaggccacaggtaacagtcaaataaccaccagtatctccaccccacgaagacctccctgcagataagcagcaggaaggcacctgttgtgagggctataggaatgtgggatcctgccctggggctccctgccagggccctggtgaaactgctttaagatgcctcttccgtggaagagggggtcagcctgctttgggcaaatgtgtccacagccactctgccaccttcccataaagcctagttgtacatgagtgacattttgtttcacctcttaataaaaatgaattctcttcatttccaaatctctttattatcataattaacctttacttggaaagcaagcagtaaaacctgttcagacagcatcattatattactttcaggcaaacaagcgtggaggacctctacaccctcaagttaaaaaaggcactgaggccgggcgcggtggctcacgcctgtaatcccaacactttgggaggccaaggtgggtggatcacgaggtcaagagatcgagaccatcctggccaacatggtgaaaccccgtctctactaaaaatacaaaaaaaatagccgggcatggtggcgggtgcctgtagtgccagctactcgggaggctgaggcaggagaatggtgtgaacccgggaggcggaacttgcrgtgagccgagatcacgccactgcactccagcctgggcaacagagygagactgtctcaaaaaamaaccaaccaaacaaacaaaaaagcactgaaagagacagactccagttcccggaaggctgacccagtcagcactaaaaacaggattaatgtatagctattaagagaatcatacagtggctttattcttactacttaaaaaaaggtgatgtgatggcagtgatggtcaacatcacacagggaagaccaggtccacgctttgtccagaatcaactgctaccacatgagtcttcttggttaagtcatttgagcccacagtgacagaataggtccctggatatacttctatgtagaggtccttagagatgttctcagcctagaaggaaaagaggatattagcagtttagagattttataccccagtgccaccatggccccccagcaggctacctgtccttgcagaggtgtgatggaatgaagcgctaatgtgggagacagaggtcctgctttcaaggctcagcctgctcacgtacaacactgtcattttggtaggtctcagcctttccttatttctagcactgtgataatacctcacaaataagcatgtgaaaacactctgtaaatgctaaagtgttatatgaacatgaaggattataaaaagaacactctacttggagttaggcagaaggaaaggctagaggccactgttttggggatcagaagtagacagtggcacttagcacagatgagcagtaatgacaaggtactcgggagtgatgagagccattcttttaaacggtgctttgctaagttcactatcaggaagatgacaggcatttcttttgtcctaaagctcagaacaatttgagtgaattccattttgtcactgaagcagcaattcagctggctgacaaaactctcccttggaggactggttctcccagagtacaaaacactggaagccagagttaatggaaagattttatttagagccgaactgagcacaatcagtcttccaagggtagacttcactcatggctggtagattacatcaggtgtgcaggcagaggatgggtctcagttcaaatggtaaaaggacaaagtcacaaaccagaagagagcctgtaattaagggccagagtgacacctgggatgccattacaagcttgcttaatgctgagaaggggccataggcagaagttgtcgattccactaccacacacaggaaaagccaaactactggccagcaaattgcactcagaggaataaatgatcatgtttacatttttatgaaatttcccctcttcctcctaccttgcagatggatttgaagccaattttttccaaagctgttttatgttgtattctttcatgcctgtccagttactgcgaaattggaagtctaccatcctttaactgacgtaaatgtgtatgacaatgtcattaactatttattggttgtcaaccatgtaaataaaagtcacttttagaaaatatggttatatcagaattgcagaaagccaaggatgcttcatttgcacacaaggaaacatagaggtaaggttggcatgtggctgtagaactccaacacggtggaacatcagcattaccaaaagtcagcaagtgttgagaggcgtctaagccttaacaacttatatttgtactagaagcagaatattcttaattgtcactaactctagtatactccaaatcctgactcgtagcaaaccgtatacaaacaaaaagtaaatgtattgcggcaccatgctgaatgaagttcctttcctcagaattctagcccttccaagttccaaaaaggatcccctggcttcatgacctaatgagtactttatcctaaaaatgaaaaactcattatatgtttttacagagaaacatttgtggaaaataagaacaaatgccttcaaatgttttggaacctgatctcaccaaatgtgtatgtttcggaatttcagcaatggttttcactttgttagcaggaggatcgtgcccctcctgctgcttgaacagatggtggaattccagcaggacccagtgccagcccagctgagctgtaggaactgagaggtgaatacttcacattctttccaaccacaactatgagttcaggcacaaagagtatccctgaagcttagagtgaaggaagaataccaagaaaacctaattttacactgaaccaaaatcttgtgtgcccttcttaagtgtaagaacatctcaacttaaaaatactatagactcaattcaaatagccctctaagaaccatgtcaactggttcatggagttgcaacggtggtgaaacccagtgcgtaagcagttccgtactcacaggctgggatgcctctggagcatgctctgatatttgatagctgcctccaggaccaagggatgtcttttttctgtcttttctctgaagagacaagtagaacactgatttgtgcccaagctttcacttttggattgtaaagagaagttctcttctaccttattaggagttagtaattgttctgtcagctttttctaagttgtcatctaagtcattaaggcatttttaagtgaattctgtgaggtatttttagtcaggtatttactataattttcatccttacatgggctttggaatcagccacgcctgagtttaagtcctatctctgctatttactaagacagattaacttctcttgaaccttggttttccagtctgtaacatggcactcttggattgcagggaaaatttaaagtgcaaaagtggcacttaggctctcaatacattctcttctgtgcttcttctaggagtgggggtggtcctagaagggaacaggctgactgataaagccaatttcccttagagggaacttacattttaaagggagagatgggaacgactcttccccacatgtacctaagtgcaccctttagggtcaggtgcgtttaggtaagagttcaggctaggccagaaaagggggctcaggactcaagctctggcaccactactcacctcccaggccaggggaggcatgtgggaggtgcttcgagtgtgcactcagcccttgctcatgtccctgtgcccactctcccatccttttcctaaacttcctccctctaacaccccaaaatggctgacagaccaaagaagtcaggaatccaacttagactctggaatagactctggacttcagtttgctatctttgagtacaagtagggtaggttaaaacaaaagcaaaaacctagtctcctcagaaaccaccaccaccacctcctcctttgaatcagttcaataagcagaatctttggcttccccagaatgacatgtggtaaaaggtaagtttgtagtgagaggcccgtaactgttattacctttacaaaaagtattttgttaaaagagacccccgtccccacacttcccttgtactttctttttaaaaattatgaaagacaggggccaggcatggtggctcacgcctgtaatctcagcactttgggaggctgaggcaggcagatcacctgaggtcaggagttcaagacctgcctggccaacacggtgaaactctgtctctattaaaaaatacaaaaatgggtcaggcgcggtgggttacacctgtaatcccagcactttgggaggccgaggcaggcggatcacgaggtcgggagatcgagaccatcctggctaacacagcgaaaccccgtctccactaaaaatacaaaaaattagccaggcgtggtggcaacgcctgtagtcccagctactcggggctgaggcagaagaatggcgtgaaccagggaggcagagcttgcagtgagctgagattgtgccactgcactccagcccgggcaacagagcaagactgtgtctccacaaaaaaaaaaaaaaaaaaagaaagaaaaatacaaaaattagctgggctggtggtgtgtgcacgtagtcccagctacttgggaggctgaggcagaattgtctgaacctgggaggcagaagttgcagtgagccgcgatcgcaccactgcactccaccttgggtgacagagtgagactccctctcaaaaaaaaaaaaaaattaccaaagacatgacagttatcaccttatagtaaaaaatgtaattattaaaaatcttttcccccagcctgggcaacatagcaaaaccccatctctattaaaaacattaaaaattagctgggtgtggtggcatgtgcctgtagtcccagctacttgggaggttcaggtgggaggatcacctgcccaggaagtcaaggctgcagtaagccatgattgctccactgcactctagcctgggtgacagagtaagaccctgtctcaaaaaaaaaaaaaaaaaaaaaaagaaaaaaaaatcctatccctagatgtagaagaggatatttagagctcttttaaaaaaaaattagagaaagggtctatgttgcccaggatagaatgcaggggatagtcacaggggcgatcattgcatacaccacattccaggcttggaagctcttttctttaaacctgctggagaatcccatggcccaggactgcaggttcaactaaagatcctacagtggcatcaatcttatatttttgacaacctcctatttcatgttcattgctgtaagttctctaaggctatgaatttacacatttctgttaagcactgtaatgccaagtcacacgggcatccagtgacacaaagtctagcaggggctcttgaatatagggtgtcatatcttggtagactgaaggcatggtgcaggacagttgagtacacttacctgaccattccctatgtccaagcacatgtgcagcttcgactcgcctctgtgataacgatagacatgggttgcccctccttcctctggcacagatgaataatatttctagagacgtaatgtcaaagatgttagctaaccaaattgtcttgtcaaattttcaaaaaaccctgatatttgggcaaagtgcagttaaggagggaggcaagagagcaaaggtgaattacctgccctcttgacaggcctctgaagtcatgcaacaaaccttagcccacccaaagtggctgcagagaaagaaatgcatttggcatccccgtgctgccacctgctgcctccatagggcaagaacgctggctaactaaaggtgggcaggaccatgctctctgccaggttaaacaaatttcacatctttgcccccatgtccaatgcacatatcctttcatttcctcccctaaaaaatgtggatgaacggttccatgtttattgtctaagtctcagaccaggacacgggaagagaggggtacattttcctgagatttagaaacacagcaggaaatgaaacaaacccaagagctgctctgcagcccttttctctgtgcttcctgcgcgtgggggagtggagggagaagtctctaatttaagaagaatcttccgaaagatcggaaaacagttacatttctcttgtctgcttccttcctccccctcaaagttagccttagacttgcccttgataatgactaatgacatcacagccctgcttgttttgaacagggtaggcacactgtctaaaaaacatgtgaccagaagaacgagaagctggggaaagcacttgaggacacagacctaaagatgtgttttagtggctgcttcaaactgtggagacaaacccagtacacaattcttaattctatctctagaaagccaagaggttctgaggctccatttcataacagagacttgaactgaagcatgaactgaaaacaaaaatgaagaacagcaatttgctaaacctcaaaccaaagacaaatattattccttttgctgaaccatgaaccaagggtttaatcactttacagtagagttgaggctattgatttttgtaaaaccactgaacaacacaaataagataaaaatattccctgaagtattcctctttggttggaatcctattcttggagtcagggattcttataaaagatgtagaaagattagagttttttgagatcttaacatatgaaactgaaaagcagggcagaaacaaggtattctcttccatctcctttgtggatcagcctccttaaaaccatgtaggactcaccaagtgttaagactgcatgaggccagagcctgctgtaattcctagaagacagtgccttccatgcaggtaatttccttgaatgttttctggcctgccctcaacattccctaagtatcgaaagatgacttggctgggtatggtggctcaagcctgtaatcccagcactttgggaggccaagatgcgcggatccctcgaggtcaggcgttccagagcagcctggccaacatggtgaagccctgtctctactaaaaatacaaaaattagccaggcatggtg

SEQ ID NO: 10697 - DNA, 20930 bp, Homo sapiens
  misc_feature (1)...(20930): n = A,T,C or G, or insertion/deletion polymorphism (see Tables 1-2)
aaaaacccaatattgttaagattgcaattcttcctcaattaatctgtgaattcaatataatctctatcaaaacatcaacagttgttacacagaagttgacaaactgaatttaaattttatggaaataatgactgtactagaatataaaaataattttgaaaatgaagaacatagttgatatacttcccaatttccaaacttactacaaaactacaataatcaatacagtataatatggcataaggacagacatatagatcaatagaacataatttaaagtctaaaagctaactcttacatttatggtgaattgatttttgacaaagttgccaagggaatttaatgagaaaaggatagtcttttatacaaatgatactgagaaaattgaacatctgcatgaaaagaaatgaatctagacccttacctcataatgcacataaaaattaatgcaaaatggcatagagttaaatgtaaaaactaaaatatacaactattaggaggaaacatagaaaaaatcttcaaaaaaaattttcatgaccttaggttaggcaaagatttcttagatataacaccaaaagcacaatttataaaggaaaaaaattaataagttggagttcatcaaaactttaaatgttagtacttcaaattacaccactaagaaaatgaaatacatgacacagcctgggagaaaatacttatgaatcatacatctggtgtgggtgcggcggctcaagtctgtattcccaagagaaatgaaaacatgtgtccacacaaagtcttactatgcattatcagtcaaaatagccccaaaccagaaacatttcagatgaccatcaaccagtaaatggataaacaaaatgtaatatattcatataacgggatagtattcagtcataaaaaagaatgaagtattgatacatgctacgacatgtgtgagcctcaaaaacattatgctaattaaaagaagccaggcaaaaaaaggtcacatattatcagattccatctatatgaattgtccagaaaaggcgaattcataagacagcaagcagaagactggtcacctaggaccagaggcaggagctgagaactgactgcatatggtatacactagggatttttctcaggtaatgacagtgttccaaaactgcactttggtgatgttgacaactctgtaaatttacaaaaaatactgaaatatacacttaagacaggtaaattttatcatatgtacattatacctcaataaagaagtcttttttttctttttttttttttttttgagatggagtctcgctctgtcacccaggctggggtgcagtggcgcgaccttggctcactgcaagctctgcctctcaggttcacgccgttctcctgcctcagcctcccctgggactacaggctcctgccaccacgcccagctaattttttgtatttttaatagagatggggtttcaccgtgttagccaggatggtctcaatctcctggcctcgtgatctgcccatctcagcctcccaaagtgctgggattacaggtgtgagccaccgcgcccagccaagaagtcttcaaaaaaaaaaaaaaaaaaactctacataaatttcaactgtttatattaaatatcttccaaatactattcctttgatctctgacttttaaaaatgacaagatttcaatcattcctgctctgcaaccaatttttttaactcccagtcaattttaaacagattgtgaaagttaattctcagaagtttgattcattttctttaatctacatcatcaagatgacaattttgataatgagtttctttcattcccccaataacccagtgagatgatgtaatcaggcaaaatgaatgatctaatgactcagtctgtaatactaccttacaaagctgtgatgattccaaagctcttaagtctgctggagaaataacaataccatttgtcaaataaaatgatttatacagtttctggtatgtacagtataaatcactgtctaactctggcacagtacccacttttgcatcctgggtttttaaccctttttggccctcttcacataaagaaaaggaatttacattgctcttcactggacttgtttttctcctcaaaaagtcccaaatacagcaccagtctctttccccatttcacaattaaagacctcttccaacgcatctcctccaaaacatagaaccctgacaactaactttcatctgttctcattagtgaatttacccttgtgaagatagaagtcattaaaaactcatatcaatagtttatttttctgtcaatactgacagtctatttccctgttgaccaggcacattcctaattagttgccctctctccatttacaattccattttcagttctcaccagtggctttcatttggcgtgggctatatttgatccacaaggggcctgatggtaggtcatgttctatcattattcccagccaatcttaaaaaagataaaaaggaatctctcaagtctctcaatctgtggtttacaggatgaatctttaaaattataaatatgcacatataaaaatatatttacaaatatatttacaaatagaaaaataaaaacaaatgcaaagatttaatttagagtcttttggtttcagtttcatttcaagcatcttctttcccataaatttctaaatgttaaattctgagaaaatgtagttacaattgaatattcattacattcattaaagttcatgtaggtaggtgtttttttaatagaaaagccaactcttttttttcttaagataggttcttactctgttgccccggctggagggcagtggcacgatcatagctcactgcagcctcaacatcctggactcaagcaatcctcccatctcaacctcccgagtagctaggactacaggtatgagccaccatgccaggctagttttttaattttttaaaaaatagagacaggggtctcactatgttgcccaggctgctgtcaaactcctggcctcaagtaatccttccacctcaacctcctgaacttctgggattacaggtgtgagccaccacaaagccacctctttatgtgggctaacagaagtctatttaacttaaaaattaaatcagagtaatttcaacaaatggctactgaacacccgctacttaacaggtcctggaatgtttagggacaaataaggaacagtttctgccttcaaggaattgaaaggctattgggagagaagaaaccataactacacataatttaaattagattggaaaagtacacacaaaaaatttttttaaggctatggcaacagaggtggcaactgggaaccactgggaaaagtttcaaagagctgacctgacaaaaagaaagtagtgcctcaactggaatgactaaaatagaatggggaagagagacaaatgagatgaggtgtggctatgatactgggtaagtgagagcatattttgggagaccaggctgaagcttaagataataatactagctaatatttattgagcacctactatgtaccaagtactataaatgcactttatagatattaacttacttgatattcacaataaccctatgaggaatgtgctaaaaccttgaaatccataaaaaataaagaggaccaaattctgtcccactccaaccacacttattgtaaaagcagttaacaggtatcttatctacctcttctctcactgattcctaggccatccttcaaggcctagcttgaaaactacattctctgcaaaacctttcttgatcctcccagctgaacatagtctcctaagcttgatagcattttatctgtgtcaatcttatggcatgtccgaatattttgttcttggtattatagattttatgtgcattctttcctcttttttattctcctttagtctgatccacattctgttctccacaactcctagggcagtgcctggcacatactaatgctagctaagtctatggagcacttatctttgccgggcactgtgctaagcattttacaggaattatctcacagaatcctaatggcaacccaattcacacattcaagggctatttttagtccttactgtgacagacaaaatagtaaatactagatgcaccttaaactctaaacactacagatacagtcccttccctcaagaagctcagtctaaagaagttagtactattggaatccccagatatagagatgaggaaaagtgaggctcaaagaagtaatatgtttgcccagaaccacagagcaaaaaagtggcagagagcctgggcaacatagggagaccctgtctctacgaaacatttaaaaaatttgcagggcgtggtggctgaagaagaggatcgcttgagcccaggaggtcgaggctgcagtgagccgagatcgtgccactgcacttcagcctggctgacagggtgataccctcgtttctttattaaacaaaaaagaagaagaaggaagaaggaagaagaggaagaagaggaagaggaaggaggaggaggaggaagaagaaggagaaggagaaggagaaggagaaggagaagaaatggaaaaaaaaagatggcagagccagaattcaaaccagctctcccgagtggatatacaggaccccatgcacgtataaccactatgttctaaaggaggcacttgataaacccttattgaaggaaatgttttggaataccaataaaatgaaaaaaaaatcatctcaagaataatgtagggtttcactcactgttattcttttttataaggggaaagcaggaaatttgcaaaagttaagtagcatagaaggaggtcgtattggtcggctactactcacctggtacctgataattgctcatcaagccatctgttgagactaggtgaggatggagtttctctcctttttcatgaaccacagaggagacttaaaggaggatttatttgtgttccttaaagtgacccccactgagcgtgtccctcaaagtggaccttcctaagcatcggcgctttgctttgcgctgggtggtgcggctgagtcactaattagcagtgagagcctgggctgtatctcctaccaaataaccagcggagtggagtgacaggtccttacttaaacatggtttaagtaagcattcacagttccttacttaaacatggtgcagtcttcctaaaagatggagtcagaccccaagagaacaggtctccaaaaatatgtgaatccgtacttcccactggaggggagagagagctgcgctgagggattatgagagaccctacaacttctcaggcgccccctgccccgggggccaggaacatctgcagacagccccgcctccgtctcgcctcaatcccgagctgttcccttctccaaaggccaccttggcagccacacagtttggcctaatcacctcctcaaacaagagtagcgacaccccaaaatgtagaccaagcagaaagaggcgcgggaggcacttgccttattccccatgatgtttttgttttgagacgaagtcttcctctgtcgcccaggctggagtgcagtggcgcgatctcgtctcactgcaacctccgcttcccgggttcaagcgatcctcccacctcgaccctcccgagtacctgggactacagatgcgcgccaccactcctcctactgtgtgtgtgtgtggacacgggttgtcgctatgttgcctacctagctggtaccccataaccactcctggctagtgtgtgtgtgtgtgtgtggacacgggttgtcgctatgttgcctacctagctggtaccccataaccactcctggctagtgtgtgtgtgtgtgtgtgtgtgtgtgtctacacgggttctcgctatgttgcctacctagctggtaccccataattttttagctcaacaggagacctgcctttatacccaccaagttaagcagcgcagtagccctctaagggccagccccacgcccagaggctcctctgacagcgtggacagatgccctgggctgctggctcgactcagtcctcagcccccagcccccgacccccgacccccgacccccggcccccgacccccgacccccggcccccagcgcccggcgccccgcctccagcgctcagcagttaaccaggcaactcgcgcgcagacgccaaggctgggacgcagaaggcgtgtttggccgcccagccgccccgcctcccccacttctcccgcctctcccgcctctcccgccttccgccaatggcccagctgcgccggcgccgccgggagcgctaggcctggtccctcttcctaggatagcgttgcgcgcatgcgccttgacgagtgagccgggtgagggggctccctaagtagcggaaggggtagatgaaaatggaaggggygggcgcgctaggcctagtcctggctgggctcccgctggagtgtgcgttgggggcggaccaggagcggtggtctccagggaggtygaggctggggctcccacccggatttggagcagggtcgccgcggcccagctgacccgccggcgtttgtacgttgtgtgcccactcagggagccatggacamctgtttggcggccgcagcgctgaatggggtggaccgacgttccctgcagcgttcagcaargctggctctagaagtgctggagagggccaagaggagggcggtggactggcatgccctggagcgtcccaaaggctgcatgggggtccttgcccgggaggcgccccacctagagaaacagccggcagccggcccgcagcgcgttctcccgggagaggtgagggtcgctgtgccgggggccgccccagtccttcgcgccgcggtagcccgctgggagccaggggtgcgcagcgcagaagcagctgaggaaaccttcccttagcggaagctggaaaggatcagaacaatgaatggaaaagtcctttcaaaacgctttacatttgacagattcttgttgggtagctgtagaataacggtagtgttcagccctggttggttacttaaaaaaaaaaaaaaaaaattagccgggcgcggtggctcatgcctgcaatcccagcactttgggaggccgaggcgggcggatcacctgaggtcgggagttcgaaagcagcctgaccaacatggagaaatcccgtctctactaaaaatacaaaattagccgggcgtggtggcgcatgtctgtaatcccaggtactagggaggctgaggcaggagaatcgcttgaacccgggaggcggaggtcgcggtgagccgagatcgcgccattgcactccagcctgggcaacaagagcgaaacctccgtctcaaaaaaaaaaaaaaaaaaaatcttacagctatcatctgataatagaggaaagcctgcaagcctgtctcttagatcctggataaattgcatgtctatcttttagagktggaattctttctcaataacatcgttctttctgacataaacttgcagagcctttccaaaagtaaaaaggagactatttccaaaatggcttcattctccagtagggaatcctagagctaacctgtgacgtgccatttattcaaatagagagaagagagacccccaacccttagtgcttccttcagaacaatggctgaattcatggactatacttcaagtcagtgtggggtaagttggtgtgaaccaaanctatgccccatcacctgctgatggaccacatttggatctttctggaatttacggagaatctggacactacctgtttctcctgcccagccttcacggtcagattgtaatcagtcaaggacttaaaccagggggtaaatccaagttagaattcacccaataaatgtttattgaatgcctaaccctgtagctgacaatatagcaatgaaaagtcagaaaaggtcttctgccctcagtgatctttcagtctagtggggggaaaatagcttatttgccgaatttcatagcaaataagttaaatattaggggttttttttaactttttttttttttttttttttttgagacagaggcttgctctgtggcacaggctggagtgcagtggtgcgatctcggctcactgcaagctctccctcctgggttcacaccattctcctgcctcagcctccctagtagctgggactacaggcgcccaccaccacgcccagctaatttttttttttgtatttttagtagagacggggtttcactgtgttacccaggatggtctccatctcctgacctcgtgatccgcccgcctcagcctcccaaagtgctgggattacaggtgtgagccaccgtgcccgaccttttttttttttttttaattgagacagagtctcactccatcacccaggctggtgtgcagtggctcagtctcggctcactgcaacccctacctcctggcctcctggttcaagcgattctcctgcctcagcctcccgagtagctgggactacaggcacatgccaccatgcctggctaatttttgtatttttagtagagacagggcttcaccatgttggccaggctgcyctggaacgcctgacctcgagggatccgcgcatcttgrcctcccaaagtgctgggattacaggcttgagccaccatacccagccaagtcatctttcgatacttagggaatgttgagggcaggccagaaaacattcaaggaaattacctgcatggaaggcactgtcttctaggaattacagcaggctctggcctcatgcagtcttaacacttggtgagtcctmcatggttttaaggaggctgatccacaaaggagatggaagagaataccttgtttctgccctgcttttcagtttcatatgttaagatctcaaaaaactctaatctttctacatcttttataagaatccctgactccaagaataggattccaaccaaagaggaatacttcagggaatatttttatcttatttgtgttgttcagtggttttacaaaaatcaatagcctcaactctactgtaaagtgattaaacccttggttcatggttcagcaaaaggaataatatttgtctttggtttgaggtttagcaaattgctgttcttcatttttgttttcagttcatgcttcagttcaagtctctgttatgaaatggagcctcagaacctcttggctttctagagatagaattaagaattgtgtactgggtttgtctccacagtttgaagcagccactaaaacacatctttaggtctgtgtcctcaagtgctttccccagcttctcgttcttctggtcacatgttttttagacagtgtgcctaccctgttcaaaacaagcagggctgtgatgtcattagtcattatcaagggcaagtctaaggctaactttgagggggaggaaggaagcagacaagagaaatgtaactgttttccgatctttcggaagattcttcttaaattagagacttctccctccactcccccacgcgcaggaagcacagagaaaagggctgcagagcagctcttgggtttgtttcatttcctgctgtgtttctaaatctcaggaaaatgtacccctctcttcccgtgtcctggtctgagacttagacaataaacatggaaccgttcatccacattttttaggggaggaaatgaaaggatatgtgcattggacatgggggcaaagatgtgaaatttgtttaacctggcagagagcatggtcctgcccacctttagttagccagcgttcttgccctatggaggcagcaggtggcagcacggggatgccaaatgcatttctttctctgcagccactttgggtgggctaaggtttgttgcatgacttcagaggcctgtcaagagggcaggtaattcacctttgctctcttgcctccctccttaactgcactttgcccaaatatcagggttttttgaaaatttgacaagacaatttggttagctaacatctttgacattacgtctctagaaatattattcatctgtgccagaggaaggaggggcaacccatgtctatcgttatcacagaggcgagtcgaagctgcacatgtgcttggacayagggaatggtcaggtaagtgtactcaactgtcctgcaccatgccttcagtctaccaagatatgacaccctatattcaagagcccctgctagactttgtgtcactggatgcccgtgtgacttggcattacagtgcttaacagaaatgtgtaaattcatagccttagagaacttacagcaatgaacatgaaataggaggttgtcaaaaatataagattgatgccactgtaggatctttagttgaacctgcagtcctgggccatgggattctccagcaggtttaaagaaaagagcttccaagcctggaatgtggtgtatgcaatgatcgcccctgtgactatcccctgcattctatcctgggcaacatagaccctttctctaatttttttttaaaagagctctaaatatcctcttctacatctagggataggatttttttttctttttttttttttttttttttttgagacagggtcttactctgtcacccaggctagagtgcagtggagcaatcatggctyactgcagccttgacttcctgggcaggtgatcctcccacctgaacctcccaagtagctgggactacaggcacatgccaccacacccagctaatttttaatgtttttaatagagatggggttttgctatgttgcccaggctgggggaaaagatttttaataattacattttttactataaggtgataactgtcatgtctttggtaatttttttttttttttgagagggagtctcactctgtcacccaaggtggagtgcagtggtgcgatcgcggctcactgcaacttctgcctcccaggttcagacaattctgcctcagcctcccaagtagctgggactacgtgcacacaccaccagcccagctaatttttgtatttttctttctttytttttttttttttttgtggagacacagtcttgctctgttgcccgggctggagtgcagtggcacaatctcagctcactgcaagctctgcctccctggttcacgccattcttctgcctcagccccgagtagctgggactacaggcgttgccaccacgcctggctaattttttgtatttttagtggagacggggtttcgctgtgttagccaggatggtctcgatctcccgacctcgtgatccgcctgcctcggcctcccaaagtgctgggattacaggtgtaacccaccgcgcctgacccatttttgtattttttaatagagacagagtttcaccgtgttggccaggcaggtcttgaactcctgacctcaggtgatctgcctgcctcagcctcccaaagtgctgagattacaggcgtgagccaccatgcctggcccctgtctttcataatttttaaaaagaaagtacaagggaagtgtggggacgggggtctcttttaacaaaatactttttgtaaaggtaataacagttacgggcctctcactacaaacttaccttttaccacatgtcattctggggaagccaaagattctgcttattgaactgattcaaaggaggaggtggtggtggtggtttctgaggagactaggtttttgcttttgttttaacctaccctacttgtactcaaagatagcaaactgaagtccagagtctattccagagtctaagttggattcctgacttctttggtctgtcanccattttggggtgttagagggaggaagtttaggaaaaggatgggagagtgggcacagggacatgagcaagggctgagtgcacactcgaagcacctcccacatgcctcccctggcctgggaggtgagtagtggtgccagagcttgagtcctgagcccccttttctggcctagcctgaactcttacctaaacgcacctgaccctaaagggtgcacttaggtacatgtggggaagagtcgttcccatctctccctttaaaatgtaagttccctctaagggaaattggctttatcagtcagcctgttcccttctaggaccacccccactcctagaagaagcacagaagagaatgtattgagagcctaagtgccacttttgcactttaaattttccctgcaatccaagagtgccatgttacagactggaaaaccaaggttcaagagaagttaatctgtcttagtaaatagcagagataggacttaaactcaggcgtggctgattccaaagcccatgtaaggatgaaaattatagtaaatacctgactaaaaatacctcacagaattcacttaaaaatgccttaatgacttagatgacaacttagaaaaagctgacagaacaattactaactcctaataaggtagaagagaacttctctttacaatccraaagtgaaagcttgggcacaaatcagtgttcnacttgtctcttcagagaaaagacagaaaaaagacatcccttggtcctggaggcagctatcaaatatcagagcatgctccagaggcatcccagcctgtgagtacggaactgcttaygcactgggtttcaccaccgttgcaactccatgaaccagttgacatggttcttagagggctatttgaattgagtctatagtatttttaagttgagatgttcttacacttaagaagggcacacaagattttggttcagtgtaaaattaggttttcttggtattcttccttcactctaagcttcagggatactctttgtgcctgaactcatagttgtggttggaaagaatgtgaagtattcacctctcagttcctacagctcagctgggctggcactgggtcctgctggaattccaccatctgttcaagcagcaggaggggcacgatcctcctgctaacaaagtgaaaaccattgctgaaattccgaaacatacacatttggtgagatcaggttccaaaacatttgaaggcatttgttcttattttccacaaatgtttctctgtaaaaacatataatgagtttttcatttttaggataaagtactcattaggtcatgaagccaggggatcctttttggaacttggaagggctagaattctgaggaaaggaacttcattcagcatggtgccgcaatacatttactttttgtttgtatacggtttgctacgagtcaggatttggagtatactagagttagtgacaattaagaatattctgcttctagtacaaatataagttgttaaggcttagacncctctcaacacttgctgacttttggtaatgctgatgttccaccgtgttggagttctacagccacatgccaaccttacctctatgtttccttgtgtgcaaatgaagcatccttggctttctgcaattctgatataaccatattttctaaaagtgacttttatttacatggttgacaaccaataaatagttaatgacattgtcatacacatttacgtcagttaaaggatggtagacttccaatttcgcagtaactggacaggcrtgaaagaatacaacataaaacagctttggaaaaaattggcttcaaatccatctgcaaggtaggaggaagaggggaaatttcataaaaatgtaaacatgatcatttattcctctgagtgcaatttgctggccagtagtttggcttttcctgtgtgtggtagtggaatcgacaacttctgcctatggccccttctcagcattaagcaagcttgtaatggcatcccaggtgtcactctggcccttaattacaggctctcttctgntttgtgactttgtccttttaccatttgaactgagacccatcctctgcctgcacacctgatgtaatctaccagccatgagtgaagtctacccttggaagactgattgtgctcagttcggctctaaataaaatctttccattaactctggcttccagtgttttgtactctgggagaaccagtcctccaagggagagttttgtcagccagctgaattgctgcttcagtgacaaaatggaattcactcaaattgttctgagctttaggacaaaagaaatgcctgtcatcttcctgatagtgaacttagcaaagcaccgtttaaaagaatggctctcatcactcccgagtaccttgtcattactgctcatctgtgctaagtgccactgtctacttctgatccccaaaacagtggcctctagcctttccttctgcctaactccaagtagagtgttctttttataatccttcatgttcatataacactttagcatttacagagtgttttcacatgcttatttgtgaggtattatcacagtgctagaaataaggaaaggctgagacctaccaaaatgacagtgttgtacgtgagcaggctgagccttgaaagcaggacctctgtctcccacattagcgcttcattccatcacacctctgcaaggacaggtagcctgctggggggccatggtggcactggggtataaaatctctaaactgctaatatcctcttttccttctaggctgagaacatctctaaggacctctacatagaagtatatccagggacctattctgtcactgtgggctcaaatgacttaaccaagaagactcatgtggtagcagttgattctggacaaagcgtggacctggtcttccctgtgtgatgttgaccatcactgccatcacatcacctttttttaagtagtaagaataaagccactgtatgattctcttaatagctatacattaatcctgtttttagtgctgactgggtcagccttccgggaactggagtctgtctctttcagtgcttttttgtttgtttggttggttkttttttgagacagtctcrctctgttgcccaggctggagtgcagtggcgtgatctcggctcacygcaagttccgcctcccgggttcacaccattctcctgcctcagcctcccgagtagctggcactacaggcacccgccaccatgcccggctattttttttgtatttttagtagagacggggtttcaccatgttggccaggatggtctcgatctcttgacctcgtgatccacccaccttggcctcccaaagtgttgggattacaggcgtgagccaccgcgcccggcctcagtgccttttttaacttgagggtgtagaggtcctccacgcttgtttgcctgaaagtaatataatgatgctgtctgaacaggttttactgcttgctttccaagtaaaggttaattatgataataaagagatttggaaatgaagagaattcatttttattaagaggtgaaacaaaatgtcactcatgtacaactaggctttatgggaaggtggcagagtggctgtggacacatttgcccaaagcaggctgaccccctcttccacggaagaggcatcttaaagcagtttcaccagggccctggcagggagccccagggcaggatcccacattcctatagccctcacaacaggtgccttcctgctgcttatctgcagggaggtcttcgtggggtggagatactggtggttatttgactgttacctgtggcctgtcctctgcctccttccgttgaagaaggccttgtcagccactctgtataactctcctcgaatatttaccatgtttattctttacctataaaagggggaaaaattccatacattgttatgctgactgcaattttaagaatcaaaagtcactgattttaaaaagtcattgattgtggccgagtgcggtggctcatacctgtaatcccaacattttgggaaaccaaggcaggaagatcacttgagcctagtaatcaagaccagcctggtcaacacagtgagaccctatctctacaaaaagtaaaaaatttagtcaggtgtggtggcatgtgcctagctactcaggtcctagctactcaggaggctcaggtgggcggctcacttgagcccaggagttcaaggctgtagtgagccatgattatgccactgcattccagcctgagtgacagagtgagatcctgtctcagaaaaaaaagtcattgctgtgtcccaaatgtcttgaagctgccacagcagtactgtgacatctcccagtttcgttgcctggtgattctctcattttgaacacaaacctttccttgggaaaggtgccagtattttatataatggaaataaagtttaagtagggctatattatcattcttagtgaggaatagactccatattcagagggcctaataaagcagacccctacccaataccatagaacagagggtcatttaaacggggatccttgcacccccaagaagcctgtgattaaattcatgggttccataagccttctgaaattacatgcaaaattgagggtatgtgcatttttctaggacaaggggtcataggttttactgttctcaaaggggatgtgacccaaaaggtctaagacccatgtgaggagtccttaggaagcccctttccagccattctgctttacctagatcctcagggctcttagtctaacgggaattcttgttccactgacatattgcaaggctctgactccgctttctgtgttcagcttcccctggcggggtccgcggtggcttcatgtgggttgctttcgagaccagctccttggtagtccccactactacagtttgtgctctctgctgtttgtgatccttttcttctttgcagatgttggaatatcttgttcctaaacccaaaagtcaattacttaggttgaatatgccaccattttgatggcataagtagaactaaaacaaggatcactgaagtatctgtaagctcaagcattgttttcttttcatttattatgtatttgagacagggtcttgctattatcacccaggctggaatgcagtggcatgatcatagctcactgcagcctcagccacccgggctcaagtcatcctcccacctgccacccgctcttcactacagcccccagtagctgggaccacaggcgcacaccaccatgctcagctaattgtttagttttttgtagaaacggtctcactatgttgcccaggctggtcttgaactcctgggctcaagagatcctccagcctcagcctcccaaagtgttgcagttacaggtataagccactacacctggcctgttttcttttgccatcatgcaatgtgtccatgtaatgttttctatttttagagaaaaaaattgttatcatttctggaccttatgcttttgggaaacattacctgatacccaagatttggagttgtgaagaagttattggatgtgtcttctaaactgccagtagggcaagcaaaggtaactgactgccaccagttaaaggagcttcgacaccttcactgatcactgataacacagaccacaaagaagagattacaagctgatagaaaacaaatattaagaaattgaactgggtgcattggtgcacacctgtagtcccgactatttgggaggctgaggtgggaggattgcttgagcccaggagtttgaggctgcagtgagctatgatcgtgccactgcccaccagcctgggtgacatagtgagaccctgtctctaaaaataaaaaaaaaattggggcaaaacaaaaataatgggagatgtgacttcctgaggaatagaccaatctaaaagggaaggaatgctttttacgtttcttttaaaactacagattgaatcctgtttcagtcaaaggaggcagaaagtacctccctgccagcagctcacaatctggcctccctaggactattaggatctaattgtaacctctcactgcctgtaactgaaagtaagggaaagtgtggaggacagagaaacctatgcaagagcttttgtgagaggcaaagctcaaaattgagtgtcaagcatcagcactcgacagaacggatatcaagtcctgatagcaagaactgattaaacatcaagcatgtttaggagaagcaaaacagcacatttcctttaaaagatacaaaacctggaggggagaaaagcaaagctctggtgtttgccttgtttcagccctgaccctggttttctgtgcttctcttcactagtgagcaggtagtcccacacatgtggtgagggcgggggatggccatgtctccacaccccctctcgggcatgctctccatatatttgggaacatactgatgatgctcatgggtcagccccaggaactttccctagagcataacacaagatccagtatttaacaggaaagcccggccaagtacctgaagatactatagttatcttctttatagtcaattaatagaatttatttcaggggagaaaataactttggagtggatctctttaaatgtggtgatggagagagactgtaggtgtaagtggctttgggcagtagcagtaagagctgtgtaaacttagggccaggggaaatttgtttggacttaatcaggtttggaacccttctagagtttgctatggagcaagtcacagcaatgggaacacagacgtggtatctagggtatgtctggcctccatggcccctctggttgtccctctcccctatgctgggcttggcactgtctcagttgctccccacagacccctctctgttgggtaggtacagctcttctttctccaagctgtgctggagcaagaggcattgggagctatggagaatttagcatgaaaactctagagttcggtgccatcttctttatgccctctctacaagtgataatataaagaaaatggtgccaaactctagagttttcatgctaaattctccataacttcatttctttcgaatggagaaagaaaccggcatttctttcttttctttttttttatttttgcagacagagtctcgctgtgtcgcccaggctggagtgtagtggcttaccctgcctcccagcttcaactgattctcatacctcagcctcccaactagctgggattacagacgtgcatcacaatgcctggctaatttttgtatttttagtagagacggggtttcactttgttggtcaggctggtctcaaacccctgacctcaagtgatccaccccccacccccaccccccggcctcccaaagtgctgggtgagccactgtgcccagcgaaatcgccatttctgagtggctgctgccaaggcttgccattgcaagattggagtaacccatttcacagaagcccaggacccacctccccattttatgttttcaatacaaagtttcctcctggagagtggaggaagagcacagctgggcctakgagagataggggaaaaatcctcatataaaatccaagtgcagcagacacactcctccccacccctcccaaagcccaggggttcagaggagtcaccaggaaagcttctcattacaaacaatttctcaacttcctggaactgaacactaataaaatccttacccttggggcaagatttaaatcttcattggtgccagcttggtggttcacgcctgtaatcccagcactttgggaggccgaggcaggcagatcacttaggccaggggttcgagacctgcctggccaacatggcaaaaccccatctccactaaaaatacaaaaagttagccaggcatggtggcatgcacctataatcccagctactggggaggctgaggcatgagaatcactcgaacctgggaggcagaggttgcagtgagccaaaatcatgccactgcactccagcctgggcaacagagtgagactctgtctcaaaacaacaacaacaacaacaacaacaaaaaccctcatgggctgagcagtccttctggctcagtggctgtcctagaaatagggctatggtttcaaccagggacccccagtgggtcccagtgtgggcagtgcctagagatctaagcccttagcagtggtgttccttcacctcacagcctccctgccccagatacgttcagtgaccccaggactcccagaatcttgtcaagggccagacttttccaggccacctccttcacacagctctgacaggcttctgctctttccagactccgttgggaatttagataggatgggctccccgaacctagcagggcccgccacacagttctcagctggaggcgatgcagtgtggggctggctgcagactgccagcagcaacaggacacggcttccctgttggccatgagggataagaagcacatcgcagtgcccgggtcctccccgctcacttactgagggaaccagcaggagagtggggcctcacgaccaatgctcaagaccagtttctatgcttcagtgcatcaactctgatcaacacctggaggcatttggactgttcatctagagaaaaaccaaggcctccaagaaaaaaggaggagactaaaaacagacaatggcagtgctctatcagtagagactagtgaagaaagaaaaaggcaggtattaaatagggatgcaaccttagcacaaagatcagttcatccttctgctcctttgggcctcatagctgaaatggaaacctgctatttccctcttgccacagcctcctcttcagcatgaccagactcccaaggattactgcagtcccaacagagtggacacgtgcatcaaattcctaagggacatgtgggagggaagggaggcggggccccagcccctgccttagaaagcaagcccactcccctggtatacctggcttcccarggcatggctcaggcccgtttctcttccaatacctccactcaggctggcagaggccactctgtctcagaggcatctcaagaaagatgggatctgtgttgactgcactgttcaccatcagtctctggggagggcccatctccagatcattctccacaccatcttgttcacaggaggaggatgaggaggaagaaacagccaggggagcgtgcattgctactttctcctctttaggaccttccaggggcaaaagctgtgctgtgggctccaactctggaagttctctggccatgacttctgaggtcctggttagaggccaccaagtcgtgccacatggcgggcagccacagaggcagccctggcacagtagctggcagcaggcatg

SEQ ID NO: 10698 - DNA, 96004 bp, Homo sapiens
gagaaaagtggagcacctcatgccattcattctatcttctttctctgccttcccctagaaaagcagcacaggagagaagcagagaggttgatggtggtgtgacaagggatggattatcatccatcccttgggtggagctggagtgcgggacacattgggggatctcagagaagtgaatgaagccagagggagtccatgaaaggccatgggtttctgtaactgctggctcggtggagaattgttctggaaaaatgacaagtttagaaaatgtcacccagctcctctaggatcaaggtttactgggttacaattgctcctgatttgggggacactatagaggctggagacttttaaataaagagccatcaaacaagcctcctctcaaggaggagagactgaagcaatttctggggagatcgcttggattggtggagaaaacattaatctcaaagtcatccctgtcaggaagtcctaaatctgaacccagggggagaagagtgttgacttgtaagagctctaagtcttttcatgaaattagtatgaagaccctaattaaagctggctggaaaacagccactaagagcacagaccatggtcagcaaaatctgggttcagtcttggctcatctgcccattaactgcaatcttggtcaaatcctttggcctttcctgagattgattttcttcatcttaaataatggagatagaaagaggacctaccatcacaggaaaatcaccatagggccctgctggttgtctgcagcaagtctgattgactgatgccccattctgattggttgcagcccaaaccgtaacaatcgctaaatatcttgactcctaaatatcactcttctgtagcttataggttgctgtgagaaataaataaaataatacaaggaaaatgcttagcttgacccaattactactagtatttgttatgggctgaattgtgtccccgctttccaaagaagacgtgttgaagtcctaaccccagaacctcagaatgtaaccttatttggaaatagggtcattgcagatataagtaatgaagttaagatgagatcatactggagtagagtggttcctctaatccattgtgactgctgtacttttaagaagacaactatatgaagaaacaaggagaayacagtgcacagacagaggcacagacgggagtgatgcacctacaagcagaggaatggcatgggatgctagcagccaccagcagctgggagaggggcatggggcagattctctctcagagacctagggaagaatcaaccctgctgatgcctgactttggacttctgccaccagaactatgagagaatatagttctgtcgttttaagccactcagtttgtgattatttgttacagcaaccctagggaactaatgccatattatagtgggttagctcctcaaaacccactaagaccaagaatttataaagtatcaggaaagagaagacctcaatgttcgttctagcccaatcgctcatctgatgcttaacatcccctcttcaacactctcattaagttgtgtttccgcttgtacctgaacacttccagtgaccaggaagtcactacttaccatgacacccaggtaactttcattattagcaatgctagtctgtattttgagctaaaatctgtttccttgtagattctcccatttggtggaaaccacttccctgggaccttttgccatatacttagcattttacaacccttcaaatatttgcattcatcgaacaagccatgctcttgcacatatcatagttttagcaaatgtaagttcttctgtgtgaaatgaactttggccttctccacctaaagaataatccattaaagtcaagtttggtattatcccctgatagggtaggttacgtggtgggaaaaagcaatccccaaatctgggcttcaaacaccaaaagattatttctcacatgacatgttctcacatgacatgtccactgtgagtcagcaggaaactctgtggtcactcagaggcccaggctggcagagcagagcagccaccatcttgaactctgccagtcacctccagagagagaaagctctagggtgtctcccatcagcaatgttaatgtaccagcccagaaaagacacacaccacttcctctcacaattcatcagccagaactagtgccatggcctcacttaaccaagacagggctggaagatgcagtcctggaaagccaggccagaaatatttggcaaacgacactgatggccaccccacccactttgcgtgcccctccctgcagcccccggcagagttgctagcatctcctccagccttctcagagcagctgatgtatttgttagccatggtaattatcacattgcattgtcgttatattgcttgtgttttcatctcctccatgaaaatgagagtttctcaaggacaggttagggcataatacatgtttgatatgtggatgcatttgagaacagtgaccatctatccagtgtaaaagccaaataacttacaggggtttacaaggctgggcatgacctggcccccactacttctctgaccttatctccccacagggctcccttgttcatttggccccagccacactatgtctcaaattcaccaggccggcccctgccttagagactcaaactcactgttccctcactatctattcagctcaccaccccacttctgtcgggtgtcctctcagctgtcagcttatcagagaagcctgtcctgaccatgccctatacaatgtcgacctgccctgttaacacccctgctccctccatagcagttaccacttcctgacacaaacacaaactcatgtgtgttgcattatcacatattaaatgtcacataatttctattatataatacattatgtatgacatatataattgtctgtggtatttatttatatgcccaacccacccacccacacacacttgaatgcaacttctataaagaaaaagaccagcatataataggtacttaataaatatctgtcaaatgaatgaatgataaatgaataaatgtaccccctgagtcttcacatctttgggccaaaatgctaaacttttccctctcatattataggattttgagtcccttcaacatcccaggcacctagaagtgatcaataatcagtgcagtaaagagtagaacaacatagacccttgtctatcttttatcctatattttaattaataaaacctacatttgaataagatttcgggagttacaaaaatcacaccgttgaccaactcatagcaagtttagttatcgactaaagtatttagtgtttttttacacataaagctgtacctttccccctctatgtaattttgtagctgtcactttggacctaaaagtgtaggacctaacatttttctctcttaatttccctgtcacttgtcttccttttcgttgataatgtcatttattcattcacttattttgagtgtcaactatgtgcaaaaaagctgttatgtgctacggggtgttatgtgatcattttccaattcccagaagaaaaagttatttagcaatatccacatggatcagataaacaaacttggattcaataagaaagatagccaagaccccgtctgtgtgtaaatgactgatagcagagctgtttctggagactttcaatgataggagggtagaagtgatgctcaagaaagtcacgcctagggaacctgaaagtgagaaggcgagtagagctttggatgagaggcggctttaggagcttacagttaggagggcaatttgattccaacatgtcactctacctatccccaaggtttatytaccttgtctggaagtgaccaacagatcatcatttcccacattgctccaaggatctcacccatctttggataaggctgtgttaaggattgggcttttctgctgtccacaaatggataacacatttcatatgttccagtgatttcagggaagtccttgactaggggaagaactggaacaattattccacttgtctgcaaacaatatttatttatgttagttaatgccaggttctgggtgaatattatacagataataattccattagccctccaaccttgtaagataagtaccattattatctccactttatagatagggaaactgaggcacagagagcttaagtgatcttcccacagctagaaaatgaaagagctgaggcttgaacctaaacagagactctataggctccagagtctatagtctcaacagctctgctctggtctgctccctgtccatattggaagcagggacagactatagtctagtatataatgcaagggctgaataataaggcatgattttatactaggcactaatacaggttactcctaataaaatcaaccctcaggcatttttttcagaactgaaatggaacagaccagtatctaacttgaggataatggagagggattaaattagttggagaatgatttaaccttttgctcactgagcattttctcatgaattcatctttccatccttccagggatctacttatccacttattcaacaactatgcactgagcactctcgccgtcctgaagcgacggtcacacattgcagataagacacggtctgaccgacaaggacttagcagtccaggtggggagaagcaggcaaaggaaacccacggtctagcatggcaagtgctgtcagaagtggggcctggaagagagggacatgaattcagcctgcatttgggagaatagcagaggaggcaggagggaaaagatgagagacaaatgcttatggagaaaagaacattgaatctgaccctagcaaaattttctaatcgcgatattcctgggaagatcttagaaattacacagtttccatcaaagacaagagaaaattgaacactcttttcaagaaaagccctgggacatagtaattgataacacaggttttggagtcagacctgcattcaaatcttaacctctcttggaagaacttcctccattagaagatggggctattcatagtgacccatcataaggttgtcctgagggtcatgtagactcctgtgtgaggggcacagcacagtctgtgctgagtgcaaatacagtaaatcctagttgtgaccttcttctccgacgaatagtcacactcacttggtcccttagtccttaatcttcttagtagctctaacttttagaaccaagttttgtaaatctcttttctgttttgcatagagaatacaaaaggaataaaatttctgtaaaactgatttgcatcccagtgagtttattgtactctatggttcttggtgactaggtaaccagcagaggagctaattcattattttaccaatttaaacaggaacttrgaagaaaagcacctggtggtcacagagcatgaggactatactgacaagaagattaaaagaaagttcagctcacacagccctagataatcacaaatgtacccaaggtttattaacaatcacaattacctggaactatattatttgcctggctggttattctgaagacaatttgtatggatagatgagctgagaggagctcatgaagttattttgaagtggctggcagagtccctttgcaataaatatctggggaaataggagaggacacccaaggctccctggtccaatttctcacctagaagtgaaaagaaactctgagttctcctcagaggaacagcccatccacagggccccagcccccagccctcatgtttcctccaagaaccatttgcccaccatgggaccagacctgtgtgttctagataagccttttgagaaaacaaaatagtatgcagaagcagtgtccattttcaggggtccagtcctttaaggaacaaagtcctgggcctttatgacattggcagccactgtcccttcctgacgcccccccttgaaaatctctggctgcctactcctgagctttgtaggcttgtgcagagccatggtgccaaggcataggtctcagaggttgtctctttccttggtttccgttgcagattcccacaactccatgctgtgtgctgcaggctggtcctgaacccagatctctggctgagaggatgggggcagatggggaaacagtggttctgaagaacatgctcattggcgtcaacctgatccttctgggctccatgatcaagccttcagagtgtcagctggaggtcaccacagaaagggtccagagacagtcagtggaggaggagggaggcattgccaactacaacacrtccagcaaagagcagcctgtggtcttcaaccacgtgtacaacattaaygtgcccttggacaacctctgctcctcagggctagaggcctctgctgagcaggaggtgagtgcagaagacgagactctggcagagtacatgggccagacctcagaccacgagagccaggtyacctttacacacaggatcaacttccccaaaaaggcctgtccatgtkccagttcagcccaggtgctgcaggagctgctgagccggatcgagatgctggagagggaggtgtcggtgctgcgagaccagtgcaacgccaactgctgccaagaaagtgctgccacaggtagagtccgggagctcrcagcgtggtctcaggaggggaaggagagggctgagcagagagggagagtgaacaagaaggaccaatgcacttccagcgaaaacgcactcccagcaaaaccccggcatctcttcacacggtcaaaggaaaaaagtgtcctagtctgtagctgccggttaatatgtctctaagatctaaatgcagttcttccccgagggattcagttcagggattttctacactgcatagccagtttgaaatacattaacctgattttggggggatgagtcaggtaatggttcatcggttcagcacagcaacttcgatggcgagcagggaatttgatgtctgtcttctttcatctttggttttcacaggctgttgaattgatatctatccatgttaacctgagggactagagaatgcagacgctctgttcactcaatcgcagcctttctcccatctgagtagatgatagtcattaaggtctcagaggacctatccccatcttctccagtgagatggaagctttagcacctgccccctcaaaaagcacacagaagcgtatgcacacacacacacacacacacwcwcwcacactctcacacacacatactctctctctcacgcatgcacacacgcatgctctcacacacaacacactcacacaacttagtgcaccctccaaaaggctgaaatctcaggggatttacttctaacattgcccaccccctaattagtaacccttgtgagttacctttacctctctgcaagacataattaagtcttcagagtcagaattcccaagttcagatcctggctctactgcttcctagctgatgacctaagcagttccatatctgtgccttcctttcctcatctacaaatggtgctagactagagcaacaagaagttattaacaataaaagcacctattcagatgtcagcctggcttctgtaagtamcgtataagcaacagctattatcggctgacgccaatgagtgggaactgtatctgtacccctttgtgcacaggttttctctcccaaaaggtaccttagaccccatgcaattcagttctttgatgacaagaggcatttgtcttgagttcaagcactcacctctataggatccatgatctcaaggctttcacggggatgaaagctggaggtggcagagtgaaattttaacagagcctggatggcccgcagatgtagaggggtacctgacacattcaccctgagacacagcaagtctagaggcagtcactgaggactaaaatatttcatgggttcctttcacctccttctcctcccaataaccaacactataaataaaacaatctgcagaacagaagagcaagtccagttctcctgtgcttcaatgacaatggtcaggtcagcttgtcttttcaatggagcaggagaataggggaaagtcctaggtttccatgagcatggactctgcagctcaggaagctggggcttctataagtgaactttttgccagccttccaccaggatccctggcaaacatgggaaaaatctgcaaggaagagctaagttaaataatgtcagtaaagtatattttcatgggggcggcatgaagtggcagaattaaacaaggatgtaacttactagacttcatatcctcaaggccaagtgcaaagaaggatgccagcaggtactccatttgtatttgtttaatacgtttacttgaatcatgctaggcagataaattaaccactgtagttatcccacagtaaggtctaggacagagacatgcgtagaatcccagaggggtcatagcaaacagtaactaaatgagagtgaggtcctggggagcctttgaagtaaccatggagctgggttttgatgaatgagcagagtgagtcagatggcaggcagggagggagcgagacaggtttgtaacacataagacctttctctgcacagtggactcagtgctcagcctatacctccttaggtccctcacaaaatcccatagccagcacctgggcatcctggtgagaaggctgtcctcagtttgttggaaacttcttgggctgcccagagagagaatgaggggctgggggattcgcatgccctcagggacatagaccttaacccacaatgagatgtgacctgcactgcccagagcaccctgcagaactgaacccaagtgactctyctggaacttggcttgataatgcacctgggcttgagcacgttcccttcccaaytttccactcttccctaccagttttttctgggaacaccttccaataaatcacttttacatgaatctttagcaaagacctacttctaaggaatccatcctaagacaccttaaaggtcagcttctggaggacaagggcccagatctcattcatctttgcccccagccctgtgctaggcacagacagcccatgctaggtgaaaatatttattaaattgaatatgtaccaaactacgttgagcttcactctcagcaacagaaatctggtcagagaatgagtagagaggcctttgcccatccttccccagcaccattgacaggagaggccactgctgctctttgaccttctccttgaccattccaggacaactggactatatccctcactgcagtggccacggcmactttagctttgagtcctgtggctgcatctgcaacgaaggctggtttggcaagaattgctcggagccctactgcccgctgggttgctccagccggggggtgtgtgtggatggccagtgcatctgtgacagcgagtacagcggggatgactgttccgaactccggtgcccaacagactgcagctcccgggggctctgcgtggacggggagtgtgtctgtgaagagccctacactggcgaggactgcagggaactgaggtgccctggggactgttcggggaaggggagatgtgccaacggtacctgtttatgcgaggagggctacgttggtgaggactgcggccagcggcagtgtctgaatgcctgcartgggcgaggacaatgtgaggaggggctctgcgtctgtgaagagggctaccagggccctgactgctcagcaggtaggcaggggaactctctggggtgtttggcaagggtggtccagcaaactagctggatgcctccagttagcttgggaagaaagatgagtgagaaagtgaagtttaggcaaaataattctcaattgagttgtactcatttgctttccaagagagctgagttcttgagtcttgatgaggcagattaaaagggataaagagtggaaataggaaaaggtcaagttcaggctgagagctggattgttacccctgagactaggaaaaaggtagtggtaacaatgatgacaacacttcattgcccttgaggtgggggagggtagacagtgaagtcatgggaccaccttaggcaaggccattctctaactctgagggatcccaagcgttccacctgctcaaaattrtctccctcaccagttgccatattccaggaatgccttccacaatgctactgcaagagatggtggttggtctgtgaggctctctgattatcttggagcttacagattgcaagatgttattaatttatgaagtgattccagtggggcagagtgtttttagacaaggacttaaatctaaacaggaataaagtactaaggacattgggcaacagctaacatgctaacaattagtacagaatattaagagtatgactcactttgttccagatgactatctagcaaattagaaccaaccctatgtatagtytacactgtcaaagctgatagaaggatgatgtactaaaatggggatctaaacccaacagtgagaaaaaaaaaaaaaagtatctcattggggctgattccctttttttttttttttttttttttktgagacggagtctcgctctgtcgcccaggccggaytgcggactgcagtggcrcaatctcggctcactgcaagctccgcttcccgggttcacgccattctcctgcctcagcctcccgagtagckgggactacaggcrcccrccaccgcgcccggstaattttttgtatttttagtagagacggggtttcaccttgttasccaggatggtctcgatctcctgacctcatgatccgcccgcctcggcctcccaaagtgctgggattacaggcgtgagccaccgcgcccggcctgattcccttttttatgcaaatcagattatgtttattatttcactatagctcatcctcttctgactaaatcagtgactactgctcatacatttgtttatgttttaaacagtacagattaagtggttggtcttttccattcagggctcagagagcccactgggattatttaaaataaaaaataacaacaaacaaacattttaaaccttctaatggagcaattttaggaatttgctgataagtcatgtgacatcagtttaagggggaaagcctggtaagccggattcaccagacttctgtaagccagagttactcactcctacgtggcaggcaatgttcccgcacatgtaacttcaacttaaattattttcaaaaatcaatgrtaataatgaaaagaaaaacaacaataatgcactgtgcttagggaaaaaaatttaatgttccttaattttttccatatccaattatttcatttagcctcccaattttgtttactgaattgaaatayctttctaaaaatattgtcaccacaccaattatcccaaagtgaaattcaagcagaagttaagccttattgtttctgaatccaaagtcactaggcaccttctgggaagccaggctgacaaatggctccagtttccatccaggggatgaggctccatgagaccccatctggaggacacccagggtcagtgtgggccatcgctgtgttaatgctattctgtagcgcacatgcttcttagtagacttactctttggcggtctggacatacctgtcatattcttgaccctgsctttctacagggataggttcatttgcaaacaaaatcttgatctaatccaggacttacactgaaccctcctggctacytcagggaagactcagcagctgctagcatagctacaactgggttgagtccaaactatgagcacgttacctctgacatggtacctctgtgctgcttgaggaacacttcaataggcccagataaattactttacaggttcccaaagcatgtgaagaaggacagttgcataatctccatctgtttctatagcaaccctagagccaccactcatttgcaggaggtctgctcttaaggcctgctttttaaaccaagtgctacaggtctcttccagagaagtatctaggtcattatctaaagtgctcctttgcttgctctttgtgaaaagactgtaggagaaggggctatttatccactgtttgacgttcctggccgggtgcacacaccacagcacgatgttcccattgcccatgggactgaggagaggagagagaagggttaggaaggtgaaaacactgagagccacaaaatatacttcgttatagggcattcttttctctttggcaagggcgtagaaaatagctgcccattgtgtggattgcattctgaggccccctaggtctgcagcacttaagcacaattgaatagtgttgccaaggtcactacttttgactcctagccttgatctatcctcatagtgtgccaagggacaaaatctcaagacttctgcctccattctctgcccatgtacagataatagaacaaaacattcatgaatatgagaacttaaaacaggccttagaaagaagcttctcattttacagatttaaaaagcagcagtcagtgagacagattttcccagagccagacagctaattaatggcsgagtaagaaaaagaatcctggtctcctaccagcttctagcactcttttatcttctctggaatgcaaagtagaatagaattgaaaaataaaaattttaaagccatatacacaaagaagtagccttttgatatgaaagctgagctccatcacatgattaaaaaaatgagacgtcagaggtagggtggaaaagcacattcaaccatttgtccacatctgtccccagtgatggtggttagtgctggggctggccagggagctggccaaaactcccccggagccagcaggataaaagaaccatcagaacagggtcttgagacaatccagaaagctgtttcctggacttcagtcagacctgcggagattcatcagtgtcagcctctgctctgtcaggactgcagccagcccaacctttggcacccgaaaccacttactctttggagtaagacacatcatggaactaattccaactgctctcaccacataagtgcaacatttatgcaaaatctaaagaggaaacagcatggcatctttgcagataagcaaccctgattcctcaagccacagtttattcctctttaacagcatgctcttcctcaagtttcaaagttgacaccccaaagaaagtaaggctaagaatactttgcacccaccgtgaattcattgaattaaggcatgaggctctttgattgtttgcagtacagttcaatataattttcttttataaggattactgatgcctagtgtacatagttgctgctaatttagagtgaaagtggtggtggtctcctccattgagccaccattgtcaagaccacttccacgaggaatgacgccagttgctgctttctcattcagaagtgtaggcaactttaccaccaggctcaggcctcaagctaagttgccaagatttttttaaaaatccttctgcacctcttttttttgctttaaaatcccaaaatgctcttcttagatcaccctctattgttaatattagctttgaagaaggaagcaaaaaggaatacgctgatttgttccaaatgccctaagaattgctggtgacttgaaatttggagtggccatttctgccactatgacagaagtcctgcataggaaacctggagttaatgtgttgaatcacaggagacaggcactagagaacctgtttaaaaagaattttcttacctgtaggatgagcaccagtctagagatcacacctattaagatcrtctgaattattcctaatatagtttactttgggacaccatgtataaatgaaaggaggcatctcgcgcaatctgtaacctgmtgtctaaattgtaggggaaagaatgaaaactgtagaacatcagggtttgacagtcagttctgctatgacccactctgacttttggcacatcccttaacctgggattcagtttcctcattggtaaagctgggataattatctctacatgaactacctcatatgactgctactaaatatttttttaaattcttgttagatggtatatatgaaaatagtttatagactgtgaaatgctatataaatgtaaagtggtattgtatattggctaagaaggtttatagtcattctgcctgcattctaatcctagcttctatgtttgctgactgtgtggcccaatttcgtcatctataaaatggtagtaataatgayaccttaatcccatggtgttggtgagagggtgaattgaaataatctatgtaamagtggttagcattgtacttggtacataataagtgctcagtataatcatgcaaaatcctgacaggttctaaatatcaactcttcttctcatggcctaggagtcattctgtatgtgttatataggttgtcccaaaggttttagtgaaattcaaagctttaataaggtcaaaactataggtgatacagtttataaaacatcatttgaaagcttatttaaatttcgtttacacttcttgagttttataaattttaaacaaaaattttttttaatttttgttttggtcaacatttgccatcctcaagaagctctgctttctagactgttttattcaatgaatggttttaggcaaaagtaattgaagcaaatgtccagcagtgcatatatatgctgctgattctatcctgtgagtcttggatctgttaaaggtctccttgtgtctctgtctttgctgaggatttgagggtgcacatgtgagtacaatgaggagacagcactctccactcacaaggtccagcaaaacacagctggcctcagcctacctggttgtaaaggggaggggtgagattacccaggggagaaattcaaaacctatgacaactcttaaactcatcgaagcctccactacatataaatttataagttaataatgaccatttaaatatcggcttgatctttgatttaatctatgggcaggtctaattacagacacactggagttagcctcttagttagtcttaaaggcttaattatttaatggccacaacactggtgaatcttcattttccaagacgatacacaaaagtctatttctctgtgttttaccctttggtgactccaagtagcatttgagaaatcagaagaaagtaaagcaaggtcctcaagaatgtttttttatcatcatcatctccaagattgaggctaataaaaattagtttaacacaagctagatttctttcagaacataagtggtctttaaaagggaaaattctacaataatgggctgttgagtgtcttcatcaggccgtggtatccaggacttactgttttggcttctcataatttgcaagataatcaggaatgagtctttatttccacttgccaaatcagatattggctcccagggtaatctgatgacgataacttattaaaccaccaaaaatgttggccagtggtgtgctgttaaatacctaacaacctggctccctaaaggaaaaaaatttaaaagccccgttgtgtagcatttgccagtttccatgatgtaaatactctctccatggccaatttcaattaccaacatgacgtcagtaaacatggagctggaaacagatgtgtagtagagtacaatcatagaatattttcaccagacagagcacacataaattatcttaaaggtacacataatagtaaaatgtagtcaaataatttgagagtgataaattttgaatatctattacctttrtttttaatataatttacttaagtattaggttataaaattgaatctttaataatggctgtattcaacgacagtcttgaaacagtcctgaaaatttgacaatcagcatttacaagccagtaggagctggctccagtgcatgttcatgaccttatagagattggggtactaagcaccaaaaagacaagagcckgctcacaaaggaagttacaaatcacttaaagccattgagcccagcaggacatatagacatggcatggggggtgagatgtgaggaagaaagttgagtccaggatggggaaggcaatcctctgagctcatgctatctgtgtattgcctcccggtagttgcccctccagaggacttgcgagtggctggtatcagcgacaggtccattgagctggaatgggacgggccgatggcagtgacggaatatgtgatctcttaccagccgacggccctggggggcctccagctccagcagcgggtgcctggagattggagtggtgtcaccatcacggagctggagccaggtctcacctacaacatcagcgtctacgctgtcattagcaacatcctcagccttcccatcactgccaaggtggccacccgtacgtaccatttcccygtcctgcttcatttttcttttctcctacatgagatcatgggcwttcatgatagtagcgtcttttcttagttcttcagggatgcctggaatagttattgcccttgaggggaagggctagagatgtgacccatttagaaagggtacatcattaaaaaggcactttcgattaagagagtttccaaattcaggcagctttcataaattatagaaccaaaaggacaaaaagtactttaattatggagtactggcttgttataagctagactctgactagaagtcaaggaaagtgtaagacatctacagactttgaatcagttagggatccaaaacaaggagatatgaactaggacctctaagaagcaagtgctaaatggtgtgttctcgaccataagtgtatagcaaagtgagaaaaaaatcttatttaaaaccacagctgacaacatccccttctcctgatagagaggtggcataatttcctcctggtcttttgtttagtgaaatatcttaatagttcattttagttataaaagttgaagccctagagcataatttagaaggattcacagggaagaaagagagagatggagacagaaagcaatctaaactgctctccataagaaatgaacagttttttttatacataaagggaaacttctgtgggtgtgtacctatattttgtgtatgttcaagcatagaaaaatataaaagattacataacaattattaacactgactacatcacagagtagaataagaaggagataggaaataattattatatttttctttatacccctctgaattcttaaattgatacaataagcctgttttagtttagaatttcaaaagccaggcagaataatttaggcaagagaagttctcatcaccccaagtctactgcaaaacctgcatgcacacaatgcctctgtgccttatgtggaaagtctttggagagatcatgaaaaaggggctgtatctgattaaaatstgggaagagagaagagaacattcaaaggagatgaggtatgagtgatacagagatttttagcaataccaagaaagtggaacaagaagtaaccatgaaaacataagccctctagaattcagaaagcccccrggccagtaaataggacttaccaccagataaggggtaagagatctgagcccattttgtgtaggtagatggtattcaggtaacaaatgccacgaaagttcagaaaaggaaaaggtcaaggtagraagatttagccttgaaatcttcatggaagctccaggactgaattgacctttgaaggatgcaaggatagagacaggcagaggggaaggaatttaagaagtcatcttgtccccttgcttttcaggtgacagaaattctgctataattttggactccgctatgagaagagtgctgactctgttaatatgcctataattatctctgtttatatttgaccttttttwaaaaaaaaaatcctctggtgcctgagaactggttttaaatatctgcaatgattgtgcagagaggcaggtcaccatctgccgcttttcccaccttgctccgggatgagtcaccaccctaagtgcctggcctaactcccaagcgtctcctctctgatccacatgcatgcacagtgatgaggtttccatctcctgtggcatttattatgccaattcagggcattccctcaggcaagctcccaggtgacaaggacaaaatcatgtaaaccacctgacacaacttcaagtgggyttgcagtcagccctgccttccaaccaagaagcatgagaactcttccaaacaggaaggatgagaaaatctgtcctttttccaatgggaatagcccatgagaggcaaagctaaaatgggagcaggcttcctggagaactgagaaaagtcatgctgtcatatttcagggctgataattgaaactccattaggacaagcacacttccatctcacaaaacctgtrcatgtgtatgtgactgtgtggttgggggagaaggggtggtgggaggaaaagagggagatacatgaaatgaaaaattcagaccatcctagacttagtgatttgagctwaacraaatactctcaatgtgcatcagatgatcaaggaaatcactctagtattaattctgaaactggtttgctccamaactttagccagctttctctgtgcctctcttttcctgtgtgcaaaatgagaacactgatagaagccatcatagtacctcccgggagtcctgtaaagcttctaaagatactgctcaagtcctctgaaaaaggcactgtactatatatgatatgccaagatctaccacattagtaagaaaagaaaaatgatgtctgcattttaatagtaacctattaatgcaataaaaagcattaaaaattgtttatatagattgtgtttaagttaactcatgtattccatcawcatcgagcactagagccacatgrggtgggttgattctgcacctgggactcactgtgtctggagcaagattgggattgtccaccagacaccaccacgcccatggcgtggagggagttcaccaagacaaagcaccaggcaatgctgtctgtcccaagggttagccatgacattgtcacctacattgctgtgttccagatctctccactcctcaagggctacaatttaagacgatcacagagaccaccgtggaggtgcagtgggagcccttctcattttccttcgatgggtgggaaatcagcttcattccaaaggtaacactcacctgttacactgccaaacagacttatttggaatatttgtacctttagcttggaatcaggggcagcamggaaagtgctacccratatctctctccatgccattaaagacacaaaatggcatgttgtgggtgtctgggatatagaacatttctgtgacaaatatgtggtaaygacctgctgacaagagtagccctgagcatggcaccctggccttgcagaacagaggatgtgggaagcagccaccagctccagctctctgctgagataactctggggtctgatgagccatagttttggtgagcatgaaaaccagaccctgaaaaaattgaggcttctctttaggacataagaaaagccaggctgaatccatcacataatcagccaaaagcttcattctgtgcagacagatgcaccacagaaaagtcagcttgcatggcatcaatccctaaaggttacagacataaaacaaaacaccttggctctcctggattattcataatacatttgtatcctattaatttagcaacttttttattagtctatgacttttaaagtatcctaagattcctttctactctctaaagcagtattttatttattttcttaattctaaaactaacttttccgaattgccacaggtgtatgcctggctctaaatttccagaatttgttgaccctaccaatgtcctccctaactgtaccactcatgaggatataaagttcaattatactccttccctctgtctttattcttcaacatcaaagaacattttttagccattcatcagacttaatgacaaatgacacatttttggctaacaagaccatgatttcaccattcttttacttcaaaattcttagagctgtgaactgttggagttacaaaagaccttcaagttcacaggtacgacccctcattttacatctagtttagtttaatttatagacactacgattcagaaaacttgaaggacatcatacagctagttggtgacaggcttaaaacgagtacctgggtctccaccacctatcccggggctctgttcactaaatctgtatgccccattttcttatttacagtcatattatagtcacatcacagcaaggtaaataaatctaaacagacatctatacaaatgtgtcctatttgagttaaaatgataaataaaatgtggcaattgagttacataacaattgaaacgatcatgtcaattggaatggaacattgctaccaatgtttttcaggaagaaaaattacgccaggttctcctgttacctatacccaatatgtaaaactctaattaaaagagaggctgaccagggaatgccaaggtcaaatgcatggccacatggtttaataactgttgtgatctgtaggttgaggccactggggagcattcatcacactgatttataagagtatgactgtaaattacatataaggcaccctgggtaccataaatagaggccaaagaataggggagaatggcagtgccctccaaaagaggccctcttgtctcctccatttctaaggacactcatagaaagtatatggagggaaagagagagagggaacgataagatagawagatagataataaatcctagattcaatttcgtcaagttactctttctcattccctctccctcttgtctccttcttctcttctttgtattatctttttccaagcttcctttttcctttctttgtacttcrtatgtggttgtgtcactgagtcctaattcatctgggtgaaggggaaacaagacatcgacagattcacaccgaatgtagcaccatgagaaactccagatatagcaaaatattagctctggctcataaacaattatctcatagcaatgtcttagtttgaaatgtgttgtgtgtgtatataaagatgtttacacacaaacacacatgactrtcctctcctaaatagccgggggcatgttcattacgataaatgccaaaaacctctgatgaatgttaaccgcaaccatcaaacatttgatctttggcaagagccaatctgcaccacctcatcactaatttttattggcaaactcagcaaactcaggagtggccaaagaaatgttcttaaaaattgatcctccatttgccaaatcctcatagggtggtgtcattcttatggagtctatggggagttatttctggccccagatactcagctgtcagcatggaggaaagagacatcrcccccattttaaattcacaatccacaattagtattccrcacctttatctttctctcatcagatttctctcccagtgacttttctcttttgctctctgcttctccccactgtccagaacaatgaagggggagtgattgctcaggtccccagcgatgttacgtcctttaaccagacaggactaaagcctggggaggaatacattgtcaatgtggtggctctgaaagaacaggcccgcagcccccctacctcggccagcgtctccacaggtgagtgcctccaacccttctccctagagctgcctactaggtcacttggaaaagaaccacagaattgcccaaggagtggagagacaacagaggtgctagaatttctcctagagctgggacaattctggtacctggcaatggagctactctaccagatgcttagctcatcatcttccctattactcatccttacaaatactgtcatctgggagagtgtttcatggagacaattcttttttaatatttccattgtatttatgctgatcttactcatgaagaacactcatttgtcagcctctggtgtcaatgatctttggaagcagcaagagctgactcattcttacctatgatgatatttggagaaagtcatctgaaccttcccaaacttcaatttattttacaagataagcaagaataatttatgataaacaagaataccttcttcattaagttaatatgaggatgggattagataaagcacacaaagcaatcagctctgtgctgatgagagtgagtgctcaatacttggtatacgcacatatactcagaacatwytcagaagtgaaagtggtaggaaacaagtcattcaaaaataagtaggtatgggttgggtcactgttcaaggtgatggcttaagtctattattatttcatcccacagatcacctcattcaagattattatatttccaggattgattcattaattgtcatattttgccttattgtatcctcagctaacaaagagtgttcaacttcaatgctgtaaattagctattgtgatgtataaatgtgtgtgtgtcctcaccaagaatgtctcgaaagttataaatagcatctggcataagttttggttctcattttattgttgatggagctgaaactcagaggctaagcaactttctctgtcagtaacagaaattgagataggtgactattggtacagctttatgtgtttttcataaacagaaattgatgtaccagaaagccagttttaagtccaggacaaaaggctgagttgaccagagatgagaaccacaacacaatgtaatgagaccacatttatagattagtgattcatgctctgctactgaatccaaaccaaacagcatcaggtgccaaggcttaagctcagtttagaaaacgttggttcagaactattgtggcagtagcttgtgttccattagtgcaccaaggttctatggcagtgccttgaggctagaatccagtggaaagccagacctctaattactccctctttcatgcctccaaccaggacagctccactttgatctgttttatattttgtacatccatttaagatttttgtcctttaaaaaataagtttaccacccaaaaagctttcaaaccatggttctgctctaaatagtatgttttagaagaaaccccataaccataaaagctamagtgctctgtaggaatccctccagaaggccggtggctgaggttttccacagctccaaggttatgctgtaacctgaagagttgacattcgataacttgggggcagaaaggtgtgatgcccttgctcacccatcatataagcatcacaacaacactgctatcacaaaagacaggttaacaagagaaagcgtaacaaatttatttaatcaaagtttcacatgamaaaggagccttcagaaatgaagacccaaagacctgggggaaattgtctgtttttacgcttaggtttgaggaataatggacagccatgtagaaacgtaattggacaaatggctatgatctaatggtaatagtctaagggggagacccagcaaggcctgtctgcccagattcttcttggcctctctgtgaagcatttcttctccacctcctctgtgggacaagacctcactggaatgagggtcctcaagggagaagggaggagggaaaaagttacctttctaggttttatggctkgctttgaggaaaaggagttctagtttctattacctgccctgaggaagaggaattctgatttctgtgaatcacttcaaagggagaagaagggtcaggagatgggaggactgcagatggtcagaaagaccttgcttgcttccggggctgtttctgaggctctttcattcctctttaattcaaagtactcagcacaccaaggtgccaaattttggagtgtctgtgatgagcccaacaatagcaggtgcagcttctcctcttctgatatgaaatgttacaaggtgcccaagttattcctgtgatttgatattaagaaagtattagtaaaagacaaaaggctaaaaggagaagatggttcataagaggatagaaaacattgcagttgaagaatatttttctcctagaatattgacagaacatggagaaggtagtccaactttgtcttatagtcaaaccacattcttataacatttgcagtattttttggtttggcagttccttaagtttaaaattaaaattccagatctagaaatttgtggtaaagctaggcagaattattttcatttaagaaaaaatgtccttaatattttggcatcatctacagagtcatgaagaaatggaaagacatttattccagtttactttttgagcagggattgtgtttgtttagaaattaggaccaaagctgaaagcaagttgatacctccttgattggaatggaacattgctaccaagtggccaacaaagggcagaatccaagagtggctacaaaatagacggttggctcccaatcctgtgtgctgtttttaggaaacgattgtttaattatttccttctgctaaggtctgacctacaccaaccccctactgcgaagctctgtgtcctcatcaggcactcaggctgccttcttctaggcaggccattttgtgaatgcaaattacaagacctcccacagctaaaaccctctgcgctacataatcacattttaatatgttcaatccattatgattcgggttttctggatttaaagagttgaaggacaaaagctttttgtggtcagttgcatttccctgacacttttttttttttccaaaaagctccagtttattgaaatgcttccccttctttctcatggataaagaagattttccattcatttcatttactcgacacacatttactgagtgtctactatgcttcagatatcatgcttacacagcaactaggaggccacttcccccatttcataattaatttaaattaaatgtraaaggcctaagttatckaaaaccaccaagtgcagcatgctgaaaagaaactggatatattctgttaaatcacattactacctcaaatatgaaaaccaggacttcattttwagtccaaaccaggtggcacccaagtggtctggtgattttcattttagctggtgctggaccaaaagccctaagcagcttaagagaggacaggactaggctaagacccggaaagagggaggggtacccagggaaaggctcaaccttgaaaaactgaaagcctcaaggtcagcctaagacggccctgagggagaaacttcattctggagacagagtaggaggtgggccagagtggactggttagaaacaagtcttagccaaggctctccagtaacaaggaagagagacttacttaaactagctgaagcaaaagagagaatttactggaaggacatagagtgcctcatgggaatcccaggaccagaaatgcatctgggcctcacaaaagacttgcaccagaaaatggaacatcaggaatcaagttattccatatatctttctagaagctctgcatggccactggtttctctctccctctttccttttctccctctttccccttttctccagatcaaatgttttctatatcagtatcagaatggtagaaaatggccacaccagccctggctctgcacggtccaacacaggctaattagagaaccagagttctggttttagttccaaatccttaaagaatattaacattaataatcagctccagccagaagggtgtagccccaataataaatgaaaacatggaggcaagagcatgttggccatgcagacatcccatgagaagttgagaagaccatttcctattctcctcacttggctgtttctttttctttcttcttctacattccctcacctccccattatctaattcagtatgaacagaacctcaagtgggtgctggagccacagctggtgggccctgcaggaaatcaaccagctttccaggtgttgccctgacctgcacagtgccagrggccagggcttatgagggaaatacactagagaacctggaagaggtgactgcaatgtccttctgctgtagaaatatgcaagaacagatggagaaaaatgacccgtaagaggctgttccgaagctggggtcctttttatccttttatccagagaagcaagtttacccagarggcatgtttcatgtcctcatatgcaaatgtctgttggtttttaaatggtcttagcaactgtgttgactgtgctgttagagtggctgagcagggacatcttttgaatactcatgatgacctctttggcaaccaatctggaagtcttggatgtttaggtgggctggtcatttcctaggtctttcctcagggctcaaagaggtgagagctgagtggcagacacacgcagaaacccagttctcaattccctgtcccatgacctccagaaagaaacagggctgactctttcaagccagcaagtgcccttcccctgcccagactgggaagtgccatcacctggaaactacagcctggtaaaagagcagttagaccaaaattcaggggaatcaaggcaaactrcatgtcctcaggaaagatattcatcttactgtgtctcattttcctcatctgtaaaatgcagtaacaatacccatcctctctctgactcaccagacttccataaggaggaaaagagagagctgacacccaaggcttatttctcattcaaactttttgttctgtttgatccttctcactcagtcattgacggccccacgcagatcctggttcgcgatgtctcggacacygtggcttttgtggagtggattccccctcgagccaaagtcgatttcattcttttgaaatatggcctggtgggcggggaaggtgggaggaccaccttccggctgcagcctcccctgagccaatactcagtgcaggccctgcggcctggctcccgatacgaggtgtcagtcagtgccgtccgagggaccaacgagagcgattctgccaccactcagttcacaacaggtaaggctgcggtggrggagagacgcacaaggagggaaasaggggtggagccaaccggtggtgtcatcacagcaagaggagtattaggaatgaggcaaggtgtgtcagagcattggccttgtcatagacaccgcgagaaggaagcaagaggtttccagcatacaggaaaagcagcgctccctcactaggagaggaaaactagcttctcatcctacctctactggcaaccagatctgtgyttgatataaatccttccccactatgggcctcaggtttcccgtttgtaaaatgacaagtttgccttgaacacatgtaagcatccatatcgctagtccaaatggaaattttgtgagaattcaggaaaggtgtctctttctcaagacacattcttaccatttgctggaaattatcataataattctataaacctacgatgactacaccaccatgatgatgtgcattggcattatgctaagcccagcctgtacaactctaagcagaacttctgaccaattctgtgactcaccttgccgtttgtaagcactagcagtaaggctaatatgaggctgactcccacagacaggaagttcataaagcccatataaaacctgccttgctttgattaccacccacccccacattctcaaggccattgggactcttaaagagctttgccaacagttgggaaaggccagacctcggggtgacttgctccctgactctctcagtgcccatcagtctggccagctagtgggctagtaggacaggcaccatccaaaggacaggctttctggcaccctcaattgggtcaataagggcctgtgatcagattagtgattgtgtctgtcttctggattctcagtctcatcctctttgccttggggtggtcacatgtcaaataatatctctgccaactccaagttgacccagggatcaatgaaaactgataacatctgtaagatctaagaaccagcatcttcagatgggataaagttggagaatcactaattcaagaattctaccttagactgtggcataagagcctgctacagaatggaatgagtccagggttttcaagaagattcaataaataaataacacccctgtgttccrctgggtttaaaatcaattgataaataagggaaaaagtgaaacagatggacaccaaaatrtcccctagattgcagcatgtaacttagtgtcatggccagatgggtttgcaaactggatggccactgtggacctaggcaagtctctccatatggcagaaattgggagactatccaggttaggacttagagcatagaggaacaagtaggtgcctgaaccctcggaacagcctgtcccacgagagaggggaacagaagggcaatgcccaggccttgctgcaaaactcaccatttaggtaagctcattttctccagcaaaagagagacaagagccttaggaaggaaacatcaagggcagggaaaagcttcccccttaaaaaggagcaagtacagacactgacaaaatggagaaggcaaagtttatttctgaaaaatactcttttaggttttctctgtagtgcctgggccagatgccaccctgtcacccagggggtgcccagtgggatttttactgaacatatcttggaatccggagtgaccgaatgtgcatcttgaaacaatgaactaaattctgcccatttctcttcccttctgcttcctcatttagccaaagatgctcacgtcccttcttggttaattctaggtcagcttctcatttcccacccccacaataccacttgmtccggggtgtggtatcttctgtggacaatgagtcctgcatccttttcttaatttcaagatagttttgtttgaaaagtggtttctttgtgctctgctctgataagaagtttgaagcggcaaaaaggagaggagagctcttgagcagcatgatggaaaacaaattcttggtgttcaggtcgacaagatggaagcaggattggctggtggcccaggaaaattctgatcaagacaattacattctgcctcctaggagctccccatgagtttcagttcattgctacatggctttctgtttccagttgcctggtggattggcagctgtcaggcggctgacttctcaatacagcctcagcctacacctcaaatatgctcccctctgctggaggagggtgaggggaaagaagggatgaggagatgcaaacagcactgcagacagattctccaggcctgggttggcaggtgccagttaaatgatragagggtacccagaccctcatgatgaggccctcagtcatttcagagctccgcttaaattcaaattaaccaaagtgcttttccaggtgatggctccgacactaggagtgcactaattgcacaggcaattaaagcagagatttgcttcctgcatggtgagtggatatttgcttgggtcttagagctgttctgaaaaggaamgaaccctgaacaaagtgcaccatggccggtgattggagagaagccagcctagaaaacccagaggccaatctccaaaacccctccctgccctcagcagctctggtttcagttgccctcaggagggaactcctggcaccatttctctcctctggaggccttctctttaagcagatccctcaatgttccaagcacagtcaccagggcatctggtcaaccagaggctgctgttttgacctgaatactccagatttctctttattgctattataggttgaattgtgctccttaaaaagacgttgaagtcctgatcctgatgcctgtgaatgtgaccttatttggatatagagtttttgcagatcatcagttatcatgaggtcattagagtgggccctaagccaatatgactgtgtccttatagaaaggggaaatttgggcacagagacagacatgcccacaagaagaacaccatagtgaagatgaaggcygagatcggaatgattcttgattcttccagaagccaagaaacgccaaagatcaccagcaaatcactagcagctaggagaggcatgcaacagattctcactcacagccctcagaaggaagcagccctactgacacctgtaccttgagtctgtgagacaataatttttctttttttttttttttgagatggagtctcactctgtcacccartctggagtgcagtggcatggtctcagctcactgcaacctccgcctcccaggttcaagcgattgtcctgcctcaagcctcycaagtagctaggactacaggcacctgccaccatgcccagctamtttttggatttttagtagagaygaggtttcaccatgttagccaggatggtctcratctcctgacctcatgatctgcccgcctcggcctccctgtgtgctgggattacaggmgtgagccaccgtgcccagagagacaataatttatattatttaagacacccagttggtggtaccttgttatggcagccctgggaaactaataggaacttccaagtcccaacagttcaagcccctagctgcttggcagtgatgccgctctaggactcttcaggaaattctttcmcaatttcaacctggatgatacttgcacctcagccaagaatctggctgcaaagagcagggtaggacttcctgctcatacaagaccagcaccctcagtcaaagctatccttttttctgcaccttctcaccccaagcattctcaatgctccacagctgaaatatttaacaagacttttctacaacttgatgtgtgcttatcgaacacctaccaggtgccaagcactattctaggcactgaggctacagaataaacagatagacaagatcctggttcacattaattacattccagtggagaaactggacaaggcagaagaaaataaacacccaaaattattttgattatgagtactataatgaaaagcgaaataaacggtacagaagcgtggccatgttggatcaagcggtttgaaaaggcctctctgaaaaggtaacgttttaactgagacctagatgacctaagccatgtgaggatctggagaacattccaggcaaaggcagaagccagtgcaaaggtcctgaggtatgaataagcttgatgagtttcaagagcagaaaaaaagcaatatagctagagcgcaatgaataagtttagaagtcgtacatggagatatctgagaagcaggcagggccggatcactcagagccctgctggctacaattaggagtttgtaaaaggaagcaacagaaaagttttaagcaagggaattacttaatctaatttatgttttagtggctagatatgtctattccatagtctcaagtctctccacacagcctccactagacatctgtctttgcctcgctcttgacttgctgacgttgcagggaacagctcccacctacaggggtgcccttggtggccccagtctcctagaggtcagacttcaaggccagagggagcaaacaatttcaccttgtcctagctctaacaaccacctttccagacctcattctcaggattgacttctttcaggatcattgayattggaggtatctggtcccttcagagacaacacttccccttaatctacagaccacracccctatgatcaaaaatacaaaacaacaacaacaacaacaaaaaccatagtttaacatttccaaggcctgggtttttagttgtgaagagcactaggtagaagtctcaaccttaaccctaaacctaaattaattttgcyccagttcagttctagctgcacaccccaagcccagtccagtccctttgcccagcttctcctcatgcatgaaatttaggggcaacaatgcaggggcaggtgttcctccacatgcctctctatccaagctcctctctccatccaactgctggagaaataacacacataacacgtcaagaatacatagtatctggcaagctaaagtacagtgagtgaggaagaatttctcaggaaaacaagctgcagagccataaatctgctaaaagattcacccaatttacatcgctaaacagaacacttctcactccaaagcctctgcgctcacattgattcacggcatttcagtcttccacaagaacaattggtggaaacttgccttgcttttgcatattaaaacagtccactcgaggttttctcacaatgaatggctagttcactccaaagttaaattcaagtgtcaaaggcaagaactattttaaacgttttaagtgacagttgttccgggcagcacgttattgcactgcaagttgtttatgctgtttctgcccaaagcagcttgaggagatagccagtcctgggagaaaaaaagcagtgtccccgtcgtctctttgtggcaactgcagagaacaagcattgtggttgatggaactcaggaaaagcttcagaggcaacaggaagccagcccaggccttgggcacctttttttttttttttcctttggagacagagtctcactctgtggcccaggctggagtgcagtggtgtgatctcggctcgctgcaagctccgcctcccgggttcacaccrttctcctgcctcagcctcccaagtagctgagactacaggcgctgggcacctatttttgtacagatgcccatggattgcctaatccatgcaacaacctgaaaatgttggtatgatttgccccttttacagaggtggccatcaaggccaagcagggttaaaagacttgctcatggttccattaccaaagatgtcagagctggggatcaaacggaagcctgactccaaagcctatattatttctgctacatcacatcctccatatatgtcttacctttacagctgtgtttattcaagtaaacacagaggaaggcaccttacacttcaaaaccttgaaatcaacagtcttctttttgtttagtggtcaaatttgatattgttctattccatctccatcactcgggarctggctctgattttctcctcctggggtttcccttgttttgtttttaagcttatgatgttgactggttccttttaaagtttctagaatgccactggaactcttgaatggaaatgggggaagcataaagtgtattgatcttcagctcccaagtatcactctaacctgcccaaggaatttgtcacagcagaccaaaaagctaagggtagccacagtgttcattcaaatgtgagccagagggtcagggggtgtgggctgtcaccaccaatcttttcagagttcaagatgcaccacaaatgtacattacattatcatgtgcgatgttggtgatgtctgtctatttttagagatcgatgcccccaagaacttgcgagttggttctcgcacagcaaccagccttgacctcgagtgggataacagtgaagccgaagttcaggagtacaaggttgtgtacagcaccctggcgggtgagcaatatcatgaggtactggtccccargggcattggtccaaccaccagggccaccctgacaggtgagtaagacctatctcttggggttatgctggttgctgagtctataccctcacagctgtctccccaacctacacatcttacaaacccatggccaattcctattgatctcatctcttaagtgcctagcacatatgtctagtactrtccattgtactgccatcacctgttctaagctactaacatctcctttttttgagacggaatctctctgtcacccaggctggmgtgcagtggcacaatttcagctcactgcaacctctgtctcccaggttctcatctattatcttaaccattgcaataaccccctcacattgtctcctggcccactcttcacacctcctccagtgactttttttttttttttttgagacggagtttcactcttrytgcccaggctggrgtgcagtggtgtgatcttggctcacygcaacctctgcctccygggttsaagcgattctcctgcctcagcctcccaagtagctaggattacaggcatctgccaccacgcccrgctaattttgtgtttttagtagagacagggtttctccatgttggtcaggctggtcacaaactcccgacctcaggtgatccgcccacctcggcttctcaaagtgctgggattacaggtgtgagccactgcacctggccttccagtgactytttcaaagtacatttttgattatgccattgcactgtgcagatattccagggamttcccactgctcttaggataagcccagacccttagtgtggacaccaggccctgcctggtttcccctgccctctccaggctcacctcccacccatgtyccctgatgttttctgggctccaggcccacaagtctgcttctttccatttctcaaatacgttttccctcctgctatataggactggcaaatgctgttccctctgcctgatgggaacctcttcatctagccaatgcaggcttccctttccactcccaggttactccccactttagggagctttagtggtcaaatttgatattgttcctgagagagttccattcattctgtccggcagcttcatcttgccagtttccattcacttcttagcactcctcaggttatcattttacatgtgtggcatgactatttgactgtcagtctccaccctacacctaaatctctgtgaacattgcaccatatttggttttgctcatcattgaatctcagggttcaccatttcctgaatgaatgaatgaatgaatgadtgaatgaagctgcagaagttcactatgacttgggcatggattgcaagaattcactgataaaatgagagccgagtcatgccttatgcacccgatgaaaagtttrggtttattcttgagggcaacagagagtcattgaaagattttaaataaggtgatgtaatgactggattgtacagagaagggcaaggtcagaggcaggaagactggttaggaggctgctgctggagtcaaagggagatgatgatggcatggactaaggcagtgtcctcggtcaccatgatacctggctgggaagtgttccctgtcccctgggagtgtgagacccaggcaacaccactcctggggcctctggctcacccatccaagaaaacctcccttcccaaactcaccaaagagtagaagactggaaatgggggtgtggttttcagataaaggagatgctgtgcagaacagtcatggaccaggagctgccaatgtgctcacagacagagattttgtttaatttgtgtcttggattcctgcaaaagtrtttgctgtcttgatagacaagggatacacagcaaagagtgcatacrgtaaacaagggcagtataatcaaagcagttttcctcccaagttgaaatcccagaccaccttgccaaacacagccagttaaagtaaatataataaatgccttttccagacagacgcactcctaaaggcacagcaaggagatgagaagatatgctgaccaagcagattaacgggggtgaattaagcagagaaaggatagaccagctggcatagggcctcrcagagagctagaaacagtcacaaaaattaagctaaatccaaaaaaaaaaaaaaaaaaccctgaaatgatacaggagggaactgattctaagcgcagcccatccctgcctagagccgcaggctaatttggtaattagcagttatataaaatcgatggctaactgttcagatggaggatgcgccatgacatcatgagagagatagaaaaccccacgtcctagttattatttccctctaccgggaaaaaagaagatccgacactcactgatcatctctcttattccaggaactctcatacagttatagcttctttaatcttcacaaccacctcatgaggtgggtatggttagcattcccattttacagatgaggaaactgaggcttgtggagtttgaaaacctgcccaagttcacaaggctagcaaggggcacagctgtgattcaaagccagtcctttcgagtcccagtcagaagattccccttccacagctgcttctgctaaagaagtaaaatgtaagggacagtccaaatttaaatgccacagacctagaagcgatgggaaaattattattgagtagggggcttaaataggttgattttttgttacagtcagatttaaaacatttcaaatatatgtktatatatatatatatatatatwayattacatttatatattacacataattatctcagggagttcactgctgaggagatttatgaggcaaatagcttaacataatttaagaagggattattggcacataaggaaatcaagtgtatttgtactcgctgagatgctagttgcaaggattgttggttctcttgctgaggcatctgggggaagagaagggagagccatgaaaaagagaaagggacaaaagggagaagtttgactctggctctaaaacattgtgctttctcactcactctccaacttggagcstaaaaagttaagtttttcagcctccaatgcctgtgttcagacacagtttgatctgaatgctctgctccatgcaacatgctaagagcctagactttcaactctgtacccaggcttgccacttgctgtgtgatttgggacagttgattgaatctttctaaacctctgtttcttcatctgttaaaggggactgataccactgaccccacagtgccatcatgaggcattcatgaggcaatacatttaacgagtttaaggtagtgcttctgacaacaaactactcagtaagtggatgacagtggtgaagacgaaagagatgaggaggtctgtgagctactggatggtttaggatgtcctcctttagtccatgtggcctagtggtttagaaccttgcctctcacagcgtggtgcagccaccagcagcctgggcattacgcccagagatgttggaggcctcttcccccgagaactaccaacccagagcctgcattttaggacccctgcttcaaggaaatctatgagtgagaagcactcacttagagcacagctgtggaagtaccccactcaggggggagaccagcttcatgaaaagtgcatccttgagcaaatttcttaaatttcctgcactttagttctctcatctaaaagacatcctatctacctcattgggttgtagcgagaattaaatgaaatcatacatatatccctattcaagaacttrggatggagcctggcacacagtaagcactcaatacccattcaattttttattggtattaatcctcacaaagctcagacctgaagccgtggcagcctggcctttgctgggcacaaggtcaggccccctttactctcactgttgactcaacacttaaagctctatggcacctgtatttgccattccctgcagaagccgttgtctctgaggccaccattttcctctttgttgtggaatccaggcccttcctgactctcctggtctctgagacattcccagagctggctggcagcaagtaccccctcttgacctccctctttacaaatgttgccctctgccacacagagtccaggctggtgcccaaaattcaaacactccccccccattattctctgtaggcaatgtccagagaattccttctgggatatgaatttgtttctgaacaacagactcaatgtctgcaatgactttttctctctgctctagtggcttctgtgtccttaataagtctgttttagtctcagtcacttagcctgtatgatgtctgtttggcctgtgcaccatacctatagtcccaaaggggtccttgagtgttacacatcttaccagccagattagaacctggcaccatgtaacagggtacaataccattctgctttctgggcagcaacaaaaaaaaaaacaacaaatcatttagaaaactccaagtggaaggagggagggaaagagagagagaagggagggagaagatttttagttgctgattgcaatttagcgaaaaaaatcaacttccctgactgggactaacgcaaattataaacactactctggcctttgtgtccaaggtgactgctctaatctttcatcaaaaaggcatgtggttgtgttttagcaggaggggagggggcttgccctaagccatccactctctctcacctggtcttccctcatgaacagaagcttaggatccgtaaggattctcatgaccaggaaacaaggcaaaaggagccaggcccatacggtcacaggagcaccgtgctctcacaaccacccagggcccgttcatcgcaccccttacccactccacagggcacctgccttaggcctcatggtggcatttgctaacctgctgcctctccctgcaccaggactatctctatctccagttgacaagctgaaaaattgccaacagggcctaggaaatccagaagctttacagtttctacagatgtgatacaacataggactgcaagaaaacagagacttacagccagccacacatgatgcactcacactcaccacatgcacacatgtacacacaaacacacctacagactcttgcacttacacttaagcacataygcacactcacatgcacatacacacatactcatacacacatgcacacactcatagtcatacacaccacacatgctcatgccctcataygtacacactacactttcacataccctcacacgtacacacactcacacacgctaggctgatgcctgcaagtacgtcctgatcatgctttgggagttgccgccttcaaggtttctggcccaaatggggatctagtggtgagaaggtyggctcctcagggtacactggcaggccacgtgcttgtctgcaggggaagaaatctgagactccagagggagtccagctggcaagtcagcactgaccacggcactcratgtccacctcgctatgtctgcactccctgatgggccagtgcacaaacaccaaacccagcaccagaccttcaacgccctgcagctcttctgaggaggaaaggaccaggcacagggcctggggtcccgggccagacagtgctcagcctcctttgggcgaagtcacagtgaccccaagtggtcactttggtaaggcaccctctaaacatggtgtcaccttccaggggcgggaagctggggagtgggctgcagagacccaagttgaagaggaggaaagaaaggacaaaggcttccacatacctcttcctcacrgagctgggacatacagggcctattccttatttgtcttaaaggctggggataagggggctgggggaaaagcyaggtgggaatatttcagctgcagcttccacttcctcagcagggagtacttgttcacagcaacaacccagaatagggatgctcctatatgacaaggttgatgagctgtgtttctcattaattccaccagcaataagaaagttccatctggaaacaggccttagaagtattatttttcttatcaaaaatgggcttgttaggccagtcccttcctttaaatcaggatggaattggctgcttctcttgaaacttgaacatcatgcacacccaaaaaagcagggagatggcctcgaaagcctgactcattccaggaatcctgaagatgcacctgtcataatccaaagagataagtgtggggaggctgactgctcagatctccatttaactaaaaagtagattggtgcctatctggtgtgatttcaggggctctccaragatattctccacatatctcccccatgaaacctctggtctccaaattccactgatgggaaatttctctatgagggaccctatattagtccctgggttttcatgaattattttgccagagctgcctttgcatgccctgtttcctttgtctgggatgccctccctgccaccagatgtccatgggtccttcaaaacccagtccagatatcctctcttcggagtctccccaacactccccaccaccaccgctactgccaccagcaccatgctgcttctgtgcatgttttctcactatactacatactgaaaaaaataaaatctttgacccaaagacctaagagtctagtgaggaaaccaacatgaaaactaacaataataacataatcactataaaaatcgcagattgactgcaagttccttggggacagggtcctcagtttgtccctctctgtgaaggtaggcacccagtgcactagggccaatcacacccctaacctcagtttcatagacttgagcttcacagacacttgggagatgatctcagggatttaaagatggaaaggtccatatttcctcatgtccacttgatcccaaccaagtctgcagaccccaagtatcttactcatgtttttgctagcaagagacagcaatctcagttccttgggcctccttctccctaccactttccctgctagcgacagcaggcatgaagaataggttcccaaaacagggctaagtgagtcattctgcctttatcaccacagtccttgcactgcaggtgagaatgtgctaactcctgttcctttctagccctaattaatctatgaatgctcattatgccccattctggccactagagaattccatatttccttccctctatctttccttatcttagccagctttaagttccaactcaaatgccttctctggaaagayttatctgactattacagcccatgctgatcttctccctgctgatcgtgtcctcttagtcccatgctgatcttgtcctcttagttagcagcctctgctttggtcctgcattagtccatttgcattactataaaggaatacctgagggtgggtaatttataaagaaaggaggtttgactggcttacagttctgcagagtgtacaggaaacatggtgccagaatctgcttctggtgagggcctcggaaagcttacaatcatgcgggaagccggaggagtagcccgcgcatcacacaatgagagagggagcaagggttggggggaggtgccacacacttttaaacaaccagatctcacgagaactcactcactatctggaggacagctccaagccattcatgagggatccacccccatgacccaaacacctcccactgggccccaccaccaacatkggggatggcaattcaatatgagatttggaggggacaagcatccaaactataacaggtaccaaatcactctcgaataccaagttgcttactccactccttcctcctggcctgtaagactcagggatgggaaccatgctatcatgagtcagaaaataacaagagacttgggttccaaacctagttgtatcatgtatcagttttgtgaccttggccaaggaatagacttcttggagcccctgtttgctcatctgcaataccctatcagtagtgcttcagggaaattaaataacgtgtgaatctttaagaagctcagtaatacttgcataactctttaccatcagacactcaaaaagtcttcatyttttacttctctttttcttccctccccttcgtcattattcttttccatgtagcttagtgctaggcatattatgggtgctcactaaataattattttacttttttagcacagattccttttcacccccaaaaggcaaggctaatgtcttgttcagctcacaccaccttgtgtctgacacaaaggaggcccttaatatttgttgaatgtatgactgtgctttaggggttccaagaagaatgggtgtgaggtgaaagagttgagaaaagcatcaacctccaagttgaacaaagaaagttctataaggaacagagagtagtgatttcctatgggatgaattttctgtgctattgttaagaaagggaacagggccatttatatgttaccacttgcaggagttggatggagagataaagggggcattgatagagagcaatggggtctttaaaaagtgagaaatccctaggagtactcagagtgctgatatctaagtgcactggctatgcctcggatacatgtgkttttttttttttttccagcagaactgtgtctaacctgctggcaaagagcaacaattcacttgtagcatggaagaaagctgctgaaaatcaaaggaaagcagcaggcacaaacctataagcaagtcccacttttccatcctctagacagaaaacctgggaasagaacacattaaattctgctctgcagttttctgggagaagatgattccattgtaaattattgaacatttcatttaagcttcataaataagaaactgggatgaaaatgttacatgttagatctgtttggcaacgtataatttctgtcttactccctccatctgtcacccttcatctatgttggagaatttctacttcattataggcaattgaaggtcttaatcagttgcctgataaaagtagtttatgtcccaaaggtaatctcatttctgcaaccaaggatgtacctggaactcactgaacatattgatggagataaatgtgtgcttcaaatggatcagggggtattgcaatcacccactcaatctagagataggtacttggcccagccagggacaaggtcctcactgccacctggactccctgaatcactggtttccaacagagccaacaggctaagcctcagcaaaccaataacaacaagtcaacaggtgcacccaggaccggcctgtacttgcctggggcggtttttgtagttgatgagaccactcaccaaaaaaaaaaaaaaaaaaaaaaaaaaaaaaagtactcaaaatccaggaatagttctctgtgcaaagtaataaaatactagctactaccgctaagatccaggcactggactttaaacactttgactcatataatcctcatgatgaccctctgatatagatgctgtttttattctcattcttcagaaattgaggttcatagatgttaagtaatcaaaattacacaggtaaaaagtgaaagagaccaaatatagatatgtcagacgtcaaagtctgtcaaacttcaaagtttacctccactggtgttgccactttagagaaagaaagaattaagggttgggaaagaaagggagctggtttaagaagagaaaaaagagggctgattcgaatgcctacccagacagggcttcgggactgcattcctgggagagaaaccggcctggtaagctctgccatgcttaagcaacatttattgcatggactccacgaaagcctactgaggaaggggatgaagaaccccctggctgccaggcagcattcctcttgaccaagccaagccatttgttaaaggaatgttgctcaaagtatttccgatcaaaatcagggattccagagaaatcacagctgccctgagcagtggaaggaagtaataggatgtcccattcctcctaaaagccctgaactctgagaccagaatccggggggcatctctagctggtcacagacttactccgtgccacagtttctttttataaaaagatgatgtactctgttgaataacagtcccctcaaaatgcatgtccaccccaaacccttatttccaaataaggtctttagagatgcagtagagttaagatgaggtcatactggattagggtggcccctaaattcaatgtgactggtgtgtttataagaagaggggaagacacagacacacatgtgtctacagaggcagagactggggtgacgcaactacaagccaaggaatgccagggagtgctggcaaccaccagaacctaggtctcctagagccttcagaggaagcatggtcctggcgacaccttgatttcggacttccagacttcagarccrtgggaggacacatgtctgttttaagccacactgtgtgtggtaatttataacagcatccacaggaagctaatgtagatggagaaaagactgcttatcccaccttcctcccaaggttgtgatgagactctaaaacacaatccattttgaaaagcacagatgttatataaatacagaataccattccaatcagccatgagcccacacaaagccccaaaaagagcctaccggaaggactcagactgaccactggaggccctcagggtgatcacttgattttgttgggtttttttgttttgtttttgtttacttgtttgtttgtttttgtttttttgatacagagtctcactctgtcacccakgctgragtgcagtggcatgatcttggctcactgcaacctcagcctcccaggttcaagcgattctcctgcctcagcctcacaaatagctgggactacaggtgcacaccaccacacccggctaattgttgtaattttagtagagatgggtttcaccatattggtcaggctggtctcgaactcctgacctcagrtgatccacccgccttggcctcccaaagtgttrggattacaggcatgagccaccgtgccctgcctttgttaggtttttctacaaccccagtcctaatagataaaaatgagtttgatgccagttgtaatagatgaaatagccctcaaagaatccccagcatctgtgaatataaccaccttacagggcaaaaaggactttgcaggtgtgattaagttaaagatcttgagaaggagagactagcctgtactatccaggtgggaccaacatgatcgcaaggattttcataagtggatgtagggaggtcagagtcagagtagatgcaatgataggagcagaagtcagacagagaaaacagatttgatcgtttcaagcttctggctttgaagatagattaagagaccatgaaccaaagaatgcaggcaacctctagaagctagaaaaggcagggaaatggattttctcctagagcctccagaaggaaggcagccctgctgaactactttagactgcagacctcctgaactaactgtaagagaatccacttttgttgttgtaagtcactaaattgtggtgatgtgttacagcagcaataggaaactagtacaccagtcaaaccagttagtctgaaaataaatgtgaaagaggtcaaggagagaacctagagaattccagatattctaggaggttctcagagatcctttgtagtaaacctcccaaaggatttcctcagagaagcttacaccctttagtgggacagtttttgtgtctcctctgtcttcctggactcccctgaaagttattctaaaattagatccacagctttagataccctgaggcctgaattactgaacttggcggggggcctacagcaacaggacttctgcatgctcctactcgacagccctgtgcttagaaaaaaaagtccatccactgttccccctagaagggacccaggagtccccatatggcctcagctcctgtaaaaggtgtagcttggtccttgtatataacattcaaggaatgcttttcaggtctatgtccacactgtctctcttgattacatactcccgaaattcacaatttaagcaagaaatcctctcgctggttcaagccaacytgagacgctaagcatacaaggagtccttgtatacttatgtgagcacacctctgaaggtcactgacaaggcagcctcactgccttcccagagagcctgcctgcaagaaggaagctctgcgtgggctggttcrtcctattgacttgggattcctaaatagtgaaattgggatttcttaatagttcaaattaggagaggattcaaggaggactaaacacaagrtatgaataggagtctaagatcattttcttcccactttcagccttcctagccctgccccatacrcagaataatgtttgtttctccatccactgatagatctggtacctggcactgagtatggagttggaatatctgccgtcatgaactcacagcaaagcgtgccagccaccatgaatgccaggactggtgagtaggaggactgctgaggaagaagaccaggttagsctataagcctaakgagtcatggaggctcgtcccagcaaaaattaatcagaaagcaatgtcttccagtgaacagggctctggtgacaactgtcagcctagaaacaacatccaccctatgcctaatccttgatctctgacaggcaggacagagtcaccctcttccccacagacctgtgctcggtcccccgtggtctgaagagctgctcagggctgtacagagcagaggtggaaaatcctaaataggttgatgccattgcaggccatatttttatctagaccaccccgacagcaggcagaatggggcatcctcgccctgcatacaccacagaggtcctcacaaacgccacttgggtgaaggtctagacttgcaacaacccattaaatctgagggcagaagaaaagtccagctgagacccttgctgctctggattcagcagttttgcttccaaatcctgggtaaatttcaaagtcatttcagcacctatggtactagcagcctgggctgggctagggattttagaccagtccttgtcccaaggttcagcctctctagagaaccacatggacaaaagtctccaggtcctcagatctagctgcctgcctggctatggttagaacaagtcaaaatagcctcagggttggaggrtggtgcgcttctgttgccaggaatggcatatccctacttggtggtagctaccattttatccttattggctcattgagaaaggatgggagaaaatgaatatggcgagcttgaaaatcagcagccagctttgtcccagaggtggatgcaatccagtggtatcagagctcatcacggctttcttcagattgttcatctatttgccaagcccctggccatcattcagagggaaggtacttagcaaaatatkagataagtgtcagcaatgacaagctagtgctcatagtcagcaggcctgctgatagcttggaaacacacaaagcaggccaataaatactgccctccaggggaacacatgtaaaataggccatttatgtcaatccacagaacttgacagtccccgagacctcatggtgacagcctcctcrgagacctccatctccctcatctggaccaaggccagtggccccattgaccactaccgaattacctttaccccrtcctctgggattgcctcagaagtcaccgtacccaaggacaggacctcatacacactaacagatctagagcctggggcagagtacatcatttccgtcactgctgagaggggtcggcagcagagcttggagtccactgtggatgctttcacaggtaccagagcagcagaaatcccagccaggttcagggatcagtggatctcagtgtgagaaattcattcaggcaagtcactcttccaatgttccatttcctttggagaaaagagaggtgggtagaaaaggatagagtaaaaactaataagtgcatcaagagggaagggttggaagtaaagaggggaggtgagcaatagtgttacctgcctgaaaacttgtgtctggcttttctatggccttgacatagtagttgattctgtccatctttccctgctgcagtaaatcagtgggaattcagaggatccatgggatcatataaaattcattccaggatacaggctttcaatcctggttcagtattatgattaactcacagaagtagttctcattttaacagaatccattttcctatatttggattggaaaaagtggagtgaacagcactggagggtgaggaggtggaatctcttggttagtgggtgaaggtgtggcccttattagcaaggagagcaggtccctttagccaagaagttcttctagcccagtgacccatctcctcacgtgtttcaggaccatccatctcctttgctttgcaggcttccgtcccatctctcatctgcacttttctcatgtgacctcctccagtgtgaacatcacttggagtgatccatctcccccagcagacagactcattcttaactacagccccagggatgaggaggaagagatgatggaggtctccctggatgccaccaagaggcatgctgtcctgatgggcctgcaaccagccacagagtatattgtgaaccttgtggctgtccatggcacagtgacctctgagcccattgtgggctccatcaccacaggtgaggctggaggacttggcagcaggtgatgaaaggggttttcacagtagcctttgacaaatcaatgaaattttaaaagagaaagacccaaggagtaggggatttcctctatggctagagaaagtctgtgacctgttctgaaacagctacttcctccagtgctgcagaagatgcattagataagaaactcccacttggaaggtgggacaaagtcaatgtcttgaggaggtcaaagcttgaatgcatttgtccaaaagacctcccactaccagcttagaagaaaagcactggagaaagctagtctccaagaggaatccctctacagtgaagagacacctgttcctattctgaagaaccatctcttaactgcccagaaagttcactcgtacaataatgcttccttagtctcacatgggactagcatgcaatcaggtagtgacctggcactcagagaatggggttgatttggatgttgcttagaaaacacaggcactcagagatgaattggatcagtcccagctcattattcccaaacacagtttcaaatatgaggtacatgtgggtgaagatatgtatgtttgggtagtttcctccttactaacaagaactcacaaactggacaagtagattaaacacttagctgatcaactctgtgatcccctagcagtaaaaaaaaaaaaaaagcccatagcataaatgaaatacaatttaggaaaatggatttgttctggacttgtgctctgaaatccctgtayagtcaataggcagtttttcaaaactgaaaccaaaggtggctgctaaagaataagagatacaggcaaaatttggtttatcttaaaaaattacctcagagaaaatgcctatgtttctcccaattcaaaacaaaacatatgaacttaaaaaaaaagttcctagttggcttgcagataggtaacaggtacagagcttgccagcttgtcttcatgttgttaaaatattctccatgaacatagctttggtcatacctacaaggtttcaagtgaaacatcagcgtgaccatggttttaagataccctattacatggaaagatcttgtctgcctttgggacaacattggcttttggtcaacataaaaccagggatgagaatttctttttcacactgtgctttctgtctttttcccacaatcactgggtccttgtaggaattgatcccccaaaagacatcacaattagcaatgtgaccaaggactcagtgatggtctcctggagccctcctgttgcatctttcgattactaccgagtatcatatcgacccacccaaggtaacaaagtgatttgatttctcaaagatactaggatttgggtgaagattatgggagaactagcatatcccgcagaacatccactcctgcctgcgtttttcctcttctctgtggcatgctgcatcagaatgagagtgggctggtgagcagccaagaaaccccacactcaccaatgcctcttgagaaaggcttgattacattcacccagagagcaggcccttcactagcagaggtaactgatcaccattatctaggcagtgtcttgagaaaaaaagagccccaaaagaatctgccaagagcttgggtcacatgaatattcctacaagaatgaagttcaagactaggatccagagggatggctaaagacccagcaaagccagatggagccttggagggaagcacagtgatgtggtcccatttcagccactccagwcaagttatgagtcagaggaaactggcccagacctcacctgcatcctgccagttcttgctggtacatgtggcatttttaaggaagtggagggcacactcacttccagtgaggacacaggacagcattccagactacactgtctctggactgtggggactgctccttgcatcggtgccctctacactgccttaatgtcattgtcttagagaagaccagcttgttagaaaacsacttaataggtaggtcatttttctttgctccaaggagcccataaaatgaaggagtgagaccagtgtgcaaagcctcttcacactccaacattcccagcccatgaaccatgtatcatccctccccactgagtgcggagtcccacacccatctgtgctttattgacatagactgtaccatgggctgcttggatgaaagggctgctgaattttaactgtagattcttctcttctccagtgggacgactagacagctcagtggtgcccaacactgtgacagaattcaccatcaccagactgaacccagctaccgaatacgaaatcagcctcaacagcgtgcggggcagggaggaaagcgagcscatctgtactcttgtgcacacaggtgggaatgtctccctgctgtgtcaagtcagaaccctggctgaagatctgggtgaagttgttcgggcttgtagaaaggttctggaggctaaggctccatttcggggtgctcctccaactcactgtgtcttgcagggcaatttgcaatttctctcccccaatattcctccctaatactaaacgtttagagagtcaccctctagaagtcttgctggtttaggttaggaattttcatggaacttccaacataaacagtgccctttcagacatataatggaagtgaattctaaaacagatatctgaatcattcatctgattttgtaaaagactcagatgagaaaatttcacctcgagaagaaaagggttgttattccagtaatggaatggggtcatgaaattcatcatcagatatagccagaaaccaccaagaagstgcctttgctcttgctttgtgctccagggagaaagaaggcaccaaagtggccataactccctcacccgggaccaaagcagtgaaggtgatgtggctccgtgtgcatcctgggctgcctgcaggggcaccgtgtagctcatgtctctgacaggccccctagtcagatccagatgtcttctgcatcctccatcagctcctacataatgaccagaggaagggaggtgcaagggagagactggcttgcaatatgggaaagtgaggaaaggtagtccaaatcccatggcctccctcttgaaaacaagcccacgcaatggggctgaagagaaggctcctttgctagcaccactgctcctccgtctctggcccctcagcaagtacaccaggcagaacatgcaaagattcgctgcagaactcactagcaggcacagccaaagtgttctattcccataccctagaccaaacctcctagttaagccatcattcccacagcacgtgggaaaacatccagcttgcctcattaggagaacacctggattttctacagttgcttaatttcactggagaatggtatttcccaaatgagggaaatatactttagaattccttactgctttcgtagatgttctcggaagctcagaaacagcatctctaaggcaatgggccaagaaatattccttcacaaacacaaaaattattcttctaaagacagcgcaggatattctgatcctccctagtctccttccaggcttatgacaacagataacacagccattcagttttgccctatctattaaattacctgtgaccattaaaatatcaacaagtgttggccagaagtgaggtccaatacaccaaaagaagcctctatcccaccttcttgaaccaagaaattcatattaaagaaattagcctttttcccattgaggacaataaaatgtatttcaagagcctcctatccccaagataaaagagaccagcaacttcaatcaaaaactcatttctttagccaggcatggatgcatgcacctgtagtctcagctaccagggaggctgaggcagaaggatcgcttgaatccaggagtccaaggctacagtgagccatgatcatgccactgcatgccagcctgagtgacagagcaagaccttgtctctcaaaagaaaaaaaaatccttgggtcatgagcagctagtatctctaaagcagatatttggtacaccaacccaaatggtatgcccatccaaactgccctcctttaagtctaggcagagctattttagcaacttccaataactagattgccccagaatgtcttattttgctgttgtatgtttgttgtggttttacgttgaggtctatgatcttamaacttttggaagtgagtgctccttcagggtgtcatgtttgtctcgtggtatcatgcatgtctcagatagatcaagccaagtgtagtctaagggctgcatttgaagaactctttgaacatgcagattatggatacaattccaattttracatgaaaatattgtgcaggttgtttctttgtgataaaggacataggcaagtgaaaaaaatactttcaattagagaatagggcaagatccacagcagatcttggttctcaaaagtaaattttatgacacttgggttgagctgawaactaaactgttgtaataacatscacttgtgataaattataacctgatggaagagaagcacagtaataaagcaaagacttagagcatgggcaagtaagactaggaagatgatcctatgacaagcacaatcttttcctctaacaggcccttttgacctacctaagcctggaagaatcctcttgactcttaatgcaacaaaaagaataccaaggactcagtcctgagtgagacttgtgagcagtgaagcaatcatccaataatcagatatgacttttgaggcaacctgactgagcccacgcagtcattccatgggtggatcttctatgttctctgtcctggggatactcctgcccctatggagttgccaccacacttcctgaagctcttcaacagagatctttccatgaggcacacccttacatttataaaagtgcaaatagcctgggaagtatgattatctcattaactaaaaaattataacaatttctgtgggttcttggttgctccatctagatttaaatgttgaaaattcattccagccatatcttgaaatcctctttagtatctggcacagtattctgcacataagaagttattgaattaattaaaaggaagagctgggggcgacrgggggagaactggatacttgagagaagggaggcagggagaaatggaagaggctgatggaaccagaagaggagaaagggaagaggtttctgctcacttctttgttttgtagagtgcagcagcagtcttgcaccatgagtggaacttctgagatcattccctgcatttctatcctgcagctcctcttatctgtaactgataatctattctgtttcagccatggacaaccctgtggatctgattgctaccaatatcactccaacagaagccctgctgcagtggaaggcaccagtgggtgaggtggagaactacgtcattgttcttacacactttgcaggtgggtgtctgcaggcctgcagatcaggcaggtgggaatggtgggaattggagctgcagaccagtatgatgtgaataaacaaaacattttttcaatctgaaggacagattagaaaagttcctacttcaggtatactatgaagccctcaagatatccccaaactctatgctgggcatcgtggctcacacttgtamtcccaacactttgggaggccaaggcaggcggatcacttgaggtaaggagttcaagaccagcctggcctacatggtgaaaccccatctcttctaaaaatacaaaaattagccggaastggtggtgcaaacctgtagtcccagctacttgggagrctgaggcagragratcacttgaacccaggaagtggaggttacagtgagccaagatcacgccattgcactccagcctgggagtcacagcaagactccatctaaaaaaaaaaaaaaaaaaaaaaaaaaaargaagatatccccaaactctgcaaactgtatcaaatctaggagctgagaaagctgaatctgaaaggtacaagaaaggcatgtaaccaagggcaagtacaaaaacagagcaatagccctaggaagatgaaactcagaacagagctaagacttgcccccaaaatgctacaaacaagaaagcaggcttttctaaatattcgcagagcaagaaaaacactgaagatataggaccaagtttgaaacagagagtacaggctaacaggtgacaaaagattcaggactgctaaactcttccgtgtttttgtcttctctattcatatccagcccaacaggtttaactaacacgaaatcttgaagttcactgtcttctgtatcatgcttgttcaccttacaccatttgaagttgaacagaacagagaagcccaaagcaaaatagarttgagtcctccaagtctctaggcttagggaagttatttccctgccttcatcaaacatgtgatcacagaattgttttgggttatattcaggaatccagagaacaaagataccagaagacagaaggcaggcagatgtcttggttttcaaaaatgacagagaaagctaattctgtgagctgcaaagaagtaaacttattgtcaaagcttaggaaggtaaaaactaaaacagacaattaaacaacttggaaaaggaattagtgattaccatatagcagcacagattcaccaagaataagttttatcgaaactactttatgtctttgttttcattggcaaacctgctagtacatttgtatttcagcaaggcatcagaaaaccccacttatcacttagtccttagttaacatggaaaaatacatgaaaggtcatatttggaggtagctgggactgtagctgaatgaatgaccctccatgaagaagggatagcattactatgggtatgtcctaacccctctgtgagcatgcacaatccatctcaattcctgtcacccctcctttcataacatgatcccgcattttttaattatcaccatgctttctcaagcctccatgcatttgcacatgctatttctttcaccaggaaactcccccatttgcctgcctagaaaacccatccttcaagtcgtggtttcaamcctatctcttctgtcaaagcttccctgaaggcagtcagacacatctgctcacagacactaaacacacagctctaacagagcaatgaacttccattcattccacaaatacttttgatgccctcccatgtgccacacactctataaggctataaggattcagaaacaaaaattgagctctcatctttatggaactcacttctaatgatgttgcagagaagtaaatagttacaacttgatgtgagcagtgtatgctatagacrtgcacagaacaccatgggccatgtccagtgggctactatgaatagggtcaaggtgtggagggaaagaaagaagaaaagtcttagataaagtgaaagaagaaaaggagaagaaagggaatttcaagaaaaagagcagactgtgggcatttgcagagatgtgagagtgtaagaagtctgaagaactaccatagtttggtatggctggagcattaatcaatggcatgatgtgcaaagggggacattaaaaagatgatatccttatacatgctcttccaaagcttaagcattagtttgaattttaacttgtttgtatgcctttagaccacaagaaacttgaaatctcaaagccctacctattctgaaaatgtgcctagtaaactgttaaatattaaataatttccaagtattctaattgcccaacagaggagttggccctgaactaatgaacagttttatcaacagcttgaatgaattcagagaagacatgcttaccaaatttgtgtataaaacaaaattgtgatcaatagaatccaagttcaaaaatattttaatcaactgaaacagtggcccaaaactcaatcaaygaggcaaaatgcaatagaaataaatgcaaagctctgtccatgggtataaaaaatcaactaacaaaattggattgagaggtagggggagtggttacaaagaagatctttgattagcaataatcttggcatgtgataacaatatcacatggcattcccaaaaccttactaattaatataagtggcacaagcacagactgaccctgtttatttcattggtcagtacctctccattattctcagttctctgagttttggactttagcagggacattgataaactgttacgtgttcagagaaaagtagataggactgtgaaggttttaaaattgtcacataaatgtgatgggaagtgggggctgaattttctcagtctagtggagagagaacttgattaggaagggtggtggagaggaaggggtcatgtacacaaaagactagatttatcyttaataactccagagacacgaatagaagttatagagaagacaatttgacctgcacataaagaacactttttttcaattatgatatgagatgagaggggaatccttgcaaagagtaagatactaagctagataacctatgaaagatttttttccaaaattctctagtagtaaatccatgtgaaatacctttggatttggtagatctttcctaaactgagtagccttattcaacccttattcatattcatttgagttcagtcgctggagagaccatccttgttgacggagtcagtgaggaatttcggcttgttgacctgcttcctagcacccactatactgccaccatgtatgccaccaatggacctctcaccagtggcaccatcagcaccaacttttctactcgtgagtacatggtcacctacatacccgtatccctggggacttttgtggaaatgatcagctttcttgtggtggactagattatcacttacaggctttggacagggcagctatgagctgttcttatttggactgactacagcccaaattcagtgaaactaagctgcaacttttggccagcagagacatgtctgttttctgctctcaccctgggtgacagcagaagaaccaggtcaagagaggtctgtactcrgaatgcatctgccccagaaaagtctgatggatattaaaaggctagatatctaggaaagagctgctgagtagagtgatgaataggagaaagtagacataggtaatatgtggaaacgtaagttcacgagtgaacaagcagacatgagagtttatcagggtccagatctcaggcatagaaggtcagtgtggaagatgtcacacccaagcctagaggccctgtaagggaaggggaagtagctgcaagaatgatcgtggcactgaatgattatcatctgacccaggagcaccctttatgctcctttccaagccagagcaggggtcagcatgtgagcaatcctgagaccaaagaggtgggcaacagatacccatacctgaaatcaagcagggggaggagctggagaggcaggcatgccctggcactttctcctctttgcagtcctggaccctccggcaaacctgacagccagtgaagtcaccagacaaagtgccctgatytcctggcagcctcccagggcagagattgaaaattatgtcttgacctacaaatccaccgayggaagccgcaaggtgagattttgctggaaagggaaaagaccatttcttccaagtgaggccatgtggaaactgactagtggagtgaccacaggacattggagggagggggaaggaagcaatccacaaggaactcatcagcttcccatcaaggatacccagcctgctgttgatgagagagccctagtctgcaagccagaagatttggatgatagtcctagctctactgctactctctacgtaagttgaggcaaaggactaaacctcctcaaggcttgctttcttctctagctaatgaaggtctctacccctgcaacttcactgggttgtgctggtgcttccaatacaatgacacaaagcacattggaaactcccaagtacatgatattggaatagtttttcaacaacagggctgagcaaacatgagctggataccaaattcaataggcttttatgcctcttgataagcattataaaggtgatatctgtgtagcctacagtaaagaaacaacaaatttttgttttatttcatcagttgaaacagttcatccagaacactgattttcaagtttttgttagtgaagcaacctctttttaaagggaaatcatatgcagaaaccaaaagcacagaatacatttcagcagagttagtctgcttgatagaagtaaggaggccttagatcccacttcctcagctctttctctgctctcaagcaagtacagtgcaatctgaagacttctagattcaataatgcaggtacctaaatttatcccaatgtgcattcctgagataggagctggcctaaatctcacatgggagctctcctctctgcttattggtgcagtaatccttattgtgggatggagaggatgacaatggccattgcaatactgacctagctgcccatgggatttggacttcccttccctactttcccaaattgcaagccagttgctcccttccaccacccttcctttggctcattatacaggagctgattgtggatgcagaagacacctggattcgactggagggcctgttggagaacacagactayacggtgctcctgcaggcagcacaggacaccacgtggagcagcatcacctccaccgctttcaccacaggtgagggagcatggccactttgatgccttcttctccacttcctgatgtttggctcatcagcagcctctgctgagacttgccctgggagcagtttatcaaaaaagctcagttgcctcctccttcttttcccctgtccaagcccctaccaggaaacctctcactaacaaggtaaccgcaggaaccagcagtacaactccctgatccacccggaccaattaaatgcaccaagtaaagacatcaggttctggctgggtgcggtgactcacacctataatcccagcacttcgggggyctagatgggcagattacctgaggtcaggagtttgagaccagcctgkccaacatgataaaaccctgtctctactgaaaatacaaaaattagytgggcatggtggtgtgtgcctgtaawcccagctactcaggaggctgaggcaagagaatcacttkaacctaggaagcagaggttgcagtgagctgagatcgtgccactgtactccagcctgggtgaaaaagtgagactccgtctcaaaaaaaaaaaaataaataaaaatttaaaaaatcaggttccttccagttcaggttttctgcaagtggttttccagcaaagtttatctttctcttcctccttcctctgctacctgtaatcagagactcacttagtaaaagcagcagtagtaaaccctcaacattaaacctgcagctcttttccatacacaaaggacttttgcattcctatgatctcactcagttcttatataacaactggtcaggaaggcctatgatccccattccacaggtgatgaaaccaaggggcacagaaaccaaagacttacatggctagtaaatagctgagtcagaccttgaacccaggtcttctacttctaaatgcagctgttccggctgccttccctccttaagtcagcagaagatacttgaaaaacgctgctaaaggataaaaaaaattcctaatctctataacaggaaataacctaatatctgacttttgagagttacttgccaagtactgtttaactgcattacatgtattacctaatgtaatcctcacaacagcctatgtggtatgcactatcatctctattttttacaaatgaggaaattgggccacagagaggtgaggtaactcacccragatcccatagctcttaagtaagggagctggaatttgacgccagatgtttcagctctggggtctgtgttactaatgtttctctctaccacctcccactgtgcctctctacagtccataatgtaaggctgcccagccccgactttgaattctctccctggcccacattatgggggtgtgggtgcatacatgtgaggcaaacctgagcatgtcccatatactcagccacatcctgcctgccatgtcagagcaccagaatgactggattcccgtccatgcctcagagcctcttcctccatccccagagaggtgagagaaagtcccccagccccaccaggtgtctcccccactgcactcgttctaaatgacaaagcaagacactgatcagatatgacaaaatatccccagtggttctatagagtgcggagattgtgaacgagtcctcttctcccttctttttttacacttttcaatacatcacaaagtatcttaaatgagcacattaatcagagaaacaagtgttttaattaaaaaataaaaataaaccttgggtacacaaacagacatgaatccaagatgtatctttaccaagtggaacttagaagacacttgatctcttttatggggctggagtcaattatgctccccctccatgctcttgcaaaggtgtctgatctcagaactaaggtgctaccctcttcttgttaagcccttccctgcacattcgcaggttaattaaagagggctccatggtcctcttttccacgctaccacttaaagacccacgggttggagctttccattgaattaagaatttcttttctataaaaaggacacagatgacagacacttaaactgagctcccaatttgcatatttattaggtctaaattaatcattttatccccaaaatgcatgggtttcaatgtttgctcagtgtagtatgggcttttaattcccacactgatgatgccacagctagcagttgtgagcagtatgacaatgtgcctcaagtctctgtggcatcttacagctgtgcctcactccagacccacctgggctgtaaaagcaaaccagcttctgtgcccctcactgccctctcttagatgcagctgcgccaagcagtgtacagttttttggatctgggatcccaaatccacctggggcctcagtaggatcaaataagcagaagattaacaacacacatggaaatctggagaggaggcagaataatggcttcatttggtggacagtgcaggggactatcaggatgtatttaggttgtttgtttgtgtttacaagactccagttgacaccaggctcttggggcatgaccaataccagctcagaaaggggaaaacagaagagcccaatttccyatgcggtgagtgtagctactgactgagstgttccatgtagagtttgtattattacttctgtggtacatggyaaagatatgtctgtgtttggaagctttcgcagttttactggaaagctcaaatttaaatgtaagtcactcatgtataccaaactctgctggctttgtcttggagatttatcagaacccactgaaatgactggttgcagaatgaaagattcttgggcagaaataatgcatgtgaaagtatcttgcacraagcctggcacataccagacataatagacactggttaaattgaatagtcaaatctcagctgcagagcacagaagaggggtctctgataaaataaagcctaaggcgatttttaataccccttgtagggataagacaggcaaagaggtataaccttcaagagtatgatgtgatgcccaaattccctctaatttcaggctctgtcagccacctcaatgcaaatttccctgaataaattccactaggctacatagtcatttgcatggtaatattaatgagctctcgttgcctgtgccacctctctaccccaaagttttctacccctgcccaagagcaaattttattaaggaggaaaagaatacaagggtatcagcttacaaacttggtgaggtgggattggggacattaccaataaggaaaagcaaaattgaagagcagtgtatcttcacttatatgcaagactggagtgctgccagtcaggaccccacagacatgaattactcttgctgagcaagaagtctgagaaacactggaagcctcccaggtgatcgcaagccagggctaatggatttagaggctaatttctttttagcaattagcatcctttccaacttcattgacagtacctgactttcccacttagcagtatcctactcttaggatgggttgatctcagctcatcattctgagtgttttctatgccttctctgatggaacaagagagcttaaagtttggcccaaagttgcctttatccacggataaaccctcaccttgtcccaagtggaccataagaggttcattgtaagcaagatgcctacctgatggcctggaaaagagttaagatgtcaaaaagtaataataaaactaaaaaagagaagaaaagaaaagaactggcactcacaaaccctcaaaaacctcctttgatcaagatgtcttcccttgttgtgtttctgccacataacataagtccatttcattctttccttcatgttaatagcttcctgtcctcttgtctctggtgtttgcacaagactctggagggaattaagtacaagtagtatggaagagaaaaaatatggatacattatttataatttactgtcgcctgaaatttcatccaaggtctacttgtcttttagagatatgaatataaatgaggaaacaaatattccccacagagcagccaggacttggtgaaatgattgtctgagaggcagtttcattgtctcttttaatactataaaaagcaaacaaggttctcactaaagcttgtcctaagagacagtgagcactataaaataggttgtcttgaccttgaggttaagtaaagacaatcatttgcagaggtacccagagatggataataagaagttttcttttattacctttgctcctgtccctgcccttccacatccaggctgagctgttctgtggggctttttaagaaaactttggagtctactctaacacaagcttcagcttttgaggttgtgaaaattaatgaagattggcaaacaccacactctggaacaatagatggcagatcatggaaattcacatacttatcagatagatattctagttagaaaggaaagcctcatgatcactatccacggctatctatcctcagatatgccacaaatccttttcaccaaagtgcagaggtgatagggcttctctctgctccactatttagaaacagcttgagttcttgctttattataagacaaacaaacccctaaaaggagaagtctaccttctttctttgggacctggctgtggagaaggaggtagggcactaattatcccatttgaacaaaccatttccatgcatgtccaaaattaatagaaggataggtgtcagatcagaggtttcaattaatcacactgcacagtttttcacataccacccatgtcaatctccagcaaggtcccagtctgtttttactcatttatttccttttaccctcttctcttcttccaccttccataggcaggcatttgatacattaaatttgtgtccttttgtttgtatgtatttttgaaaaatgtgttcttgtaaaattactttgagtataaatattttaaatatatgtaagcggtattgggttacataattcattccctattctcatagtttttgctcagcactgtttttcagacccatccgtgttgtcatgcatctatatagtcttttgcttctaattgttgcaaaatactgcatggtgggcacccatcttattttacctctccattctcccaaaaatggacatcagattgtctccaacctcccaccaccacaaatggtgctgcagtaaatactttgtacatgtccacttatggatcactaaggtaatgccttctggaatatatgcccagaagaggaattgctgggtcataggggatgtgtttacatagtttaaccatgtactgccctcccacatggctgtactagtctacactccctccaacagtgcacagaagctcctatttcctaacgacatgcatcattccaaatgccttgacatggcctggctttgtcatttttgataatctcatagagataatttatatctcatttttctagttgaatgtctttaatcattagtttgagtttaaacatctcttcatatgttttttagtcctttgagtgttattttcctctaaatttcctgctcatatagtttgtcaattttccaccgggttcctgtactaaatattagctattattatttgagcttttgaaacctttcttaagaagtctttctttgcttttcagccaaaaggttttcttcaatatgttccgctattaactttctagatttatttctctatatttagcctattttataytggtattagttgaggatacagtttcatttttctttctatagtgaaccagttctcctaacatcatttattaaataatccatctgttctgtattggtttgtggtgcctcattgtatattaagttcccataagtacatggatctctgtttgacctctgaactccctattctactctcaggtctgtttttccatatggtattccataaataccacattgtgcttttatagctataacttaatacattaatatatggtaaaacagttttccttagttttcatttcgaggttgacttacctaattggtgacctttatttttccaaaggcatcttagtttaacaagtttagtttatcaagtttatcaagtccccccctcaaaaattttaacttgaatttagattgaaatgacaatgaatttataaattaatttggggagaactgacatctttgtaatactacagtcatcccttctgaaggsctataatgcatcttcctttgttcaaatcatccttattttttaatagagttgtaagtttttcctttatattcataacaaacattctatatgttcttggctaatttctgaacatttcattttgtattgctgataatttttgtctaacttaaaaatatatattttctagttggttattaccaatgtagaaaaataccattaattttttatatcaatccagtatctagcaatcctgctgaactctcttattgattctaagtatctattgtttctgttaatatttttaggtaaatgttttatgtcatctacaaataatggcaattttatttctatacttctaattcttatacctcttatttatttttcttttcttatcacattacctaggacctcctgaactatgataaatagtgacagtaatattaggtacattgactttagttgcattcgcaaaaggaatgcaactaaagcattatcatgttgcataatctttgctaaatcttcctttttaaacttcctttagataaaaattaaaatgtaaatttaaattaaaaaaaaaactatttaggccaggcgcagtggctcacacctgtaatcccagcactttggaagcaggcggatcacttgaggtcaggtggtcgaaaacagcctgggcaacatgatgaaaccccatctctactaaaaatacataagttagctgggcatggtggtgcacacctataattccagctactcaggaggctgagacaggagaatcgcttgaccctgggaggcggaggctgctgtgagccgagatgacaccactgcactccaacctgagcaacagagcaagaccctgtctcaaaaataaataaataaataataaaacaaacaaacaaaaaagcctatttaattttttctaaaataaagaaaatatataattggctaatcttgaataaacacaaatagtgtttgtttagatttgaggtttaaaacatttatcaagrtatagaattttcttctaagttaagagtttttgtaataagctttgttgttaaactttatcaaatggtttttataatacctatttaatttattatatgacttttatcagttagtatactaatgaggtgagttatattaatagcttctttctcgatatattaattacaatccttagagaaatctctcctgaatatgatttgttaatgcactgttatatatggttagctactatccgtttagacttttcacatctacagtcataaatgaaactgacctgtatatttttttcttgtgtatacctctttattgggttttgaaatccatgttcactaatctcactctaaaaagaaacaaaaaaagctagacagcttcatctttcactcttttttcttttttgcttctttttttttttttttcttttgtggaataacttgttcaggacagaactcctcactaaaaccacctgggcacattgttattgttttgtttgtgtcttttcgtttctttgtttttggaataggaaacatttgactaccacgtctaagttttttaaaataattatccatccatgctcttgctttcttcttgtaccagttttgaccctttataaatttttggaaatatattcatttcatctgatttccagaatttagtagcataaaattcttcaaaagacttttcattgttttattatctctactgcatctgtagctattttccctttttcattttattttttttcatattctgtctttacttctcagtcttcctagtgatatatttcttttattaatattttcaaagaaccagactttagatttcagatacatagtcctgtttatttatccctcctcctttcttaaatgtgtcaatatggcatctttgtgtaacaatccaagtacttgagcaccctctcaaatccctctagactctttcctcyctacccgcttcacctccccacaaacaagctctgtctaggttttggctctggattcttatggataggctttctcttttctctctgttaattatagccttttatttaagacaatataaataaagtttttccaagtagttaatcattcttacttttcacatctctagaacttgtcactcttatttgtgttctctaaattttcagtaatggattttgtaaggcaaaccttccgtaatttcatatgcccaaggaacttttgtggtttttttcatacattgaaattgtaatttaatcagatatcaaatactacctaaaaatatttgttcccatcatatttaaaaatactattccattatcttctcaaatgcagtgttgccattgagaagtcgaatgttaatccggttcctgttcttttgtaggtgatctgctttttctttctagaagctttaaaaacaatatttcttttatttttgcaactcttacacttcattatatgtcttgaagttcatttatgtttttatctccagtttcacactctatacactctttaaatctgatctgttttatctttaattctgagacatttatctttatttttatttaagcactttctcctcttttatttttcttttcaggacttttgttagctagatgttgaaatacatagtctatcctccaaataccttagctttttaaatgttttcttcctctttattcttactttttatgttctcaaagagttctttaatcagaacttccaactcacttgcttactctttagcttatttaaatcccttattcaccctatctgctgtattcttactttaaactgttaatatattaatttttatttatttgatttttaaaaaatccttttttatattgttaatttacttacctccttaaataaagttattgtgcttaatttaaattctgttctaataattctgtaccagatgatcaatctcataatggttgtggtctttctttcacagtagtcttactcttcagtgaatggatattctggcctgtgagctcgtgtccctttggggttatcggctcctctgcttggtaatgcaggtattagaaaaaggccacagacatgtgaaggattggcagtgattactccatggcaatatgaaagacaagcaaaacagactttttcaaaactttcttccaagccttcctctctctttttttggtgctgtttggttttgtggggkttttttgttgttgttttgttttgttttgtttgtttttttgacagagtctcactctgtcacctgggctggagtgcagtggcttgatytcggctcactgcaacctccgtctcccgggttcaagagattctcctgcctcagcctcccggatagctgggattacaggcacccgccactacgcccagctaactttttgtatttttagtagagacagggtttcaccatgttggcaaggctggtcttgtttgtttttggttctgtttttgtttttttatcagactaatgctggctgcaatgaatgagttgcgcaatgttccctcttgttctatttcctggaaaagagtatataaaattgatgatttttattctttaaattcttggtagaattcacagtgaagatacctaggcctggaaattctttttctagagattttaagcacaaattcaatttttaaaaatagtttcatcctattcaggttatcttttcattttatcttgcacaactttggggatgtggtgattttcaagaaattggtccatgtcatctaagttactgaattgatttccatagaattgtttgtactattcaataggacagggacatgtgatcccccacagggaggcagtgaatcttgccaagcaataatacaacctactattgaggcaggagaatagggtctggaggcagggaatctaagaccaattcgtgctgacttcccaaagctggatcaaaaggaaaatacctgggtatgaaggcaggaaccctaaggccaattagtgtcaacttcctaaagttaaaccaaaagaaaaaaccccatctccccatgcctagtaacaaaggttcaaagcctgctctccctacaactccccgccatccaccacatctcagatggaaagggaaagtgtcctggattggccaccctaagcaccggccatcccttcgtctgcattcaattcaccccagcctttwgttagccacaaaccaaagccttcattcagataaggggtagccgatagagatctcaaaaggagtacttaaaacccaggaaactttgtaagcaggcccttgagccacttgcccaggtgcactctcaccttgtggagtgctttcttgctttaataaatccctgctttctctgcttcattcctgcgtttcattcctgtgttactttgtttgtgcattttgtccaattcgttgttcaaaaacgccaaaaacctggacatcttgtactcgaggcctgccttccagtaacaccatgggttgaaggtgacattgtgaatgttacagcaggaccttacatattactatatacagaacttgctctggcctattttaaattgtgttgtcccaaatgttttcagaaaatctaattttaattttccttttcataaccataggggagggataggatatagtgctcacatggcatcatacatttaacaaatactgattgagcacctactttgggtcagacactgttctaagtgctgagtgatgaataaggtaagagccagatgattatactgtcatggaacttacattcaaggggatgaggcagtgggaattgaccaaaagctaagtaaataaataaacagagtaatggaatagggacagtgtaaagagctgacttctaggacagcacctatagtaggaagtctttcttgattatcacttgccacttcctccaccgatcccagaccctggtctcaactagggtcgtcagaacaggtgtctctttacctgagacctgtgagccaagacttgaataatgagagtgaatccacaaagaagagcattccaggcctagggaygagtaattactacaccctgagggaggagtaagtttggccttttccatctgttacaagaaagctaatgaggctgaagaatagtgaaagtggggaggagtgcaggacagagacggagcgtacagggctttgtaggccatggtagggattctggattttattctaaytgcaataaagaagccattgaagggttttgggcaagtaaaagataggatgaaatcagatcacattcacactataaaaaggtcactctggctaaagtgtggagaatgaatgcaggtgggaccagaatggcagcagggagaccagtaggaagtgtcatcaggacccagccctcccttgccatgttgaatcaagagccacagacaggggccaggctggcaactgccagtctgtgatcaatctaatctgccatgaaattgggtcttctgatataagtggatcaaaggaataataagagaaatgatgtcagaacattcctctagtactaggatgcctttagctgacctgtgaagggaggatttagatgtcttagatgtctgttgcacttgcccttgggcagaaggcaggtggtctgcagagcctgatgaccttcttccggaactctgttgagggtgaacacatcaaagctgtcttgttcagttaattctccactcactctattacctccttaaaggctattgtcactctcctcctgggttcccaccactacatcctgaatggagtcctgcctccaggctcacccccatctaattcattctccacattgcactgagaatggtctttctaacaagttgagcttaaagtccaccaaaagactcttcctccaattgcctccataaatgacatgatcccatccctgcttacmtccccagcactctctytcctccatcccacccaattcttgctctgtctcctgctaaaccttcaacttctcaaaggggccgtacttttgcacaggtctggaacacccttctccaccaatttgtggccagcatccaggtcagttcctaaagtaactttctgattagcagttgtcaccctttgccctatcccgggcccccacttctcaccctgtccttgccagccaggcatcattgcacgcccacatccaggttttgccagcccacaatgtttatctctttcccagagcacttagagctcaaggttatatttgtttctcccaccacagcatgagcagcctgaaaggttgtgactgtgtcttttccttctttatattcccatcttttagcccagtatttagaacccaacagacactctgttatatatttgttgaattagtaagagtataaacaggtaaatatactggaagacgctgtgagaaagccaagtggctcaccccatgtgggctgagcaggtaaccttgycctgttggcagacttaggctgcccctgacagtctagccagctactctgcagatgtgcgccattgattctaacaagggagagtcaaccacaaacaagcttctgggaaaaagcaaatctaagtgttgataaccagaggtggccgcctgcacttctatggcgcaacactgtgttctgcgcttacagagaaacctgctgaggctgttttcagagacaaatgctgacattgtggcttcagtcctgatgctgaggccagaaaagtggacagacacttgccagggccattaaagctgatcattttaaaggaacacccaagaatccaaaacaagtaaagagcagggccaggacagagaaagtctgtcccagcagtggtggtcccctgactgcactgcgtgtcatgtagcttgctccactccactcagcattcagcctccacttcccaaaacaaaccaatttcagagcaattcttctggtgaacgccatggtcccgttgatctcacaattacatctagaaacacttaactatgagacatttcagtgtaccaagcacttgttgtggcttttctcttaacttagtaatcaccacagcctgtgctaaaaaaaataaaaattaaaagattctccatcggtctaggctccagttattgcaccaaaaggaagaaaaaccttccagttttgctcttggtcttaagattttgctttgggaaaaattactgagctgatatatgttggggtcagaggcgagtttctgataatattaaatggtgtgacatccagagagctaggagggcctgaaatttgccctgacagtctcctaaaatgtataaagccccagtacgttcacaytgaatacagcagaacaggaaccagtgtgttctttattattagctaagcaaagtccaataacccccaaagcagaacaaaacaataaatactaggacacaaagcttagactccaggctaaatgcaatctcttatcccctctccttcctatcgcactcaatccaattcttggaaccagcccactcaagacatacctactgggaaagggaaagagggggagagggaaagaggaggaaagggggcaagtgggagagagagacagacattcaatctacagtattcatccacacagccacaaggatctgggcagagaacacagaccacagggctcctctgaggcattgcttagtttaccaattccacttcttggcctctagagaagaggaaaatgtgccagacaaagagaaggttcaaatctagctggtcttcagacttgtctgagaagcttcagtaaaacactgattccctgcgccatcccctgatattctgattcagtgaatctgctatggaaaccaggaatctgaattttaataaggtcccagtctgagaaccattagtgagcctctgccttctcttgtctgcaaaaaaaggaataatattttggacaaggactagagttgcaggctgaagcaggttgaaaaggaatggttttgctgtaaatgtgaggtcttctccaagttccgaagatgtgaaaatcccaggttgctgctcttgatagtctgtgtgagcaaaatgcttgttgtctttacattaatgccacagactaaatcacagcaaatggaatctataaacaaccaaatggccttgcaatttgtcaaagggaaggcaagcgcacccagcaacgatgcatcattgcctcatgcacatctggggagtacccgccccccgccaccccaccaaccagctcattgccggcctggaaggaagaaagcatggtccttcctctcccagggtgtaatctgggacgtttatcccatccagtgtttggcaccccttagaaaacacttttttcttaagataattttattcttatttttctaactttaaaaaatgaatcactattttatatgatagccattcaggtattcaaaactccccttgtctaagtcatctcagtttactgtatttgtctgtaggtctagctttaaagcaactaatatgtttgagcctttaaaaagtatctgtaatataaatattaaatcaatctacattatcaatatgaagaagcctgcatgagatcgtttgtttccccattctgatgtttagatttatatgtgtatttgtatgagactgtcattttgagatttgtggggagatgttttgttggggatacattggatattggaaagaaatttggggttctggctccttcaagaagctgagtttattgcatgaagaaacctttcttcaggaaaaggggctattagtgcataccttaggagtaagctaaagaccaagggcactaattgctgatcttctaaaatgagaaactcaaacagtgagatgaaaggggagaaagaaargcagacaggctggttgttccagaggccaggtcaagaatgaggagataatagcagtgctcccaaatcagcagggaaggagacagagacagctcacacctgtctcctgaaatgtaactgtagcctctaggggtaggtgggatcaggaactatgaagagttctaggacactctgcagatgacagttagcttttctgcagctattaaggaaatcagtttgagagggtatggatatttgatttgaacatagaaatttttgagatctttaatctttggggtttttttgcttgtaagataaatgcaggtattaattaatcctttgctgtatgcatagatttctatcttcagtaaattcaatcatgcattatatttcctgctttagtagagtgcaaacagcacttaagccatctgaaaatatgagttccagcaatctgagtcatgtaatctttctgagtgcagtttccttctctgtaaaataagtatatctataccaatctgctgtcctctcaagtttcttgcaagaattaaatggaaataaaaacacttggtaaaggataggttctatagaaatttattgtcattccctggtataaccatgcctgcagtaggcaatgcctttgttctaaactacgttaggccagtgcgccctcgacgggtgtgtggcagcaagttgaagggcagtcctggtgcgggggcagttaacacatctccaggggggccttccataaaccgactctaaccacctcttcctgacacaggaggcttcactggtgatctatgatggggtcttaggtgctcagggttttcrgtraggttgctatgttgccatccttgggtaggtgctgtcacttactctgacccaccagcgggccctgtgtcacacctgtagtgcaccggttctgccactagggtatactgcagtaactgacacgtgcggtccctccccagcctctcttcctgactgcaacagttcaaggatgcagaactagatcaatcgcagcatgctcttcatcaacccagaagatcatactatttacagagcacccaaaccaccctttcccacacagcaagctctgcctttagctyrctctagcagctcctgcagttcagaaaagctcctccggtgggctttctgcttcttggcttgcctgctcagcattaaaatttgccctgaagctaagctcttcaagacacaggatttaagctcctctttcagctaattagatattgttctacaaattgggctgttgtctctgaaagatgagctgcaatttacttcccctgccctctccttaaacttaaactgaactgtaaaacatggctacttgattgtttagtccaatcaggatgtattttgtacaaggaatagataattcatcttcttgctaatgccgagcttgtttgggcattccttaatggctactgtaaagatgacagaaagctttgctcagatgcctctcattcttttgaaaggtggagtctgcagtgatttattttggcccatgcatctgtaatcattgcctgagtaaccaatcactacctgcattaacacatctttgcccttcaagggggagacttttattatccccattttactgataagaaaactgacgcccaactgatttacttaaagtcaaataaataggtaactggtggagctagaccatgaacacagacctttagttctcagatcccatgaaattgtatgttgtctgataagtctaacaacagttgtggaagggaaatccaagatgatgccaagtccccacacccacaccttgagctccgttgaggatttcttacagctgttgatgatgtaccaggaggcctgctaagaccttctatgatccaaggagctcttgtgcactgtgagagaaagaatcctttctggacattgtctattttccttgcaggaggccgggtgttccctcatccccaagactgtgcccagcatttgatgaatggagacaytttgagtggggtttaccccatcttcctcaatggggagctgagccagaaattacaagtgtactgtgatatgaccaccgacgggggcggctggattgtaagtacaatctgtgctctccttgcacagaagcgtcctcagtgttctagtctacctagctcagcacctgccaagccaacttcaccatcctcctggccatccttttatcaccccccacatgtccatcytggggctcctcattgccctcaaggcccatgttcagagtccaatcatatatctggccaggcagggaaaggaataactatatctgtcctcacagaaggaggaggaaaggacagttaagcaggagagtgctggggaaaggcagtcgcggstctgttgggcccaaggatcttgcctgctgagaaatgcatctctaataaagcagtggaggtgctgggcagagtggctgattcctgtaatcccagcactttgggaggccaaggcgggtgatgacttgaggccaggagttcgagaccagcctggccaacatggagaaatcctgtatctctactaaaaatacaaaaattagcyggtcatggtggcacatgcctgtagtcccagctactctggaggctgaggcaggggaatcacttgaacctgggaggcggacgttgtagtgagacgagaccatgccactgcattgtagcctgggtgacagagtgagtaagactcaaaaaacaaaacaaacaagcaaacaaacaggcagttgaggaaaactatttctctatgaggaggtgatcaccaccacagagagatgatcagaagcctccaattgaggattgcagttgggaaagcagatgaggccccaaacatggatagctggctccccttccccattcttcctggggtctccctggttcttccccagagctgacacagccttcagggagcaccagtggtcaggaaaagagagacactgtttcctgtcaccaccctcctcccatgcctgatagggcaatacagagtgagggaaaataagggcagcctccttaatgcaagccggtcggagcagccgggagttcccaccacttggccctaaagcagcccaacattagctggatcgctttaggatggaaaaccagcccctccgcccttctttggatgccctctctcgctctgctaacagtgctggatgtttcctggtgcaaaatgggtaggttttgaatggtgatgtgctcataacagctactcttgggagacattttcttttatgtttctgacatatgtgtgcctccttcttaaagcataactggaaattgaagccaaggctgatatattggaggctaaataaaataagcacttaaacagctcagaaagtgaatgatatgcaatattgctttgcctgcaataggacgatgacagttactagctgatttgaagttggtcctgttcttttggtgagaaatgctttctactgcactctgtagtgcaaaagattcgtttgagagccaagcctatttcccctgatrtttagggcttgatatgtatcctgagtcctttctacattgcaggggtgcaaattagtgtcaacatcacactggagcctattcatcaggggcctctacacttcaagagaaatgctctgagtgtctcctacaaaaactgctgtgtaaatactgagctctgctctgaaatgttccttctttggacatctttgtcattgcagatataaaacccagttatatcaattttacttatcacagtttattttccttagcatctctttgggttttgtttttttgtttgtttsttttttgtttttttatttccttcataggtrttccagaggcggcagaatggccaaactgattttttccggaaatgggctgattaccgtgttggcttcgggaacgtggaggatgagttctggctgggtaaagcctccttattgctttccattgatgtgcttctctggctttttgtccatctctctcctttttgtgtccatctgagattatcagaaaccctgtgtttgttgagaagctaacagctcctgaatygctttcagaacctcttgctctgtttagcttcactattgatctgtttttatcttactgtggtgttwccctcttttctctgtctcttcccatcctcattaatagtctcttattctgatgggttttgacatgaggctgccacaaagggagtgagctgcctggtcggtgaggggcacagggagcaacaggctgcctggccatctcccagaagcaaggcaaccagccagccagcctgcaggtcaggggagaaatgaggacagccactccgcttagttccttggagaatgttattacctgacctgggaaagaaaagggaaaaaatgaaagtggcattagaggtgactggcaatttcctagaagtctgacaccggcaggaaatatagatcgagaaccaaactggcgtgagatggtaaacacacatccaagccaggcagatggtggtggtgccaagttctggaaagtggtccatttattatgacctgtgtccccctcttagttagattttcatagtgatggataaagggaggtagaggaaaagattatcaagttccatatttgtggtctcctctctgtcttccctgccactatctcatctcatcttcttctcctgggtgcctagataacaagcttcttaccggcctctctgcctctaggaccaccccattgtccacatggctrtaatcacccaacaggttcttcttgtcttttgcacagataaacccaattctctgagacagcattattgcaataaagaaagagtttaattaacacaaggccaccaagtggaaggactggagttattactcaaatcaatctctccaaaaactcagaagctagggtttttatggataatttggtgggcarggggctagggaatgggtgctgccaattggttggggataaaatcataggagtgtggaaaatggtcctcgtgccctgagtctgcatctgggtgggggctgcaggcccagttgagtcatgtgtcactggtccaggtggggtcacttcgttgcctgaatgcaaaagtctgaaaaacatctcaaaagaccaatctgcaatagtgctgttatctataggagcaactaggaaagtcacaaatctctggccacatgaccctgagcagtaaggrattatagaaactatgcctacattttagcagaactcaaatccctccgtaatcctaatctcttggcctttcgttagtcttgcaaaggtagtttcagtccctgaaaaaggaggggagcagtttcagggaggactattatcatccttgctttaaaattaaactataaactaaattcctcccatggttagcttggcctatgcccagaaatgagtgaggagggcagccagccagtgaggccagaagcaaggaatcagccatgttagatttctctcactgtcatgatctttgcaaaggttggttcatgaccactataatgatcttcctcayaccccaaatatgggcgatggctaatcccctttgtaaaacttttcaatgactccacattaccaccaggagaaggcccaatgccttagccaaagtacaggccctctctcaccagcctctgaagactcctctacaccctaagtacctcacctgctcttcccccgactcctctccaacaccaaactccacacatgcaaaacccccgatgcttcctctgccaggagcactcctagccaactgtcctcctttccccacattccttgtgtggtgagtgccatctgtgtatattcagagacacagctaagcaccttctcctccacagagccagtcctcaccagttttctcccctattgcctgtgggagaagtggccactccttcttttgtggcacagatcatagtgtccattttacttcctgtctgtctctgctatgtgagcttcattgagggctgggaccacctcatatttatcttctaaccccattacctatgtacctatgacagtgcctgagagatagtaggtacctaaaatgtagataatcaataaatcaatcaatgataagaattaatggaatgcatattaaatccacagatttgtgtttgctgatatagacaataaaaatgtaaggtaaatgccatacaaaaacattgacataaaagtcaaacaaattgaaaaatattcttaccttgaaagcatcagcaagcaacttgggagacaagtgtaatacccatgaatcgatacatccataagcagacaggactcacgtttcccaaagctgagctgctgtataccattttcacaatttgtgtcatattttctgaaatacataaactatcatgcacttaaaatttctataattactctttaattaaatctatttttaaaagaaatgttatagcattgccaaaaatagaaagctagttatcatgtgccataaataaaaaagaaaacctcaaaaataaatgcaattaaaagaaactatattaatagtactaaatgagagttaaatacagggactccaagcctgttgttgctggcagtggtggtggtattaaaaatggagattaggaagtgtttcatgcttttcatgctaaacaaaccactaaaacactagaacaaaactgagactgtgagtgaaggttaggatcagggttaaggtatctccttcttctattacaaaagactgagattaaatttggaaatacctttcttcctattattcaaggttatttagtgccttatatatctcatgtcatcagagatgccatccacactgggtaacactgttctaacctaagagtcactgaaaagaaggccacagatattcaaagaaggaagagaccagcttcctggagaaggcattgagggatgagtcagtcagaagaatggaggaaggaaagggatgaaaaggagggaaggcaggaattctcctgacaactgcaaacttaggccagggaggaaacccaatcccagtgagggaaagaaaacaatgaggtgagtgggttgaatagaggcacagtagggaacttaaaaatcagaaagagaagtctttacttgatgatgtaggtaagagggagacagggagggctcttgaagatgctaggcctggtgtggtgtagtttggaagcaatactcaagttggggataacactgtgacccatagtttatgtactatatggggttctctagaagcagagatcaaaacagggattcttgttcaagtgacttactgggggacttcactggggagaagggaatgggggaacaaaaatagggcagagaaaactgcaaaaatgtggttttggctggagactcacttcagtgtgatccctaaggaagcttgggagcatgaattgctcctcagagctggtcaccacttaggcaaggaggccaagcttttgaacccctccacatcagtcactgatggaggtctgctccaaggcatggtgggagagagcttagcttccaggatgaagtgactcccatttgctcaagggcaattttccaagaagaaggcagctgcaagttgctaacagccaacacttgtagcagcctgggggatggatctatctgccaattaaagacatcccagcagaacaacatcagcatctactacatctgcacaagcacaagtctagggtgagttgtgggtcagcaactcagtcaacagcaaacagcagtcaaacagcctttgacttataatcaaggtaaagctctaagtctcaaatgggacaggaaagccaaaagatctggatgaccttcagccaatcatttcacctctcttggactttagcttcctcttccgcaaaacagacactggcctgagtaaccactaaattcccttcagtctctgcaattgtttgattctaaatcacggcatactcaagtagagatcagatgtcacagcaaagcaaggggactctagttcagtaagcagataaaaattaggactcagagaaattaccagcaacacaagatgaatggttcaaagtttgggcaggtagatcaaaattggagagtcccagggcatggctaatcatgacaagcaggcaagaaaatgtatataagaaaatatcggccaggcacagtggctcacgcctrtaatcccagcactttgagaggcygaggcgggcagatcacgaggtcaggagatcragaccatccyggctaacayggtgaaaccccatctttactaaaaatacaaaaaatgagctgggcatggtggcgtgtgcctgtagtcccarctacttgggaggttgaggcaggagaatggtgtgaacctgggaggtggagcttgcagtgagccgagattgtgccactccactccagcctgggcaacagagagagattccgtcgaaggaaagaaagaaaggaaggaagggagggagggagggagggaaggaggggaggcaggaaagaaggaaggaaggaaggaaggaaggaaggaaagaaaaagaaagaaaggaagaaagaaagaaaagaaagaaagaaagaaaagaaagagagagagaaagaaagaaagaaagaaagaaagaaagaaagaaagaaagaaagaaagaaagagaaggaaagaaagaaagaaagaaagaaagaaagaaagaaagaaagaaagaaagaaagaamgaaagaaagaaagaaagaaagaatcaccaagagggatctggactctgcctaacctggggacttacaaaggtttgcaccttaaaagaatatattagaccaaggcctgggaagtttagaggcaaaggaagaagcagatgaatgagggtaactggctgaaaaggccagtggaaaggtagcagtgcaaatgtagcaggcagattagagagaaagggactggagtcaggaggcagagaataatattctatgacctggctatggagccccaggaagcctaggctgaaggcaggagaggcagtgtaaggaaagttcgacagagcccttcctacatgctactaggagatgttaagatgttccagatgctctgaactcctctaatcaatgttttcacctcttgctttcgatcactcatgcccaagggctcacatccatgtaatacctcttgtaattttcttctagtaccatggtttggcagaggaggtgagaggggacagggccaggaatcctgaggctcagggcttgtcagttactgggtcaagaggaggtattagaacccctgagtttcctgtgttggaaacccatcagcagacctggactgtcctctttgcaggaagaaattcagtctggcagggtccatttgataacaacctgtgaagcaccaagagcaaaagcaatctggagtcccctcctcttccctgtaacatgttttgaagccacagacgcatttccctcccattttccaaagctgctgggggccagtctcagtgcattttctgctcttctccacagggctggacaatatacacaggatcacatcccagggccgctatgagctgcgcgtggacatgcgggatggccargaggccgccttcgcctcctacgacaggttctctgtcgaggacagcagaaacytgtacaaactccgcataggaagctacaacggcactgcgggtacctatggctcctgagcagaccccaaggacagtgggcatgggacaagagcccccagattctaggcgtaagctgcctcaggaagcagcagcacccacagagttccagcattcgctgctggccagggagaagaagggccatgccactgggaaccactggcactggtcccagctctccctgaccagtcacctaaaagcaactttgcaggacttcagtttcatcatctggaaaatcataataaggatgcctgccctacttcactgagtagtcagaaaaaaatcagtggagtgattgtacttttaaggtttaaaaaagatgcaatgtgaagatgaagaaggattgttttctttgtctagattagtcactatgggctcttatgcagtgagagcagaatcatctactgtctgggtagaaatctcccatgcaatgacatccaggaaaaccatctttgaattagtgcaaatcatacagatgtcacccctctctgagatgcccctaacaccccaccctgtccatcagcagtcatgctaacacctagtcaaggagcaaacaatgccacttacctgttcctcatttgccatgtttcttttcattcctcygcaagaaccacatagacagtcaggttttctgtgtagatttttacagcatttctaccaagcagaacaaccatcccatcaagcttggttgcattagtagttttttcagaacataacacccagtctgcttcttgggctttgccaatctgtttcccatgttctattataacacatttcacaaaacctgctttttcaaatattctaatgtttgatacttggcattattggccctttcattaacaccaattctagggttaaatgctggtgtataattttaacaacatttttatgactcttgaaattaagaagagcattaaggtgttgtccttccagttactgcatctgttcaattatttctcttcttagccagatactccaaagagaagacatgctttcctttattatgctcacatctgagatcatttccaacagcaatgagatcagcctgaagtgcccccaacaaaaggcccaatttgccacactttgggcataaaatagccattgaaatggagcatattaaacaagatgccggactaaatcatttaaaaaatcacctgacgctattcacttctaagattagaattgtgcctgtagaaaagccattctgatttctcctacaggaaaagaagccagccctccaacttccctacagcaccccctccctccctcctcttcatccgcctgtgctttcatctgccttgcttgggcctggcccttgctccctctgttccagctctgtcttgcttctgggcctatggaggccagaacagttggactgtgcgctattctcatgtctcagaggcagatcctgccaacagtttggctgttcatcatcagctaattagggtcttatctctcacctcgaatattcagttcatcttcttcaaaagatgaaaagctaggcttccgttaggctgccatcccctctaggcaacaccacacaatggttgttctttctagatcagaaggtttctggagaggaagagcccatcccctctcttctggcatttaatattgcccagttctcctggaccttatctttagtagtggccttctgaatcaacccatctccagggcctccgatccaagttcagccttttctcctgctccccatttcccaaggctgcaaacattcaaatctctaggatgctacttggatcagaactgaaaattacaaattaagttatcaatcagaggttgttgagcagctcctaaaagtttattgtgcaagttgtggggactcaaaagaagcataaaacatggcctttacaaaaactaawcgtctagttttaaaaagaaacaggaagtaactcatcacacaatcaatggtactcacttctagttttttctgtttttgtttttgtgtttttgagatagagtctcactctttcacccaggctggtgtgcagtggcgtgatcttggctcactgcaaccactgcctcctgggttcaagtgattctactgcctcagcctcctgagtagctgggattacagacacatgccaccatgcccagctaatttttgtatttttagtagagatggggttttgccatgctggccaggctggtctcgagctcctgtcctgtggtgatccacctgcctcggcctgccaaagtgctgggattacaggtgtgagccactgcatctggcatctcatttctagtttaaggggtgttygtggaagaggagtctgggtggtggaggacggcatcataaaggcagctgcattcgactgggattcccatggtaaggaaaataaamcctggaagttacagaaggagcagatgctgtggaggaggggaggctrtgaagggactggcagagcagggcaaaatgtaaattcaggaggaatagagaagattggtgaggcaggtagagccagatccagaagctggaaaaccaaggggcagaggaattcagtcttaacatggtagcactggagggccattgtaggtcccaagaagaaaaatagaagtggggtttaggaagattcctgtgacagccacaaacaggataaagtaagtccgagcgaagaacatagagcggctgatggctgctgcatcagacctaataggagacaataggagtcttgactaatgttggaaattaagaaaaaggtattataaatctgaacagtggtttgagagacagaaaccaggacttagtgtgttaaacacatgaggtggctatatgaggcagaaatgggaaggggagccaggctttgggaggatgtaaagaccaacactgggagcaatctgcgacagtggaaggcagcctcagagtggaagctggagagaactgctccaggggaataatgaagacaaattctagatgacagagggagacgcagggagtgagaagataggatgtgggtggagaccgcrtaatcaaggaactgatagtgaaagaaataatcattaaggagtaggattaatctaagaatttttaagacaaaggatataaatgtaacttaaggtgagaggaggtgaaaacttaaaaaaaaaaaatagaagtaaaagggctgggctcacacctgtaatcccagcactttgggaggccgaggcgggcagatcaygaggtcaggagatcragaccatcctggctaacacagtgaaacctcgtctctactgaaaatacaaaaattagctaggtgtggtggtgcatgcctgtaatcccagctayttgggaggctgaggcaggagaatcgcrtraacctgggaggcagagattgcagtgaaccaagattgtgccattgcactccagcctgggcaacagagcgagactgtctcacaccaaaaaaataaataaataaaagaaaaaggaaaaagtaagcaatatgttttaacttttccaggatctggaagagatgggaaagagtgagttgcagatggtggggttaactctagatgggcataaaaatctgagtccctggagactggaaggggaagacraagaagacggaatgaagatcatgtcatgttgagttagggcctccccagtgagggcgtcagccttccctataaaataaaggtcaacctcctgagagttaagttgtggtgggaggcatcagaggcattgagtggccctgtgagcctggactcagaagccacagaatcagaataggtctttcctcgcttaacacaagctcaaaagcacccaagacctctttcattcaataagtagcatgagcccccttcacaacatcytgagccacaaatcctgatcctgctataagttttataaactgttataatttaattacagtctgatccctcaccttaaatacacaatttacctgagccccctgcacaatatccccaaaagagaacacgcagcctgtttgcccctcagaataaaaatctcaccacctctttaagcagtctattccacttgtgaacacctctaatatttaggtaatttatccttgtatatttagcctaaatatgcctctctttttttattacactctaagttctagggtacatgtgcacaatgtgcaggtttgttacatatgtatacaygtgccatgttggtgtgctgcacccattaacttgtcatttacattaggtatatctcctaatgctatccctcccccctacccccaccccacaacaggccctggtgtgtgatgttccccaccctgtgtccaagtgttctcattgttyaattcccacctatgagtgagaacatgctgtgtttggttttctgtccttgagatagtttgctgagaatgatggtttccagcttcatccatgtccctgcaaaggacatgaactcattcttttttatggctgcatagtattccatggtatagatgtgccacattttctttatccagtctattattgatggacatttgggttggttccaagtctttgctattgtgaatagtgctgcaataaacatatgtgtgcatgtgtctctatagcggaatgactgataatcctttgagtatatacccagtaatgggatggctgggtcaaatggtatttctagttctagatccttgaggaatcgccacactgtcttccacaatggttgaamtagtttttagtcccaccaacagtataaaagtgtttctatttctccacatcctctccagcacctgctgtttcctgactttttaatgatcgccattctaactggtgtgagatggtatctcattgtggttttgatttgcatttctctgayggccagtgatgatgagcattttttatgtgtctgttggctgcataaatgtcttcatctccacctactaatcctcatacttccccacagaatttatttaatttttttctcaatagcccatcaaatatttggtgacagtgatcacaggccatgtctccctcttgaagtccgctcttccccaagatacagcccagatgtcccaagcacttctcctttgacatggttatgtttttttcatcatcctgtttcttacggatgggaattctaatttgctgatgcccctcttcccatgtggcctcaagttcagaatgcagtttcttgggtgtcatctgagcaggcctggtaagccaggkagaagccaggctgaggctgcatggtggtgccctagaatggcccaagtctgcctggctcatcaccatctcctctgaagacaggaggaaccatgagtggcctgtgtccacgtacaggctgggaggaaacagctgagggttgggggtggggtgggcaatgagatggggttaagtggagaaaattctcagcaaaggtggtcaaagggattaggaagtgggttggagagagtagcatggaagtggttggccccaggggtaaggtggagtaagagttcagcacagccactctgagaaactgggtggaaatgaaaaggttccrtaagtggaagccaggtttgctggaagtgggtcaagtgtccagaaaatcctgataaagcagtgacaaatgggacagcctaatgaatgtatcttttttgcaggggactccctcagctatcatcaaggacgccctttctccacagaggatagagacaatgatgttgcagtgactaactgtgccatgtcgtacaagggagcatggtggtataagaactgccaccggaccaacctcaatgggaagtacggggagtccaggcacagtcaggtaagcgatgctccacctctgctatgaatgagccagagctgtggaatccgtgctcccttagctttatrttttaaaagcacatgtgagtccttcatttccctttaaaaagaaatattttgagtcttgrgaaaaataatgcagacaatgggataagatcaggacagagtagaagccagaggaaggaaaggaaaggacccaggagccagaacttacccagagaagcccttggatccagaagatcccatgaagagagcttatcagtcctggggacagcttcacagactcaactttaccctaaaaatggtcccaggaaggtagacatcgaaaataccagtgtgaactggacaatctttccctatcagagaccacaagtttataggctaagctgggtgacagggagaccaccatgaccaactagactttctaagtgttaacactgaaacagcccacatcagggaagcccttcagttctaggcaaaccaaaagggtttgtcaccctaggtagaaaccgcctaagtctcccattaggagtgagcagtcaaacacagttattctcttccaaatgcttccaccctgttgggatttcacaaccatctactggtgcatgccactcctggaagccaaaaacaaagctggcaataaggaatgacctgcaacatgttccctggaaagacccaggccaccggcacatttaaggagaaagctagaaagagactctgcccctttcactttattgggaactcggccttgaagcttcatgttagctgaaaatagctaaccccacattgtggattccctgttcccataattaccccttttwtgaagtggggcgttccatggtgggggatgacctgacatgcttatctttctcacgcccagggcatcaactggtaccattggaaaggccatgagttctccatcccctttgtggaaatgaagatgcgcccctacaaccaccgtctcatggcagggagaaaacggcagtccttacagttctgagcagtgggcggctgcaagccaaccaatattttctgtcatttgtttgtattttataatatgaaacaaggggggagggtaatagcaatgtgttttgcaacatattaagagtatgtgaaggaagcagggatgtcgcaggaatccgctggctaacatctgctcttggtttctgctgccctggagcctgaccctcagtctccattctccctcctacccaggcctcctcaaccttcacctcctttcccaccaaggaggagaagtaggaagttttcttaaagggccaattcaaagccaagtcgtggggtgcagattgttatggtgacaggcacacacatttttctacccttcttctgagatgtcctctgccttccaggtatttgtgattttgtcacagcctgacatggccaggttctcacactggcccagagaaaagagcctcagcaagagagttttgccaacaattccccttaaaaggaaacagatcaactacaccgcatcccaacaacccaggttcttttccttccttccttccttcctcccttccttctttcctgccttccctccttccctcctttctttcttgacagtatctcactcttgctcagtctggagtgcagtggtgcaatctcagctcactacagcctcgacttcctgagcttaagtgatcctctcgtctcagcctcttgagtagctgggactacaggcatgagccaccatacctggctgatttttcttttattttttgtagagatgggggtctcactgtgttgtccaggctggtcacaaactcctggccttgaacaatcctcccacctcagcctcccaaaatgctgggattacaggctacagccactgcatccagccccaagtcctttataatgggccaaagattctcatcttctgacactcttattataccagccacatgtcctgttacctttcaagaacagtggctcttttctggccctgatggagtcttttgcctaatcccatcctgtcttagaccccagagcctcaaaagcccaaccagcattttggaatctagttcccaaggcattgcctgctcctggccctgggtggcacagtggctatgtgcctgtgagtcatcagccactgcccccaccctcaggtcagacagacagtcactttctgcaaaggtaggagggggagatggttgtagtttttagcacttttgggtcaagcattgaggaaaggactgaagaagtcaaaatcagggcactgccatagagattatagtttccatgggaaacacagatcttccctagccctgttttctccatttctggtcctatttgtcacagattctttttttctgaattgcaaaccgaaggcctcatatctatcttcacccaagccctccttagtgtaggtggcttaataagagtcaggagaagaaggtatatgcccagagagctatacccctgactgataatcctggaaagaggttgattttttttttcttttttggtcctatgggaaacaggaatgaccttcttaatgaggtgagatcatgagaagcctttccatcttcttttattattctgccttgcaaaggaaaaatgacaatagccaaaggaaattacatccagaaatccaaaggtgaataggtgataactgtgggcctacttcccattttatgagatgcactgtcttcactagcacaatttgatcttaagcccaagagagctagatgctctagaagccgtgacctttcaatttctcctccaaatccaatatcagcaaccatccccgcaacatctgcccaratccatgcccagttccctgagctgtcttctccctttcctctcccattcctcaaggcccagcaccattttctgtagtgcctatgtttgtctgaccagagcagtgtgtacctttgccaaccagttactggatgagccttagtgtcggcaattttctaatggaaatatcctcactcttaccaagctttgagaaccaagatgaaaagtcccttgggctgaccatcaggcctcggacctcatggggatgcagccagccaccattgaatggaggcgcttcccttgccgcaggcttctaggctttgttcactgcggcagtgtggatgtgacaggcataaccctgaaaaacctaggcaccacttgcatttctcagttaaccatgggcttcaacaaactgggaggaggaaaaaacagaaacagatcctttcaacaagcatgtaaattacagaagacttacctagagacggggcaacaatgaatagtaggaagcacattgcatgggaaacttgagggccgaggtacaggccaacagctgtcatcttagctacgacatgacatcggctgggttgtttcacctctctgggccagtttcttcatctgtcagatgagagattagactagaatgagttctaatttccctttcagttttgacggtcaatgatgctaatctgtgatctgaaaacctaagtagaaattggcatggtgggacagcacaattaggtaatgaaaattcactagactccctgtttaatgaggaaagaaggaaagaaggaaggaaggaaggaaggaaagaaggaaggggagggagggagggaaagaaaagagagagattgattcaggagtcataagtaaaacacacacacacacacacacacacacacacacacgaaaatactgcagaaaagatcatgccgagtgagaggctgaactctttttgtccataaaaacagagaccaggtacctgggtggtgccagcacgcccacttcatcaaggaagttgaaatggaaaaagattatgtgttgtcaattcaggtgaaagtcaagaaacatcagtggaaacaaaaatcttccttttattgaaaccattctacactatggaacatttttataaatagtaccagcggcattgcatagctttattttgaagcaagaaagagacttcaaagatcagcttattcaaccctctataaaaggatttatagattccttttatttaatagggtgattttctcatgagttttcaccatgtttaaaagacactgtgccccactctcatcccaaggtctatggtcaacttgactcaatgctcataactttcctcgctgattcctgcttatcctgctcctccaagcacaactgcatttcccaaaggtagatccagtaagcaatactctcaaagcacccaccctatgcacaccagtttccctcaagggactcaaaaggaatcgaggtagacccttctcagaggctgtttaactacagacacatcaggatatgtactaatacccaaaaccaaaaccaccaccaatgactgcaatagattcactgtctagacccaaggtccaggcagtttcccttttttgcatttccccaacatataaagataatttccaacatatcagatgcacattcaccagggttatttctggaaggtgaaggggtcaggtgtagaagaggtggcaagaatgacaagtctgtggaaaactgttggccttgagaccacagtgaactggtggaaggggacttgctaagtgtggccacaaggtggcagtcacctcctgaaaccccgtgtgaaacgtcagcggggttgagaaaggccacgtctccaagtttccaggagagccaaaccaggactcaggaaaaccggccagctgatttgtatgggagattgatttgtaaaagaacaacaacaacatatggcagcaaggaaatgcaaagcaaacatctacaaatatttgaatccacctgtccctcacctaccaacttccccctctactactcataaagtggtaggactcctaatgccccgcttccttccacctgagaaccaaccagcaccctgatatttcaaagccagacctaaagaaccatggttgccaataacctcaatgccaaaccaaacaatcctaatcacatttttacttttcaaatccagtctcagagcagagctgtagattaagggacaaaaagtcattgtggaatcttttcaaatagctcttgtaaaagcatcagttgggaaagagtttatgagttcctctttgtcctctcctctggagaaaagacagaacatgcaagaacactagatacaccaagctatgggtgttgaaatagactagctggtgacctggatttgcaaataccctagggwcatgaaaacattttttctttttctttttcttttttgtaacctccacccagaatttcaggaaaggtggggccacatgcccaggatatatggtattctactgcttgctttcttatcaccagaatactagtcaatctgatttcttagttccatgtcttttcttccaaggaggtagggcatggggttgggggacactttccgccttccttgcatctcactgtccactcttaaatttttattaagaaacctctgaaagattcaaaattcagttcagtttcaataatcccaaagaagttgggataatttgttttcacttgcttcaaacttgccacggctgcaggaggagtctcaggacctcagaggaatggggcagatgtgtgaagtctgggagtctgcctcccacccagatgccaggagctgcatactcagctctgcctcacttccctgatggtctgctttcatccaggttaccatgacagagagggtctatcctctaaagaaagctgagttacaggctggcccctggggttgttcctgtagcctctctttgaccacattcctgaagatgtttagctgaatgcctcctcaaacctttgcttcttccataacccaatcctacacatatgtgataaagctttcttcaacaatactgggtcatttggacactaccagtccagatgagaactcacagaccaaatgaaaactttcaaaagcaagcagggaaagtaactcctatatgctttaagatgatgtattggtgtagattcaggtccaatttgaaaaaatgtctctggttctttctaattgtatccactctggatttgtttatgccagttctacattcatcaagccttgagaaacaggtggaaagaagaaaaatataaaattaagaagaagctgatggatcattggagattcaaaacaagccttctaccggtggcaccacactgaaaggcagagacaaggcaggagcggccatgggagaggaagcagcattggcttctcacgttctggcctccagcctcccaccagagcttctgccattcacccacttaacttgaggagaaactaaggcaccaaggcctgtcactgcaccgaaaaccagaagcagaaggactttctttctttgctcaaccagttctgcctggatctgacttttgcgtcaccagtagtcacaagcctgatttgtcatctccagcattctgtttatttttttaaggtcaatctttgcctgaaacatgacttcattgcacctgcagcacttcattgtccaaatgtccttggcaaacctcacagtctttggacagtgttgcattttctccaaaggggaaatcctctctccttcctcaagcttaataaggctcttgcagtgcatccaaataacacagctcttgttcctcagacacactcagccccctctgataacttcataaaacagctccttattgtctgggccatgaagccaggctaatgctaaagttccagttcaaaaacatttaactctattatccttatgaggccagctctcctgggtactggcactcactcactggcaccatggattcaggtcaggtggtgcaaacatcttccctgagaagcaagccatacacccaacaggtctagaacacctaggtcacaagaaagggtttcagtccagatgcactgtcagtaagtgaacacaaggacaagaatgcatgaactgttattttcttcccatcactggtttagcagcccctagggagaccctgtgttgctctttaatattctgacatggagcactaatatgctcaacactgcctccaacaggcaaatgttggaaatacactttcagagctggatgggactcaagatcatctaatataatcctctcattttatttcctctcaaggaaaccaagggcaagaaagtttaggcaatttgctcacattcacacaggcaattagtaacagagctgagttcgggtctggtataggctttttaatttgattctccacaaatgaacactaagataaatagcatttattgcatacccactatttaccagatactgtgcaaagggctttacatatattactttactaaatcctcaccataaactttaagtcaggtttaaccattttatagaagagggaagggagggccaggaaggttaagtaacatgctcaaagtcacacagctactaaatagagccataatctgaacctttgtctaattttgaagcccttgatttttccacttcatgaggctgctctttatatttatttagctgagtgaccaccatcttggattttactaatattcttacaagggggctttgatgccacttcttctgacttttaagaaaaggaaattcttgcattatttttgccatgtactccaggggaccctcaatctcatcatcatggggaataaga

SEQ ID NO: 10699 - DNA, 43701 bp, Homo sapiens
  misc_feature (1)...(43701): n = A,T,C or G, or insertion/deletion polymorphism (see Tables 1-2)
cctgggggagccctgtctattcttcagaagtgacttttgattgattgtaaaggtagcaatagctaagattcaatgcgcattgactgtgtgcccagcactgagcaaagggcattagatacatgatgatctcactgagtcccagcagcagccctgaagggtggaaaccaggattattgcacccgcatggctccaccaaggccacacagtgggttacatggaagaatccaggtctgctggacccagtgttcattcattcaccaaatctgtgttgggcgcacactatagaccaggcactctcctaccctttggcaatccgttctcctgtgttatgtatgccaaggcaggtctagtaggagctgcccagatggaaggggcatccagggagagggcacagctgggacaaaggcatgaaagtccaggaagtgttcaaaaaagagcaggtctactcggctctggggtagacacacttaactttttagttccacctctgccatgtaccagctgtgtaattttagtcatttcttctctctgagcctcacgttgtttctgcaaaaatggaggcaatattagcttttccttccagggctagagaggattaaatgagtttacagaggtgaagtggcctggcatagagcaggccttcaagaaatgtggattgaaatgaacagaggggtctgggtgtggtggctcacgcctgtaatcccagcactttgggagggtgatggagaccatcctggctaacatgctgaaaccccgtctctactaaaaatacaaaaatctgggcgtggtgccgcgtgcctgtagtcccagctactcgggaggctgaggcaggagaatcacttgaacccaggaggtggaggttgcagtgagccgagatcgaacctctgcactccagcctggcaacagaaggagactctgtctaaaaaataaataaataaaaaataaaaaaaagaaatgaatggagggggctgggcgtgctggctcacgcctgtaatcccagcactttgggaggccgaggtgggaggatcacttgaggtcagaggttcaagaccagcctggccaacgtggtgaaaccccatctccactaaaaaatacaaaaatgaactgtgcatggtggtgtgtgcctgtaatcccagcaactagggaagctgaggcaggagaatcccttgaacccgggaggtggaggttgcagtgagccgaggttgcgccactgcattccagcctcggtgacagagcaagactccgtctaaaaaaaaaggaaatgaatggaggaaactaatttagaatgtcaccatcaaatgtgagcatctaaggccaagcacagtggcttacgcctgtaatcccagcactttaggaggccgaggagggcggatcatgaggtcaggagttcaagaccagcctgaccaacatggtgaaaccctgtctctactaaaaatacaaaaattagccaggtgtggtggcgtgcacctgtaatcccagatactcaggaggctgaggcaggagaatcacttgaacccgggaggtggaggttgcagtgagctgagattgcgccactgcactccagcctgggggacagagcaagactctgtctcaaaaaaaaaaaaaaaaaaaaaattagcatctattgagcagaatgtgtggggaactgttctacctgttgctggattcataccctgcctctgagggatttacagtctagttgagaagatagttcagaggctttgaaaaacaaaaaagagttcagttggttgagagcagggtgctggtaggcatgtagcatggaggcccctggggctctagggggggcctgatccctgggggtttcacccaagaggtagtaattagactgaccttaaagatcccagctgcggagagttggcacattccaggacggggcactgctctccaggttcagtggaattcagaggcaatggttgaggcaggtacccatgagagtgcgcgctggatctagcctgtctgggccagaatgccagctccaaattttacttccaaatttgctcttctgcaaaatgtgggcaggagcagtggccacctccctgaaggtgtcatgagaactaagtggatcagtacagataagtgcctagaactgggcccggcacatagtagtgcttcataagtattggctacagtttttttctttgcttttctttttttaaaaaaattttgttttgaaacagggtctcacttggttgcctaggctggagtgcagtggtgcaatcacggctcattgcagccttgacctcctaggctcaagcaatcctccttcctcagccgcccgagtagctgaggccacgggtgctcaccaccatgcccagctaattttttttcttttttcttttgtagagatggggtctcactgtattgcccaggccgcattattttttttctgatgctcttggccaaaggcaggcacagatcaaaggtggggtaagtgaggccatggcttcagcattcacctttgtcatctccttgcccccagtacccagccccagctaagtcctagcaaaggtgggcccctaagcaggctggtgggccggaggcagggattggcaggagaggcagtcacacacaaacacacactcactcgggctccacctgcctgtacaggagccttgtctgctgcagtggcgctgaggccctgagggctccttggggcctttatggggtaattccatctccattagggctgattatgtcactataaataccgcgttttggtgccgctttataagactcactgaagaactttcctccttagcacccagtcacctagagcgggaaagactctgagtcggacaggaaaagagggaagggtgtgtcattaaatgggtgactaaaagccagggaaaagccaggtggaacaccctcttgccaccacctgacataccactcctttccataggcctctgttcacgtcacatgctgcagatgagcaacaccctgccctatgctctcagcccccaacttgtgcacatactgctgggcacacgccccacagccatcagggcctgcctgcacccctgccgtgtgtgtgcttggattcaaccttttgaggccacacatggaaacccacacttgccaccagaaggaccaaccaacactacacacagagactttcacgcaacacagaactcgcaacactgtcattcactcattagttcattcattcagcggaggcttgctgaatatctagtatgtatcaggcactgtctgttttctttttttgtttttggctctcgctctgtcacccaggctggagtgcagtgccgcggtctcggctcactgcaacctccacctcctgggttcaagcgactttcctgcctccaactcgagcagctgggattacgggcatgcgccaccacgcccggctaatttttgtatttttagtagagacggggtttcaccatgatgacaagcttggtctcaaactcctgacctcaagtgatctatctgcctcggcctcccaaagtgctgggattacaggcgtgagccaccgcgcctggcccaggcactgtctgttttctacaaacatccctgtcctcctgcagtgtgtcctctagtgacacatctgacagatggagcctgcaagtggcatgtaacacacatgtacaagcagtggcttccacacaactcacatggagtcttacacacgccagtgtccctagcccagaggctccaatacaacatgcaaaacacttatccaaaccacgtactacacacatgctcacactcatccacacaccccatgtgcctgtccacagagccctgggcacaacacatgccctgctctccacggatgtggcttcctgttgctgaaccgcatgtaacccagtaacagctgagatttcatgcgtgctttctgtagtcctggcccctgtggtttacatgcatgactttatttgatctttacagtaactctcctaaataggctttacatctttccaggagcaaactgaggctcagaaaagtgaaataacttgttcagaaactcatgggctgactccacatctactgtgaagtatggcacactcacaaatacatgcatacacaaatccacactcacatgcactcatacacaaatctctcacacccacatgcacactcatacacacatctagacacatccacacaatccacaaaaacacacacagacacacactcatacccaaatcctctcatgcccatgcacacacacttatacacacatataccaacacttttttctttttttttttgagacagagtcttgctggcccaggctggagtgcagtgagtggcgcaatctcggctcactgcaatctctgcctctggggttcaagtgattctcctgccttagcctccttagtagatgggattacaggtgagtggcaccacgcccagctaatttttttgtatttttagtagagacggggtttcaccatgttggccaggcatgtctggagctcctgacctcaaatgatctgcctgcctcggcctcccaaagtgctggaattacaggcctgagccaccctgcccagtcacatacaacacttatgtccatacacacactcacacacagtcatacatacatcaacactctcatgtctatacacacgaatgcacattcaacaaaatctcacaccctcatacacatgcacttattctcacaggcacttgcacactcacaggctctcagaggaccaaggctctcctcccatcctcttggtcaaaggctttaattatccccaacgcctgtaattaacccttcctctcttcctgcaggagagatgtctggacccgcttcccaagagtaggcaccaaggcgagaggccaagatgtccacatccggcagagaagacccacgtacctgggtagcaggtcccgggcatcaaagcgaggatggggtcagagaggaagaggtaggcaaagggagtctggggcctcccaggaaatcaggcctgccacagttgctcttcctggactggtcaaatggtgattggccaacaggcagccgtgggtggctgggcaggcgggccagagcaaatttcccgtttgtttcactcacactagccgcttctgtcaggaagggagatgagctcatgtctgaggaagttttgtgaagaggccttatcaaggggcaggtggtaggcaggtgtcctccaaactgtcaaaacctatcaacccatgccagggtcgggggccaggggtgccccttgcccccttccccaaaaagaagcagtggttcaagcagagaccaccaggattcaaatcctgcttctactacccgtgagctgtgcaccctttgggcatgttgtttctgctcttggagcctcagtctcctcttctgtaacatggggatgatgacccctgcctcccagatgagaattattaataaataagatagtgcatgtctgatccattcccagaggaaatgaacctattctcagatcatagtaggcttataggcttctgaacagagatactctttttgaccatcagcagcttgatatactcttcaagggttttaggaaggagggcatccaggtctatttctgggccactctctcaggcctgctgcttaggaggcaactgcttattggacccccaatccatttcagctcagaccttcaggccagcgttgagctcagtcgcattgagctcagtctcagaggtgaagggcagaatgggtatggctcagcgcaaaaccattaaacgtttccaccgaggataccaggctcagagatccctgggggctaatccgtaggggcgctggcgctttgagacgctcaaactttggaaggcctgcggggagcccgcgagtccagagggccccaaggtcctcctccaaacccctccggacttcccctccctctcctccgggtgccagcccggcccctttaaagacattcctgagggcgggcgttggtgacgtcacgcagggcatgaatgaacaggagtcggttctcacccaacttccattaaggactcggggcaggaggggcagaagttgcgcgcaggccggcgggcgggagcggacaccgaggccggcgtgcaggcgtgcgggtgtgcgggagccgggctcggggggatcggaccgagagcgagaagcgcggcatggagctccaggcagcccgcgcctgcttcgccctgctgtggggctgtgcgctggccgcggccgcggcggcgcagggcaaggaaggtgagtgcgcgcggcgtctggacccctggcccccgggccccagtgccccctagagcccggcgctccttgacgcgcgcaactttggaacctacctggtgtcgcccagtcccggcgaactggagtccggagggcgcacgggctgcgatcgaggcgagccctggcccccacccggggtcataggggctccggagaataagcggtttcagcttggtcgcacgggcctcggaggctgcggagaagaggacgcggcgcaggccacgcggttgcagtccaggcggcgacttcgggaacgcgtcccggcggggggcgtggggagtcccctagagaagggggtgtttgggcagctttccgcgggctcagcttcttagtgacctgaattcactaacccgcttgccgaggttttgcggagaaggcatactgtgcaggcctcgcattttggggagggggctcgggcgggcgggagccccctgtcgaagcccctgttccctgagattttctccacgccccccttcacctccagtcccgggggagagcgtggagataggttcgggccaatccctgctcacacactcctttccctccttcccaagccgcactcccgggctcccggggcaggttaggggccgcgagtgcggacaggaagtcccaaagtcaagcgttctgagcaagggtgactcagaacgaggaaatgcggcaggtgggggtgcggcctcccaaggtgtggagctgtcagcccagggccaccagggagtcaggacacccgggggtgggggactgaatcacccacccccgccccagtgttcccggagccgcgccgagtgaggggccgcagactttgctcatggcgcagcgggtgcgtggtgggggtgttgtccctccgctagggtcagggcgaggatgggggctcctgccctggccgaagaccttcctgtccacccagcccaggccagcttcaatttccaacagtgagggcaaggcttcccctcctgcctgggcagagcgaggtttccgcaggctccacaagggggaagccgggaggaaacttgggccggtgagaagtttccttcttttttttttttttttttttttttgagacggagtttcgcacttgttgcccagactggagtgcaatggcgcaatctcggctcactgcaacctctgcctcccgggttcaagctattctcctgtctcaagcctccctagtagcygggattacaggtgcccgccaccaggcgcgtctaatttttgcatcttttagtggagacgaggtttcaccatgttggccaggctgattctgaactcctgacctcaggtgatccacccgccgcggcctcccaaagtgctgcgattacaggcatgagccaccacccccggcctgtttccttctttttctgcctcccaaactgggtttggaggttttgctgttctgtgttgggaggaaaagaggccggatctggagccgttgggcagtggcaggtgttgggggtggcatcctgtctcagtctctggagtgacagggcccgggttggggtctcaaccgggacttctggttgcaggagctcatggcaaggatttctgccaccctcaatatccgccccaccaacgtttggtcctcccccttcctgggggactgtggttggagagaaggggagagacagctggaatcactataggcctttctcctcggctgcccatgggggggtgggggattaggcgggtgctttgctgctgcagtccccaagctggcctggaagcctggagctgccttgtccttgtcccctgtgtccacctctccccagcctgtgtgattaaaccccacccccacaccccatgggatgcagggggaaaggcttgtgtattgcactggggtgggggtacatttttgcttcgactctgagtccccgtgaaagagtccctagagaagtgtgcctaggtgggggtgggcatgatggcctagctggcagctgctggtttcagttcctgggaatcaggctgtatgtggtgggtctgcctgggggtggcttagggggcaggcaggaggacacaggtgcctttttcacctacccccaggctgcttcagacttctttcttgccccctcacccctaggctatacttggttgcccacgtggctcctgttaggtcatcaacagccactgaatctgccctcatttttacaaatggggaaactgagggaggcccgagcccttgccaaccagggccttctggacagaggaccagacctgagcatcccgcttcttggctgccagagccaaggccctgcctgctttgtggttggtgtcatggtagattttcctgggaagcaggcatagctgggcaggggcctgggcgggtggcagggggtgctgagctggggtgctgctgatgggaagagggctggagagtgccaggaagtccttggtttctggttctaccggggccaagtctgccctctgtcccctttcccttttctttcatgttttccccagagtccccacctccctgcttcctttagggattagctagtcttggttagagaggaatgggggaagcggggagggaaccacagcctcggaggctgcggagaaggaccggagaccgggagtgggtggcagtcctgcatttgtggaagaagctgtggagcaatgtggacccacaaagatggcacttacggtggaactcatggcaaagaaggaggtgttttttgctttttttttttccccccagaaatgggaaggtaaggggatagagagctcatggataagccctgcttagcctaagcctctccaggaagccgtctgggtcagccgaggggctcccaggctcccaccctttccagagaagcgggagcctctgtccctggaagaacctggggaaagagccgcgcccgcgtcagggcggagggacccagcgctgggcgcctcctgttcctggtggttggttcgagggaatttccctgggagggggccggggttggaaacccctgcagggggggctccttcctgtgtgagggcttcttttcttctccgattgagccctgtgctacttctagagccaggcctaggctggaaagggagggccctccatgccaggttaacccttcagaagcctggtagcggtgagccctctcacttgggcacagacctcagcctcctgtcaatctragggggggctgcaggactgtgaggaacctttgtccttctacccacccagctgaaatcaggagcctccagattccttcctgtgtagctggaacattccatttgctagtggggttagtgagtttcaaagccccggccctgggcatgtctgaacaaatccctgcccctgcccaccccgctgcccccagccaccctcccctatccccacagcctctgtcatggggccggtgtcacattggatttcctcttgcctgtctgggctgcctgacccttcctagagaggtttggccccggtcagtagtgggggtggcagcatttcacgccccagcctgggggccttcagcccaggtaggagggccatgtcacttcaggaggcggtcttcaagaccaccctcagagcccagctcccatctccacaaaccaggccatccctgctcccagcctgcctggagctctgtccaccctttgagtccttctccggtcctggccttgaggaatggggcttctgaggcagatccctcatgctccanggcccaaaggaagcattgacttggtttctttacccccaccttagggctttaccctctgaatccatcttgcataggttctatgccccggtttctcctatctccttaccctctagggagggtagcacttattggcagctacctggactttacttggaaatagagtggggacagtacctagggtcttaggttttgnctatggcctctgagcctggcagagaacctggggtggatcagtgggaggtgcccaatggcaggactaggtctagggaagaccccgggagtgtatccctccgccaggctccagttgcctctctgggaacaggatggtcctgacacctggtctctgggcctagaatgtcccctacaagggcttttattcctgatcccccaggaacctctggcacccctggcagggcagtggtcaggatgtgaggggcaggggtggtgggagtgactttcccagggaggggacctcaccagctgtgtgtatctttgggcccctcttaggggccctatgggtccagggctttatcctgcctgctctgtggcttttgtggtgagaagatcggtttccagataccctcttccctcctccaccctggagctgttcccacctgttcacagcactctcttcttggagtaccgcaagatgcacgtgtacatataggtgcatatgtgtgtgctacatgacctgagtggggttggtgtgtttcctgctggggggaatgtggcagaagcagacaccagtgtccctaaggcccacatgcacgtgaagtgctgccaaagggccttgttcaaggaagcagagggggcggtgtggtgtcacttaataccctgctcagcccagctctctgcccagctgctgttctcctgccgggctgagctccctggcctgctctgcccagctggggactaacggagggggacaggatggctggaatcctggcctgggagactggaggcccagtcctgaccccagcctgctgtgtgccttcagctgggttccatcctttttctgggcctgtttccctcatgagtcgagggatgattttcttggatatggtgaccctgtgtggtggggtccctctcgctctgtctgagagttggggttcctggagggatcctcacctttcctgccatggtctgactcctgaagacacccccaggctcaccccctctcccttctccctttcagtggtactgctggactttgctgcagctggaggggagctcggctggctcacacacccgtatggcaaaggggtatgtaagccttcggggtggggagaggtgtgagaatggggctgctggtcccctgtagagatggagaaactgaggcccagggagcgtggggcctggcttcaattcagcagctcagccaggtctcaggytcagggtccagcttctcacaccaggctcagagtcagccggcccaggccagggctggatgggcgtgggaaggtacgagggtgtgggtgtaagcctgagaggtggggggaactggggagacagagaaggccctagcggagctgggccttccatgttccagaagggctgacagtcagagggatctctggcaccacccatccacctcttgggagggaaggggttaaagatgccccctgtcttgaggtctcagcccaggaggtgaggggtgaagaagagacagggaacaggaaaacctgatcaagttccttcctgcccgcccctttcccacctctagctgttgcttccccttcctgtggggggctgcatttctctgcctcattctcacccaggtcttcccctctatgcsgtcctgatgtgaccaggaatgggggcaggggctgggggttcttcccctggctgtgtgtgtctgctgtgtgatcttggggaagatgtggctctcggggcctcagtttccctctctatacaatgggcccttgctgagtttgtcctgggaccctgagctgagaaagggggctgtctcccaggggctacttggaatagttcccagagctggccagatctgcatgagtcgagttcttgtccccggtcaccctagctctgggcaggcttggctggggtgtagccctgagcaggtttctaggatcctggaagtctagctgggagggaacacgggtcacctaatacaacccagtctttatacagagtgggaaactgaggcccaagggcatgtagggccttggccaacgccacacagtatagcccgggcctctgtcctcctcccctgtgctttcattcattcttttgtttattcattcaacaaacgcttccctgagcacctactctgtctcaggccggctctcgggacacaggacacaggtgaattagatgcagactctggctgaggagctcagaatctcatgtgggagcccagatgtgggtgtccccatgtgccgtgccaagtrcactttggtaaatggcaaggggtacagggtaaagggaacatggcaactttgggagttgggtggcggggggcacctggcccaactgtagcctaacctgggaattctttctggagaaggctgagttatgatccagggagggaggaacatgttcatctgctgcaaagccaaattctaaatgacggagagcatcatccgttgtttttgacttaatgccactcctgcgtttgccaacacacatgggtgcatggtgaataataccaagagtaacaataatcatactggctgcccgtatgcctgttaccttgtgccaagcactgtgttcagccagtgtagacattctgtcctttatcctcacagcaattctgtgaggtagggggtcttgctcccattgtacagatgaggaaattgcggcttagagagcataacccacctgaggtcacatggagtcccggactccacctgcaggctcacaacctaatagagaggtttggcttccagacatgtgccagaaagaccaggggccagattccagctcagccacttatggatgcagcccccacccgcctcaggcctcagtttccttcaccgtagaacccggagagcacgaactggaaagcatcttcctagtgccctactctgccacctgggcctcagtttccccaggcacctgcccacactaacctgtatcttccccccacagtgggacctgatgcagaacatcatgaatgacatgccgatctacatgtactccgtgtgcaacgtgatgtctggcgaccaggacaactggctccgcaccaactgggtgtaccgaggagaggctgagcgtatcttcattgagctcaagtttactgtacgtgactgcaacagcttccctggtggcgccagctcctgcaaggagactttcaacctctactatgccgagtcggacctggactacggcaccaacttccagaagcgcctgttcaccaagattgacaccattgcgcccgatgagatcaccgtcagcagcgacttcgaggcacgccacgtgaagctgaacgtggaggagcgctccgtggggccgctcacccgcaaaggcttctacctggccttccaggatatcggtgcctgtgtggcnctnctctccgtccgtgtctactacaagaagtgccccgagctgctgcagggcctggcccacttccctgagaccatcgcyggctctgatgcaccttccctggccactgtggccggcacctgtgtggaccatgccgtggtgccaccsgggggtgaagagccccgtatgcactgtgcagtggatggcgagtggctggtgcccattgggcagtgcctgtgccaggcaggctacgagaaggtggaggatgcctgccagggtgagtgacggttctgggttgcagggaaggggttctgcattcccaggttctggtctttagctttggaatcatggaatcttggtaagctcatccctgctttgacacacattagttctgttagtggaaattatagatccttcccagacatcagtttccttattaaggctggaytaactcattcattaagaatgaatgaattgtggctgggcacggtggctcatgcctgtaatcccagcactttgggaggctgaggtgggtggatcacttgagcccaggagtttgagaccagcctgggcaacataatgaaacgccgtctctaccaaaaacacaaaaattagctgggtgyggtggcatgcacctgtaatcccagctacttgggaggctgaagcacgagaatcaattgcttgaacccgggaggtggaggatgcagtaagctgagatcgcaccactgtactccagcctggggtgacagaggagatgcttgtctgaaaaaaaaaaaaagaatgaatgaattgagaaacagcagaatgtggagtttatgattgatgactctgaaacaagaatgcctgtgttcaaatcccaggtctacatttttagctgtgtggctttaggccatttccttgacctctctgtgcctgggtttcctcatctgtaaaatggagaggatcatagcgtctatctcgtagggtggctgtgataatcaaatgacttaatagtaaagtgcttaggtcagtgcctgccacatgagtacttttaaatgtsgctgttatttttgattcatcccacgaatgtatactgagtagctctggtacagcggcactgtggtcccacggtggagtaccaggagcaagttccatgtctgttatcagctcactatgtggccttaggcaaggtacttaaactccctgggcctcaaactcctctttcgtacatagaagtgactgagttggacccggggtgcacatcccctggctgcatatcaggatcacccgcggagcttttgggaaatgcttctgttgagggagaggttggaggggggccaagggtctgcctttcttgtctgaatgtccccagggccacaaatttcccattgggacctctattgattttccactggggcctctatagatgacacactgggcccagaaaagggccaattcattcagactctccttggggaatgaggcttgggcattagtgagttcacatggaggaagccgtggcgtggtgtggccagggcctgtgacagcggaaatctccacagcaatgtggattttcaatgggtgactttttctggaaatggccatgaggcagagcatttgtggaatgcaggccaacctttggagggctggctcatnccctctctctggcagcttctttgctgagataagcgggacgttaaggaattggaggtttagtggctgcgttgcacacaccttggctaactcccccctcatctctggtcttgggtttcctttgagtaaaatgagaaagttcaacagcaccagcagactttatgcttgttttctagccatggatcctgcagcccctggagggggttgaagggttggaggacactgaagccctttgtgatgggccctacttgcctcctaaagcaagtcctcagaaccttacttaacacggtctgtaaaccccccgatgagaagttccctacgagctttctggccataagcctgtggtgtaggctctgctccggcccatgccatcgcccccttgtcttcccagctcccctctgctgagcgagccccccttccccaggcggcccctgctttaggtgacctcgaatgcatactctcagtttcagacaatgagtgcggttgagggggccgggacgaggcagcccagtggggcgagcagrctcctcccacatgacatcctcgcacaagaatgcgggggtgggggtgaggggcagctgaaaactttccacaggctggtgaggcaggccccgcagagataagtggacggttggggtgggggtgtctctccaggaagcggggcagccttccctcctctagaggtggggggtcagggttctggcagattttgtttgcagagagccgagcagccccctgttgggaagatcagcccagcaggaggacaagtttccaagagcgaaatttccgacttagttcgtggaaccctgtcaatcgctagtcacctactgccggattgttcctcctcgggatcctcccaccaaaattcctttcagtgtggctgggtgccggtgcgcgagatgccaggaacgcccggctggctcctctttatacctctagacttctctcagcagcccctggccatgctgctgctggaagtgatgacagtcgctaccgtagacgggtgtcgtccgaggggcaggcgctgagccaagcaagcgctttatcagacatgcgagcggaatccacaccgcctttctgcgtggcagggactgtgatcaatcccatttgatagaccaggaaactgaggttcagagagctaaagaggcttgcctgaagtcacacagctaggatgtggctgcatcaggatctgaatccaggcggtgcagcggcgcccaggctgcaggatgggtcaggaaatggggcgggaagtgaccagttcctttggaatccctgactcagctcctggccctggggtaggctctctggccagccctggggatggcagggtctgttgcaggggcttgggggctctgttggaggcaggggtcctggagagggcactgctgggtacattgagggagaaccagagggaggcacagggtctgccctccctgccggaccctccccaggcctggagacccagattctttcactggggctcctgctggtgacaaaccagacccagagcgaggcggggcaccctgaggtcacctggcaccttgtctaggttattcccagtttgtccgtttctcctcagggttctttccccaggaagcccagagctcaggaaagagttaagtgggcagaggaagggaggcacctcccaggtgctgtgtgcggcaggtgggcacgctgcccggagcgctcccatgaactatgtcaggaatgagccagcttcccttggttcccccgccctgcccccggccctgcctgcggggacagtggagtcgctcgggctgaccgctgtcccccgggggctgctttgtctccatgtctccgcttcctgtgctggcctcagcagctggcggggcccctgctggcgcctcagccctggggaccgctggtcaggtgagcaggtggccagcagccttggccagtggctcagctgaacagctgggaggccagagctggggttgtggggagttggagattccctcctgagaggctcctgctccctcaaggggcccagccccttggggaggtcccctccctactgtagtttcatgatcccctagttcayagggacaccgcattccaggcaccatgctggacatctcataagcagggctttcttccatcttcacacacaacccagagaggatgaggacttgatccccattttacagatgaggaaactgaggtccggagaggaagcagtgaacagtgaccaaaagaacgggggcctggcacaggaaggcagttgcccctggtgtgtgtccttccacccacaggctgtatgaccttagcaggtccccttggggtcccacccccatctgtaaaatgagtgggctggacctgtggccctgaaggacgctgtcaacctggtgatccgagcttccctcctgtggtttcccactggggctcagtctgaacaccggggaagctgttgactgtgtgacacaagtgtggtgaggaggggtcccactgcttacagccccagtggcctaaagtccatagctgacagggaggagtcccctggccagggtatgtctgtggttaaggtggtctttagacagggtggtctcgggccatggcaggggctgctggcaggattcctgtttcatcagatcacagttggtcccccaggtggaagactctgggagctgctggctgtggctcgcaggctttgtcccctgctgggaagtcccaccaggccttatttctgtgatgtttcttctggcctacagaggtgggaccacggtggcagcacccccagccccccatggtggctctcacctctgtgccctgtctgccccaccctcagctcacactgggggcaaagctaggcgctggcatctccgctgggcgggcaccggcttctccctccctccctctctccctcctggaggtaagtgggtccccagaacggaaggaaggaggcgagggaaagcaaacagaagatgaaaggctggaggcaggacaggagcggtaggcgggggctgaggtggggagtggtgcttatcaatggtggaggaatgtgcctgcagatagctccctagggtgtgtgtgaaagggacagggtgctggcagccgtcaggccctgggggcagccccccttctgcagagacgacagggcctgctgggagcaagaagccaccagggcctgaggttgtcagctccctcatttgctgggtcagtaacccataggtcgccatttgccgtctgtcagggcccagagacaaagtccaagctccacatccctgggccaaggtggttcctgcggtcacctgctgggcctggcttgggcggtgactggccctaggtgaattgccaccatgacctcttgacctcacaaccttgccattgccagcctgggaggtggctgtgccttgggaggaggggctccactgggggctggacttgcgtcacgataagggcgtctgtccctgagtcacctcatgctgccacctgaggggcgggcatcaggaactggaaaaaccagggtatagccggaggtgcagccactgtgccccagttcccctgctcggagtagcccaggcctgccagacaaccggggccagaacagctctccacaggtgtgccacaggtgtgccaaagttaggctcttgtgtaaggcaggtaggcatcctggtggaccttctccacagtgtctctctgggcgctgaaacactgctcatttctctggccctggagtgcatatttcacatgcacatggtaggtttgccacccattctctctcccactcactcttccatccacctgtccacccatccactcatccatccatccacccctccacccatccacccctacatccatccatccattcatccatccatccatccatccatccatccatcatccatccattcactcgtctacccgccaacccaccaaaccacccatccacttgtccattcatctatccatccatccatccactcatacccccctccacccatccatctgcccacccctccacccaaccacccacctatccacccatccatccatccatccatccatccatccattcatccctccacccacccaccctcctgcctatccatccctcatccatccatctactcatccatccgtccacccaccaacccacccatccacttgtccattcatctgtccatcctccgccccatccatccatctatccacccctccacccagccatccacctatccatcccgcatccatccatccactcatccacctgtccacccaccaacccacccatccacttgtccattcatctgtccatcctccccacccatccatacatccatccatccaaccaccactccacccacccacccatccatccctcatccatccatccactcatccacctgtccacccaccaacccacccatccatttgtccattcatctgtccattcatccacccactcatacccccctccacccatccatccattcatccacccacccatccatccacacactcatctacccatccacccaccaactcacccatctatccatccatccatctgtctgtccatccattcagcaaacattaactgagcaccgctgggccatgggacacagataaattggtctccattcctgctcctcaggagctgctggtctcacggaagctcctgatacwtgcaggaataatttcaaatggagcataaaagccaagttttgaattcccctggagctgaaacagtgtttatctgtctcaccatcgcatcctagcacccagcattgtgccagacacgtatgaagtgcccatttctatttggtaaacataagattaatagatgccctaatgggggccggggggccaggaattgggcagtctgggagggctgtgtagaggagcttaagctgggtattaaaggatgcataggagtttgctggttggctaaggaacagtaggtatctggtgtatgtgggtgtgtttgagtgtgtgtgacccctgtccccacttgcccgcctagaatgccaggaaatccaactagataaagtcaggaagaacacaggggcttgctggtgtcctactcatgaactctgggacccctgagcacttggaaactctggcggggccctggagacagcccctggtagctttgtggttggaggaggggaagcacatctcgtcaggcaggcacatgccctgttgacgctgcctctctgctgtattatctggcacatccgcagcggaaatctctccaaattccctctttcctggcggcagcaggcaggcaggccacccccgggcgctggggccaaagagcccatctcttcccccacttcctcctcttggcatagaagcagccacacggtggggagtcggggcattgtgagggtttgcaggtggctaaagcctccagtgggtccgagcctgggctgtgggggtttatggcccctgcctggcctgagagcctgggctgggaacgcccccgagcttcccaagtcagctggccctggaccacctgaaccagcactgagccaggtgaagtctcctccacagacaagtcagggcatttgggggaactgaccccaggataaacatggcccagctttctggagtctcagttttactnacagatctggtggaggagagagctatttttgtatcatgcagatatgttatggggagggatgcaatatactcatgggtttccaaatacaataggagacttgaagacattcggggcttgaaggagaccacttcagccaccccaaccaacccccctgggctggagtctacacttttctgctcacagacacaaaagtgcccagtttgagaagatctgtggtggggaataccctcccctcctccacaacacatagacccacagctgctctgaaattcgtcaggmgtttctggcttttgaagtgggtcaggccttatctcctctctcttcaggcttgtttcagaatgttgatttatctttgctccaaattgaagtgttcctaagaacagaagtgggaaaggaggcccggtgaggtggctcacgcctgtaatcccagcattgtgggaagtcgaggtgggaggatcacttgaggccaggaggtcaagagaccagcctgggcaacaaagacacaccccgtctctaaaaaataaaataggccggacgcggtggctcacgcctgtaatcccagcactttgggaggccgagacgggtggatcacttgaggccaggagttcgagaccaggctgcatctctactaaaaatacaaaagttagccaggcttgatggccggtgcctgtagttccagctactcaggaggctgaggcaggagaattgcttgaacccaggaggcggaggttgcagtgagctgagatcccaccacttcactccagcctgggcaacagagcgagactccatctcaaaaacaaaataaataaataatgaaaaaggagtgggagaggagagaggctgaaaatcaggcatcctaagtttgagttctggtttccttcttgggagcttggtgaccttggacaagcttttttgtctctcctcacctccaaagtggaaccagcgctaatagtgcctgtatatagcaggtctattgcgaggactaaatgagggtacagtgcttagcccgagccctgcgcatagtaggtactgtcattgggactccaggctctgtgcagagcaggagtcgggtcccgggcctcctctgtcctgctgcatgacctgggacaagcccccttccctgccctatgtgcytgagctcttgcagggccaatgctgagggtctgcagaagcaggatggaccaagggggtgagagcggctgtttgtgtggtccctgggccagggttgggaggggacagggatgcagcctggctctgagagcagagtcatcagcaggaggtcactatctggcaccttacagagctgggtgtcctttgagtcctgttcccctgactcctggtccccctctgcacctctgctcacacaggggactggatgacgagagtcttcgctccagattctgtccctgagagttagcaggtttgcttgggtcagggcacttgaaattgcttccctggagggggttgtccttaggccattaggggccaggttgtccccagggtcttggacaaaagctgcctccaggcacagatttttcctgacggcaggggtctgacttctccacatcagacctccagcggctttccattgcctccaggataaagtcccagcttcttggcctggcattgaaggcctttctcaactgttttattgcttgctgctccccacatttgtgcccacaaacccactcataccttccgtattagtcatgcactttctcactcctaactccctctcccaacatctatcattcccctgctgaactcctatgcagcctctgaaccccagccaaaatgtcccctctgtgacttctcagactcctggccaaggttgtttccccttctccacccccttagctgttagcttgtttcctccctctgtcttgcagaccttgtcaggtgcttctgctccctgagatcaggagtttgttttcatcttggtgcatacccagcactgggggtgggccaggcacagagcagaggatcattgtgtgtgtggtgaacacggtgctgaggttggaggtgtctcaggaccctctcatcagaacaatctgaaggattataattgtagggttgttggaggagctccctagggtgacctctacccaccctggccacttcagcagctgcccaagccctggacagccctgcaccgtgagccctgtgtctgggcagcttcctgcctgtagggccaggaaggggcttagggcaggggcgggatgagacaggatagggcggtgggaggaagaagcccccggagtcaggtgcctgagcccccagcctgctgggccaggacaggactggccactgggggaggaagagtcacttcctggctgtccttgtgagtggcggatatgactcggtcctggaagcagagccagagaaaatgccagggggcttggcctttcctgcttcctggtcagccccggatggaaaggagggcaggtcctgggctggaggtaacacctgcagggatggcatcctgaactgatgaggctggccagtgagtcagggtggtggtgacagtcaacaaacacacatggtcaagaagaggcagtcattgccctgggcagctctcagctacccaggtggggaccggacaggctagtctgcatggaggaaaggggatgaggccggtgggcagcgtgcttggtcaagtgctgagctaggctgtgatgggattcttggttggctgaaaggcgaggtatggccttgaatgccaggctcaggggcgtggtgcttcttgcaggagccagtggggagtgaagcaaaggtttgcagcatgtgtgtgaagcacttcctgggtgcccggtacatgctaggcccttgccatgcatttttccatcacaagacattttgccgatgagaaaacaggtccatagagatttactgacctgcttgcagggcaggggtccctggtgagggaatgagacagtcacgtggggtggaagcagattgaactgatgtccttgtgctctgtctgtcctrtgtccaccagcctgctcgcctggattttttaagtttgaggcatctgagagcccctgcttggagtgccctgagcacacgctgccatcccctgagggtgccacctcctgcgagtgtgaggaaggcttcttccgggcacctcaggacccagcgtcgatgccttgcacacgtgagtcttgcagtgggtcagggtggcgtgactgarggtgacgtgtccgcctgggtccagcacagcactgactcctcctgtctgtgcaggacccccytccgccccacactacctcacagccgtgggcatgggtgccaaggtggagctgcgctggacgccccctcaggacagcgggggccgcgaggacattgtctacagcgtcacctgcgaacagtgctggcccgagtctggggaatgcgggccgtgtgaggccagtgtgcgctactcggagcctcctcacrgactgacccgcaccagtgtgacagtgagcgacctggagccccacatgaactacaccttcaccgtggaggcccgcaatggcgtctcaggcctggtaaccagccgcagcttccgtactgccagtgtcagcatcaaccagacaggtgaggtccaggggtggcagctgtgccctatggggcctgcccaggtggggcttaaggaggacggccatctggggctcgggtgtgtttagagagaggcagcagagcaagtggttaaaggcacagtgtctagagcaagcttgtccaacccgtgggccacatgtggccccagccgacattgaatgcggcccaacacaaattcgtaaattatcttaaaacattatgatattatttttgcaatatttttcccttttttttgagacagagtctcgctctgttgcccaggctggagtkcastggcwtgatctcrgytcactgcaacctctgccttccgggttcaagcaattctcctgcctcagcctctggagtagctgggattacaggcacgtgccaccacacacagctaattttttgtatttttaggagagacagggtttcactatgtcggccaggctggtctcgatctcctgaccttgcgatccgcccgcctcggcctcccaaagtgctgagatcacaggcgtgagccactgcgcccagcctgcaattttttttttttttagctcatcacctgttgttagtgttgctgtattttatttgtggcccaagaccattcttccattatggcccacagaagctgaaagattggacactcctgctccagagccgcttctgagctctgtgactgtgggcaggttacttaacctctctgggcctcaatgttctcccctgtaaagtgggataataattgagaattgagactgggcgcggtggctcatgcctgtaatcccagcactttgggaggctgaggtgggcagatcacctgaggtcgagagttccagaccagcctgaccaacatggagaaaccccatctctactaaaaatacaaaaaattagctgggtgtggtggcgcatgcctgtaatcccagctactcaggaggctgaggcaggagaatcgcttgaacccaggaggtggaggttgcggtgagccgagatcgcaccattgcactccagcctgggcaacaagagcgaaactccgtctcaaaagaaaaaaaaaaaaagaaagcattcagcaaaagttagttcttcttcttcttcttcttcttcttcttcttcttcttcttcttcttcttcttcttcttttcttcttcttcttcttcttcctcttcttctttcttcttcttttcttcttttcttcttctttcttcttctgtcttcttcttcttctttttttttgagacggagttttgctcttgttgcccaggctggagtgcaatggcacaatcttggctcaccgcaacctctgcatcccggattcaagtgattctcctgcctcagcctcctgagtagctgggattacaggcatgcgccaccatgcccagctaattttgtatttttagtagagacggggtttctccatgttggtcaggctggtctcgaactcccaacctcaggcaatcctcccgcctcggcctcccaaagtgctgggattacaggggtgaaccaccacacctggccttttattattattattattattattattattatttatgcactcgtaaatatggggcacctctgatgtgccagcccctgtgatggggccagggtggaggcctggggctctggccctgtgctctggagctgaaagtttaggatcctaggttgggatctaaagagcctgggagctgggcgtggtgaccacgcccataatcccagcattttgggaggttgaggcaggaggattgcttgagctcaggcatttgagaccagcatgggcaacatagggagaccccatctctacaaaaaatacaaaaattagccaggtacagtagcatgtgtctgtagccccagctattcaggaagctgaggcaggaggatcacttgagcacaggagttcaaagctgtagtgggccgagatcatgccactgcactcgagcctgggtgagagagcgagatcctgtctcaaaaaaatgaaagaatctgggctgtggaggatgtggctccacgtccacttgtccccccaaaccctgcctgctcgtaggcagcttcttacccacttcccccactgcctgtcctgcccagagccccccaaggtgaggctggagggccgcagcaccacctcgcttagcgtctcctggagcatccccccgccgcagcagagccgagtgtggaagtacgaggtcacttaccgcaagaaggtaactcccagaggggcggggctggctctagctgggccgacagcaggggacaggctggtcacatagatgatcaccaaaccacccagccatctgaagaagcacccttctgcagatggggaaactgaggcctggggtctgccagggggttacatctcccaaggcagcacagcagagatttgtacgagagaagacatggcgtccttggaagaggcagtcagggtgaggacaggggcagaattttgggaccccacacactcagtttgagtcctggctcatgcatttagtggttctgaccttgagtgagtcacttaattccragcctcagtttcctcctctgtaagaagagcctcaagtttgctaacaaaggcaagccaccttgctagcttggggtggtctccagcgggctgagccgaggcccctgccctgccctcactgcctgctcctccgccggccacccacccacagggagactccaacagctacaatgtgcgccgcaccgagggtttctccgtgaccctggacgacctggccccagacaccacctacctkgtccaggtgcaggcactgacgcaggagggccagggggccggcagcaaggtgcacgaattccagacgctgtgtgagttgggggaccctgggcatggaccaggccagggcccagaaccaagcaattgagacatcttgggaaaggaagtgaatcaaataacttagaaatgcccctttctcggtcaccggcggcctgggacagcccttcggggactgcccccaagcctggggagggggaagcatggaaggctgaggggtggaggagccgggatgtggattcacgacagtggtgtgaggaagttcaaatccgcatctcagaaaaagccagagctttgagccccacatacctgcaatacctcccgtgagaccttcgggaaggcctccgcttgaccgtctatgaaatgggactaagtaccctctggagccttcccaagtgcaagcacccagcacacagtaggggcccaggtgtcttgggtgcagcgygggtgttgctgtaatttgtgggggaactcccttgtcatcagctgatttcttccaccagccccggagggatctggcaacttggcggtgattggcggcrtggctgtcggtgtggtcctgcttctggtgctggcaggagttggcttctttatccaccgcaggttcgtcagagcccataccctggctccacatgggcttgggtgggaaaatggggcaggaacctccatttcctcatctgaacgatggggcccacaggatgctagtcgagtctaatccctgcctcnggatggtgcgaggatatacgagttagagtgtgtagcgaagtgcctggcacgcggcggggccgggacacgggggtcattacctctgctcttgttattaatgatgtgtccacacttcctctggacacgcaggcaggaatccccgagtagctctaatgggaatgccttcgtcacgactgcttaaggggccattctggggcctagatcctggagagggagtcctggctcgctcacttcctccctgttcctccacccgccttctccgcaccctcggccctgagagtggagcttgggcagcnaaagcrgggactgggccgcattctgagcaccccaggtcctcctaggaccaaagtagggccaggaggcttccctggccggagcagacctcactgacctccctgcatttggttccccgtggggctctttcaggaggaagaaccagcgtgcccgccagtccccggaggacgtttacttctccaagtcaggtgagacgcagccccnrctccaggcccagccctgcccgcaccgtccccagctctgtgggggaggtgggggcagccagggtgttcccagggcactggggtggggccacaggcttccgtgggcagctctgaggggtccgtcccccacagcctggtccaagtctctgaagatcacgtgaccttctcctctgactccagagcaccccccatggggcccctcctgagctgcctgtgaccccaccccttctccttccagaacaactgaagcccctgaagacatacgtggacccccacacatatgaggaccccaaccaggctgtgttgaagttcactaccgagatccatccatcctgtgtcactcggcagaaggtgatcggagcaggtgaggttggccccctgccaaggggccctgaggaggcagcggtggtgacacagtgtgggagccctcatgccggggctgaccagggcactcccctgaccctgtctgcccacaggagagtttggggaggtgtacaagggcaygctgaagacatcctcggggaagaaggaggtgccggtggccatcaagacgctgaaagccggctacacagagaagcagcgagtggacttcctyggcgaggccggcatcatgggccagttcagccaccacaacatcatccgcctrgagggcgtcatctccaaatgtgaggcttggggcctgcccacactgggtggagagggrccacttagcaggggctctgtctgtgactgtgcccacctcccctatacctgtgcccaccttccccccacacctgcacccacctcctctacaactgtgcccacttctccccaatacctgtacccacctcctwacacctgtgcccaccttccccccatacctgcacccacctccttacacccgtgcccacctctccccatacttgtacccacctcctctacacctgtgcccacctctccccgatacctgtacccacctccttacacctgtgcccaccttccccccatacctgcacccacctccttacacccgtgcccacctctccccatacttgtacccacctcctctacacctgtgcccacctctccccgatacctgtacccacctccttacacccgtgcccacctctccccatacttgtacccacctcctctacacctgtgcccacctgtcctcaatacctgtgccctcctccccaatacctgaacccacctctccccatacctctgcccactcctccgcctgtgcccagctttccccacacctctccccatacctgtacccaccctccccacacctgttccacctctccccacacctgtgcccacctctcctacacctgtgcccaccttcccccatatctgtgcccacctctcccacatgcctgggcccacttacctctcacctgtgcccacccccctacagacaagcccatgatgatcatcactgagtacatggagaatggggccctggacaagttccttcgggtaaggatgtgggttgtagggggcggggatgcctggccattgagcccggggctggcctrgcgggttcagggctggcctgcagctgagcgcctgtgctccggcaggagaaggatggcgagttcagcgtgctgcagctggtgggcatgctgcggggcatcgcagctggcatgaagtacctggccaacatgaactatgtgcaccgtgacctggctgcccgcaacatcctcgtcaacagcaacctggtctgcaaggtgtctgactttggcctgtcccgcgtgctggaggacgaccccgaggccacctacaccaccagtgtaagttggggaaggggacctcaagggagaagcggccttcgccctgcatggtgtcctctcacctgcacacctgggcagtgcttcaggaggcagaacacctgtaggagtccagggaggggtcgtggggcttggctgcaatggtcctggggccagccagagggcacagtggtgactgggcctgggttccctgcagggcggcaagatccccatccgctggaccgccccggaggccatttcctaccggaagttcacctctgccagcgacgtgtggagctttggcattgtcatgtgggaggtgatgacctatggcgagcggccctactgggagttgtccaaccacraggtgggtgcccttgccctccccaggcctgyccggacctgaactcaagccctttactcatctcaaactgcaggggctgggcagaggacagtttagatgaaccttcttaggcttgctccataaatgtttattttttttttttggagacggagttttgctcttgttgcccaggctggagttcactggcatgatctcagttcactgcaacctccacctcccaggttcaagcaattctcctgcctcagcctcccgagtagctgggattacaggcatgcgccaccacacccagctaatttttgtatttttagtagagacggggtttcactatgttggccaggctggtctctagctcctcgcttcaggtgatccacatgcctcagcctcccaaagtgctgggattacaggggtaagccaccgcacccagccccgtaaatatttcttgaggatctactgcgtgccaggccttgtgctgggttccaggagctgattcagagagtgcagagatgaaaaaaggagtggggtgtacgtgtgtatccgtgtgtccatgcatgtgtgtgcatccgtatgtgtgcacatgtgcatgcatgcatgtgtgtgtgtgtctgtgtgcttggtgcctctctcagcctggtggcctgggaggcttctcagaagaggtcacatctctgccaagaccaagggcactgtaaggcagccagatgagagggaggggaagagagatgggagggaggctgggctgagggtacacagtgtggctgctgcctggtgccctgtgagggagcagggtcccttctagctgggagcaatggcgcatgcctgtaatcctagcactttgggaggctgaggcaggagtatcgcttgagctcaggagttcgagaccagcctggacaacatgacgaaaccccatctctacaaaaaattaaaaaattagccaagtgtgttggcacgtgcctgtagtctcagctactcaggaggcggaggtgggaggatcacctgagcacaggaggttgaggctgccgtgaggtgtgatagcgccactgcactctagcctgggtgacagactgagaccctgtctcagtcaaaaaaaaaaaagtcccttccagtgaactctggacacagacccttaggcatttgccctttgggcagctctgaaggttgggtggcagctcaagaaaggcccttcctgtytgtttctgggatgttcctgttcccctcccctcccctgcccacctccataggctggaggctgcagagggtttcagtggctttctgcaacagcgcccctgaccttcgtgccccgccaggtgatgaaagccatcaatgatggcttccggctccccacrcccatggactgcccctccgccatctaccagctcatgatgcagtgctggcagcaggagcgtgcccgccgccccaagttcgctgacatcgtcagcatcctggacaagctcattcrtgcccctgactccctcaagaccctggctgactttgacccccggtgagttctatgccctctgcccatgatgacctcaattttccttctgcagactcttgaaccacttcggtagagtggccacccaggtgaagctggtagggggggtgctgggggctaagaggttatgtgtggacttgacttagactggacacgatggcccaggaaatcctaatagaagcaaccagcttatgtgtctgtgtgcagggcactgcgtgagcacttaatatgttttcattcatttaaacaacctacgagatgagtcctccagtgatcctcattttgtagaagaagaaactgagacacagggcgattgaatatcttacatggctggaagtggtcaggctgggattgtgacctcaggatctggaatctctgctcgtagcattttatgatgtggtagttattggtggtggtcctgttagtaggagtggaggggcagcagtagttacagatgctgagcgctcccaacgtgccaggaggtctcattgaaccctacttgactgggcttccctgttgcccagataaggagacggaggcacggggcagcrgagtcaatcatccaggttagggagcagcaggtgcagggcccagggtggactgggtgctgcagcccctcacctgcagtgcttcctgttgcagcgtgtctatccggctccccagcacgagcggctcggagggggtgcccttccgcacggtgtccgagtggctggagtccatcaagatgcagcagtatacggagcacttcatggcggccggctacactgccatcgagaaggtggtgcagatgaccaacgagtaagtcaggcccctttccgtcccccctcgcctcccgcctcccactccagaggctgcctccatgccccccccagccctcttccctgcccctcaatgctcctctctttgttctttctcttctgggaagaggctccttggaagagaagggcagaactccgccagcagctggcagctctgggtgcccactctcagctctctcctcttcctacatcctttaccagagtggggaaataatagtaaccgtaatcataacagtagctactgtttactgagggctatgtgccgtctctgcttgagcactttgaatgagaacccagcggggtgagtcctgttaacaggtgagaaacaggtgcaggtgagaaacagatgcagagaagtgcagtgacctgcccagggtcccacagccatgagggggagagcaggattccaggcccagtcagtcgggatcccagagcgcagggatcggagaggtcattggtagagaaacaggctgagatgttaccggcttgcctgaggtcacacagccagtttggggcagtcttctccaagatgccctgactgctgcccaggagagagaacccctggcctaccccgggcacctctctccacttggttggctctcagcctgcagtcccacctggtgagaagtgccacttactctctgctggccctgggtttgcccctttgtcaagctgccccttggcagctcttctccccttcccaactccagcattgagacttttcccggcatggccttggcacagacacctcctcctgtcccaggargggggagaccctatcctcttagccttttgtgcctctaaaaatagtggccagtttcaacaacccagcttgtgcatggtcaaagatcatggcrggaacagaccgggaggctgggaggttttgggaaccgtatggaggggatgacctgggcctcccatggttctaggtcacagaagttctgggatttgagcctgttcatgaacattctctagggcctttggaaattgctcagctgggctcccaacctgctggccaaggccatagcctccctcaggggacagtcggtgatgggaagcaggcaggaacagagccgaccagaggggaggcggggacacgtagggaggggagatggatcacaggatgtcttttgctgcccgccagcccagcagggccacaggcttgggctctgcacacatacctgggttcaagtcccgcatctgccacttcctagcgggtgaccttgatcaagtttgatgggattgcatgggtgcagcgcagatgacacgactggtatacagtgggtgctaaatcctcattgctctcctcttttcctccactcccttgctttcctcccctagcactgtgcaaatgccccctccttttctcctttttcctgggaacatccaccagaccctttgctcctccaggggctcccaccaaggacaacacagcctctcttctggggaccagagctgagggcacggagaagtgcttatgggaaacacatgttcttagaagcttccctaaatagcccagggtgctcctcgccaattcctttcccacgagcagggacggggcagtcttggatggatggaggctgtgtgtgtgtgcgctgcagtgcgcgttgttgtgaaagggcctggataaaggcaggaagtcattcggcgccccccaccacccaccacccgctcctcccaccagccactggtgctcagagctggggcctgcatgcctcctccttcccctctgcctctttccaaataaatggggatctcaaaggactttttaaaacctgaagcctgggtctacacacgccatgggtcccaacgggagacttggagctggtagcaggggaatgcgtgcctttcccaatgggatcaggatttaggcttcagtgtcccacctcctccccttctcagcctcctgccttcttgactccctcccaggggaccagctgcctggtcccctggggtcccacagccactgtctcttctccatttgtgctattttggagtcagttgggtttctagctagactagtggtcccagatgttttgtgagcagctgacgaaaggcgtggatgttgcaccccagaaaaatagcccaaccccaggctctgtctagagctgggactacagcatttgcatcctgtgtgggggtcgagggcacaggctgtagatcttagggtctccagtgcccttggcataggcttggcactgaaggaatgcttgctgaatgaatgaatgatctgacacgtgaggctccaggagccatttcttactcccgtctccctgcacccagggccagaacacagtaggagctcaccgagtatatggccttggagttttctacgcagggcctccaaagcaaactgtgctcccatcctgtgagattaaccactaccatttgcaagagggaccagaggtggcccagcaacggcccaacctccgctaaagcattcattcgctcatgcattcatgcagcagacacttcctagggacctactatgtgccaggcctatcctggaccctgggcaggggtgggggcgggagcaggtgctgtgggggtgatgggcccagatgacaaggtctcagcacttgtcctcctggagcttacaacccactggtttttaaaccggatgtcaggtttcttctgggattcaaccaaatgcagactccttgccccacctgcggaactgcaaatcgagtgawtctggggtcaggccgggggtcctgtctccttcaccgtggtctgarcgcttttccagggaccacaatttgagaccttcaagtgtgtgggaaactgctgctttttcagcacctccaactgtataggttagaaacgtcctgtgcaggtagcgtaggaagttctcccaaatgtcccaaatgtctcggccttcctgctgctgtgggagcaccagcctctgcgygaggtcctggagtccccccaactcacctgggtctgcccttccctgctctgcgcctgtgccggggctcccggagcctgtgggaaagtcatgtctgcagaactgcaactaggatcttgcatcatataattagctccctttacagccaaaagtcggcccataaaaacttgggtgttttcatgggtttgggctagtgggtgaggacggtggaggagaaaactcccaaagtgagtaataaatgccctcctcacaggttcctgggagcataagtgatttcatgaggggacggaggggcatggaagggggccccaggagagcgtgtaccctgtgggggtgggaaagcagggctgtgggctcctgggcacatctgtccatctggtactgatgctgccttccccctcggctgctggttttgaggtctctcgccctccagatggacagtagctcccattttacacgggaggaaactgaggtttccccaagggaagacatcttcctagtcactggatctggtgacccgcaagcctcacccatgaagactcgcaaagtttaacccttcaagtatttcccaagtccttccttcatgatcagcagtgggaacttggaaggagtgagggagaaatgaggcagcaggtgggaagagaccttgggcagagaggctttgagcgacatccctagagagttcctgggaaggaggcctgagctgggggcactgggaacagactaggggtgaggggagggaaggcatttgttcatagctggtttgattcccagctcttccacctcctagctgtgtgacytcaggcaagtcactttacctctctgacctcagttctctaatctgcaaaatggggatgaaaaagagcacctgcctcacagataattcagaagatttgatttatttttatttttttaaagcatcgtacagagttgaggcttctgtcgttttcctaactttgttgatggtgggccaccttggcaagcttctaggctgtggctccttctcccaggcctacctaaccagagctctcttgccctacaggtccccaaggcaccctctccaccctcctcctctgcctccctccactcccctccccagccgcccaccgagtcctgtccccacccagcccggccccctcccctgctccagcccctaactctccctctctccctcccggcccacagcgacatcaagaggattggggtgcggctgcccggccaccagaagcgcatygcctacagcctgctgggactcaaggaccaggtgaacactgtggggatccccatctgagcctcgacagggcctggagccccatcggccaagaatacttgaagaaacagagtggcctccctgctgtgccatgctgggccactggggactttatttatttctagttctttcctccccctgcaacttccgctgaggggtctcggatgacaccctggcctgaactgaggagatgaccagggatgctgggctgggccctctttccctgcgagacgcacacagctgagcacttagcaggcaccgccacgtcccagcatccctggagcaggagccccgccacagccttcggacagacatatrggatattcccaagccgaccttccctccgccttctcccacatgaggccatctcaggagatggagggcttggcccagcgccaagtaaacagggtacctcaagccccatttcctcacactaagagggcagactgtgaacttgactgggtgagacccaaagcggtccctgtccctctagtgccttctttagaccctcgggccccatcctcatccctgactggccaaacccttgctttcctgggcctttgcaagatgcttggttgtgttgaggtttttaaatatatattttgtactttgtggagagaatgtgtgtgtgtggcagggggccccgccagggctggggacagagggtgtcaaacattcgtgagctggggactcagggaccggtgctgcaggagtgtcctgcccatgccccagtcggccccatctctcatccttttggataagtttctattctgtcagtgttaaagattttgttttgttggacatttttttcgaatcttaatttattattttttttatatttattgttagaaaatgacttatttctgctctggaataaagttgcagatgattcaaaccgatcttggctttcagtcttgggaaaagcagtggggtcccagagcttcctgggtgggagttgaggggctgagggttccccccaaacccctagtgtttaaacagagattcgtgcacaaggcagacacgtcacttaaccctgggagcaggggtgggtgggaggtgggcagggggccgggaagcaggttctgccgagcccggcctccatgccagcaggccccaatcacctttgatctccaggctgctcagagtcttcgggagggctgggaggtaggagaacagcaagagccgccgtcagcttccctcccacggctccccggagctgtcgaaatagatccttcaaccatccatgtacagctctgaggtttacacaagcttttcacaggtttcggcttgtcggaacctcaacactttgttatgagttttgtgggcggccccattttacagaaaaggaaaaccaagctggagcccagcaactgggtttgttcaaggccacacagcaagttaggggcagaggccagaattgaaagcaaggtcagaaatctcagtgggatgcttttctcatagatgaggagatggaggctcagagacatgcagcgacttgcccaaagtcacacagcagtctcaagaaaagccagagttctaatttcttttttttttcttcttttttttgagacggagtctcactctgtcgccaggctggagtgcagtggcacgatcttggctcactgcaacctctgcctcccgggttcaagcgattctcctgtctcagcctcccgagtagctgggactataggcgcgcaccaccacactcagctaatttttgtatttttagtagagatgggatttcaccatgttggccaagatggtgttgatcacttgaccttgtgatctgcccacctctgcctccaaaagtgctgggattacaggcgtgagccactgcgcccagcaccagagttctaatttcaaacctgagccttctccactctaccgggttgcagccctgcatgtcagaggtcgttcatagtgggggttaggaaggtgtcaaacacaggtcaccaggaacgtaaccagggagcagagatgatctgaggcccaggaggaagacttcctggaggaggtggtcccagagctgagacctcagggactactaggaattaaccagcgaagccaagggagggtgatgcagagtgaggcgcgggggcgtgaaaccacatggttgtgcaagggaaccacaagcaatttggtgttattaaggcatgacgtgaggtgctggagaagtctctagggccttgtaaagcaggcccaggagtggggatttcaagttgagggcaataaggagtcattgaaggtttcaagcagggagtggcatgattgttgtcactggtagaggcaggtctgcaacccagagctcctgactcagcctggagctttggggagatacaggagaggcgctggcaaaagtcgagagggtgttcggcctgccctggggtctcaaagctggcatgctctgccctggcccctgctgctgcaggagagctgccaccctctgggtcctggcccactgggcatccatgagacacctgactgtgtcaggtgcggctggggttggtgagctatgggagtgcagggagcacctggctgggccttcctcccattagtgttgggccacctgagtgtgctgggcatgatggctgagtcaggccttcctggtgcctgaccctggcctggcctgacccaggtggccactgtagctctgtggctgggctatggctactgttgctaccactgacaaagctgttggcccagcagggaataagcctgcagcttgcaaatccacaaaaatctgggctatgagggcacatcaagaccaggcctgagtcccattcccaaagcaactcagccatggccctgctgatgagcaggaatgaactcaggaagtggctcagcatggggggaggtggcctcgtgtgctctctcccttgaagtcctggacataagacccttccaagggcatgtgagaacccataaacctgtgggccacggacaggtccgatgctcaaaacccagtgagcagctgtctgcagtctccaatggaccctgcaattggcaggaggggaaactttatttttaaattaaagcaaatccagatctgtctcctagagggcctagatgcaggaacacccctgtagcaataagaacacccagcccgcacatcttgcttcctaaaaaccattctccaatgaaagggaccagggctccttagagaaatggctgattctggggctgaagcagggaaaatacaagatgagctgggagcatcttggagtatcagagagtaaagaagtgctcaaaaataaacaggtggggctgtgccagagacacacaggagccagccctaaagaactcccagggcctaaacctagaacaagctgagcaacaaaacgatgaggtattagattaaatccaaagtcaaaaataaatattcacgagtctatactgagataaataaatgattaaaggctgggtgcagtagctcacgcctgtaatcccaaaactttgagaggccgaggtgggtggatcgcttgagctcaggagtttgagatcagcctggccaagatggcgaaaccccgtctctatcaaaaatacaaaaaattaaccaggcatggtggcacgtgcctatggtcccagctactcaggaggatgaaacgggaggatcgcctgagcctgggaggtggaggttgcagtgagccgagattgtgccactgcacttcagcctgggcaacagagtgagacctcatctcaaaaaataaaaaaaaaaaaatgcttgaataaataaataagtggagggagcctagacaaatcttccttacagatgaatttcaaaggggtggattcttttccctctagtgggtaaagcttacttccccactgcctggactgcggactggacacccttccaaagaaaggcagtagggaggtatagaaagggttaaaaaaaataagaaagaaaacaaaaagtaactttacagtggagaaacctggcaaacaccaccgtaaccaagtgatcaaagttaatatcatcagagaaaaaacaaacaaaccaacattgagcttgaattgaagatcaggtatcagcaaacacttacacaaggctttctgggcaccacccactgttctaagcacttagcctgtgtttacttatttcattcttccaacagtccttcaaggtagatgctattaatatcccattttacagatttgaacaccgaggggagggaggttacataactggccagagccgccctctcccctctctgccatcatggacacttccctagataaggtctgagaagcactggttctggggaaactgaggcaacataacctgcccatggtctccaaatgccaccacatcccacaccccaggtatctagatagtttgctgctctgtcccttctctcagtggccagttcctgctctatgccaggctgggcacaaggtcacaaagatggataagggccctgtctgccctcatgggactcagtctggtgggggcagcaatggtaatagagtaggacccaggctaagaaggggcagagctgggtgttacaggagccagaggttggggcggggatgggggaggggcacttgacccagcctagaaagtccaggcaggctgcttggaggaggagccatccaagctgaggtggaggtcaagtgagagtccaccaggcggaggaagaagtgtcccagaagagcctggctctgactccagacctctgtgggtggggcttgagtctcccctccaacatctgggccccatttgaccaagacaagattcctccatctgctatgccaccctaacccctggctgttgtgtcaggagcagctgtaggacagcagccctgccctcattcccacccctagcagaaccttcatctctgattttagccttctctgctgagaagtgggcctgcagccctttctgggttctgagctgcagggaccttggtgggcctttgatgcatccagcaaagccctgaaggaggtgaaggcagtggtgactggggcattgggtagggagatgcctgctttctctgctgctcccagtctgcatggcaagttaaaatcgtgtcgccaggcaccagcccgagatttcctaattaattagcaaattctggagggacaggcaagctctctgctcgcctccccattcacaccccctcagctccagctgcagcccagggcctgggatggggccttgggcaccatagatgctgctagaacagggggcaaatgaatgtgtacgggaagtgcttgagtccttagctccggccctctgtgcctttgcccattctgtgcatcgcgcctgcatcgtccctccccggaactatgtctggtacccagtaggccctcaataaacatttgttcaataaacaaatgaactgtgggggacaaggactgggcttttgagatccaagagccctgtggagctggatatgggttttgggaatgtggtgagtgctgtgcaatggtcctgggctccctctggctggccgggagggaccacaaaagctggtaaggagaagcagttgaatgtttctgaacacctaccattgtaggtggtgggcgttcctctagcattgcctgttcctagaggagttgctaattaattaggaaatctaaggctggtgcctggcgacacggttttaacttgccacggtgccagtgagtgtgccatgccagtgatcatgcccagcccaagacccacaccgtcttatgcaagggtcacaatgaccctgaggggcatacatttatccccattttggggaccctggggctcagcgaggttacagtaatcagaccaagttcccacagctaggaggtgacaaagcggcataggagacaagagtcagctcatcccactgcctgctgctcggtgacatttggggaccttggggttcttttcaggaaacggcaggaagacccttggactgggaagggaagacagaggttctgttgggcgcctactattgacttggctgtggactcctgggcatgtcccttgtgtcacgggggctcagtttgtccgtctgtagtgaggaaggctccaggaagtctgtcctggctgagatgaggggcccctgcccccaccacagagttgccccctccccactcctggcaccctctccccaggcagccctgggcagccccaggtagcccggccagcaggccccactccagccctctgggtctggctttccagtccaaaccgtcagccagtctctgtcggcagaaccagacccagtttctgggaagctgcagccacatcccacccctgcctggggtgggggccccctttctcctgctgggcccgggccccatttcagcagcctcatcacattccccacggcctcagcagcctgatggatggatggatgcagcttccacactgggctggcagagcaggcggctgcatgatcaggtctcctgctgggcggaggggcctttcccccaggaccaggcctcatgggcccggccaaccaatcccagcatctgggcacaggacacacttccccagactctgcacccctcccctgtactctaatgcggtctagactcccggacctgccctcagttccccatgagccctcgcccacccccgcacacatccctccctatttctgtctgtggaaaatacacccacccttccaggctcaaatcaaatcacccattttccaagagacctttgcaggccaggtgtggtgggttacgtctgtaatcccagcactttgggaggccgaggtgggtggatcttctgaggtggggagttcgagaccagcctggccaacatggtgaaacattgtctccactaaaaatacaaaagttagctgggcgtggaggcgcatgcctgtaattgtagctactcaggaggctgcggtaggagaatcggagaatcgcttgaacccaggaggtggaggttacagtgagccaagatca

SEQ ID NO: 10700 - DNA, 803755 bp, Homo sapiens
  misc_feature (1)...(803755): n = A,T,C or G, or insertion/deletion polymorphism (see Tables 1-2)
ctagaagacattagagatgggtctcatgctgggacaaactctatggacacaagcgtttggaggttacttttgtggtactgaacacagcaaagtggttagcaccctgcagttaaagaatgaactccacatagaggaagggataaaaagaagaaaggtgtttcaaaatggaattttcttaaaaggaaagtgaaagtagaaaggtatctacaaaatggtaaacaagcagttcatgaccatcaacagaaaggatcttaattattacccataaagaaaagaagtataataaaaaagtagacacattttctctgcctctatgcagtagttattgcatttgagggacattacccttaaacatacacctacaggcctgggcaatacaggatcaagggctgtggttcacaggagggagatacaatctctggccagagtaatcaaagcccagaagggggctttgaactagtccttgaagcatggagtggatttcagcaggattttgtggccctggatggctaaagaaatagcaaaagaagaggcacggctgagtagctttttaatctgcagaacagtagtctggttgggaggcaaaatgggaatactaggaaagaaatattgaaaaggtatgtttaaggctatatcgtggggagtctccaaagccaagctgaggggtttgaacataacctggaggcatctgggggccacctttcaatggttctagttcttattgggcaaggaagtgacaagatgaaaacattattatagggggtggtgctggtgggagtcaggaagatgatttgcactggaaaagcataagaaacaggaagattagtgatgatgttagtgaaattactctgggatataaagacaagaatcaggaaaatgccttttacttataaaaagacactgatgttcagtgggaaaggtgagagaggaatcaaaaatggtgatcagagtttggattcgagctgtagtacaacagaaataggcaaatcaggaggaagatctgccttcagagacacgtgacagtcagaatgacctacttgggaagccactaggcaatttgagttggaaatgaggctggggaacccacatttccttaggaacccatacctcctgatctgtaggggatacattccaagaccccaggggacgctcaaaaccatggataggactgaaccctatgtatgctgtgtttttcccctatacatacaaacctaggtttaagtttagtttataagaggcacagtaagagatgaacgatgataactagtaataaaatagaacaataataacaatatgccagcatcactactcatgcactttggagtcattatgaagtaaaataagggatacatgaacacaggcaccatgataccgcgatagtcgatttgattattgaaacagctactggctaacggtggggagtacagaagagtggatgcgctggacaaagggatgattcatgtcccgaatgggacagagtgagatggtacaaggtttcatcacgctactcaaactggcacacaattaaaaatgtaggaattgtttatttctagaattttccattttaaattttggaactttgagtaactggaactgcagaaagcaaagctgtgggtaagaggggactacagtaataagcaaacttttcgtcgggtggggacatccttctctgtgatgtccagggctcctccgatgccaagaggtagatcatgtgtactttttctatctgcatgtagttcagtcctgaccctggaaatcagaatactaattgtagtttggggcttcataatttggaaaggaactaatacgatagtggtgaataaccttcaagtcttgaaaaactgatttaccctaagaatccaaactgcggagaaaggcacaaattggatattatttctgaacacatagtaatctctgtctctttccagaacttacttggcattccaagagctagcaggacctgctttggcctgaaaccagggacagatctcccggggctgccagagccttttatagttcatgctagtctagactcttttttgtgctttccgctttgggatggaggtaggggaggagtataagtcctcggacccctgtgtcaaaactcagcagctgcatactcttggccaagctacttaacttctttaagtcttctttcctgtttttcaaaaatgatattgctgcgaagacgaaaagaaaaaataaaatgcaagtgctcggagcatagtaaatgctcaataaatgaagtttcatcaccatcgtcatcattcgtaatgtaatttctggccatcttgcattaatgcagagattcaggccatgtgacctgaggactggcttgtggtgaatttcccagggatttatttctaggacaggtgctcataagaattatagtattttagaacacatgcaataaggatgtaaataaaatggaaattttgtaaaatgttggtctgttgagttctgaagtgggataagaagataggtatgaaatgttccttagagattttgaaacaggaaatctgagttaacaagaaatgggctaaatctcaggacgttagaggctctctaatcctaattttataatgattcgatgacaattccagaggctttcaagtcagtaataaagcctttaatgtatgtaatcttaattgaaaggagctgaattaaaatgataacattgagtattttgctgagtttccgtagaaaccttgaggaagaagttaattttttaagctcatgtacatcattggggagcttagtaaattgtaagtcaaaatgaaaaagcttacatttgtcctaatttttttcttctttaaggctgtctagcatcctgccaagtgaataagtgggctacgatggcccattcttaattagatgactgcagaaaaactcttaattaaaaaagcaaaaatataatttttccctctcttgcagaatataaaattagtcataaagaagaatacttcccaaatttggactaagaaacatagaaatgtcatcctctaaactttttattaataattttatgattaataaagatttaaaatgtagtatctattgaatataaagattatattataataaagcaatattaagataataaaaagcaaaataagctattatacataacacgaatttagaaaaagagaatttttttttttttttgagatcaggtcttgctctgttactagggtagtggcttgatcatagctcactgcagcctcaaactcctgggctcaagcaatcctcctacctcaacctcccagtagctagaactacaggtttgtgccaccatgcctagctaattaaaattttttttttttttggtagagatgaggtctccattgcccaggcttgttttgaactcctggcttcaagcaatcctcctgttttggcctctcaaagcactgggataacaagtgtgagccattatgcccagccaataaatattttaataaaaattacaaaatatatagatatcaaatactattttctaatgaaaattgtaaataatttttttctatttaatgaactatagttttgtgcctagaaaaaggtctacttgttaatttcttttagtctgagtctacaataagaattaaatacagtaaacataaactttaagctgtatccaaattttatgtattttttctcaagtacacttaaaattgaggttagttagtatcctatgatctctgcactggaattcttactacaattgtccaccagaagaagaaactagggaattataactaaattatccaaaagggttaaattttttttaaaaaagctataagtaaaaagtttccatagctttcactgaagttgctttcttgtaaaaattattttgttatgtaattatgaaatataacagaatatcagagtaccaaaaataatattccaccaatatgcccatcaccagtattaaaacacttgttatatttgctttggttttctttttaaaaataaatgttgtatatcattctcaaacatatttttatacttttagaacagactagagatctataaacctcatagttttgtatttttgtgttttaaagtccacatacacggtgtgttttataaatagtctctgctctatgtctacttgctgttgaagactgtatggggtgaataagaaacatcgagtgtctaggccttttagcattattccacttacattgagagaactaaagaaataataaccataactcttgctagaacagtttacagcctagttaaaatgccaaaatgaagacgtggtaagcgtttttatattattttacctaccatctgggtagaatggagtaattaagaaacctgtctctgcatagttctgaataaaatagtttaaaacgtcaatttgatacgttctaaatttggaagatcaaatcatttaacattaaatcaggagccaatttcagaatatagtcattgctcatggaggactcttacccgactttttgggagctcactggttgttcctttagagactcgtaagagtaaacattcacataaataataacggtttaagagttggttagtcgtcatggctacagggataggtcaagtttttaggtaaggtgactggtatacttccatgagatagggcagaacattactagttctaccacggacagcgagtatttatacacatattgtcattctcctggaaatttacaaacctaccccagtaagtacaaagttaatgaatgctaaaaataaaatataaactgtatagaactcagtggtcgattttaataatgagttagatgccgcagaatgtaagatgtaggtaaacggacgcaaaaatccttgttttacaatgtctgcatctccgtagtactgacatttgaaaactttactttgcacatacttattttaagtacgataaatgaaagcgctgtggactaggaacaagagacaaattgctttcttgtccaaattgtctcagaccctgtattttcttagtcatagccgtttgttaagtaggcatttggtagactattgcatggaggattgcgagagcaagatattactatctgcggtggaatgctcgaatttcttctctcagcaaggataatgggtagcacagtctgactttagacccatccagtggttcagacttatagatagtatcccatactttaccgcaattccttgttgaattaaggcttgcacttcgaatacagactacacacttctgggtctgtcttgtaccacattgtctggcataggcgctcactgtatatttgttgaatgttaaagttctgtgcaccaaaaccgtgcactttgcatcgattatctgcgaaaagcatggtacactaaaactagatcttgaagaattcccatttgatcatgaatagaggtaatccacgtttaaaataccaggtgttgcgtaatctctacttggagattagccaccccgtgcgcccaggtgaaagatatcattcttccgtgcgatccgaagtgccgtggaagttagtgccctagcccagtccaggaggaaggggcgtcgtgccggcggttttaagctcggaaggggcaggggaatgagcccagggaccccagcggggcgcaggtaggaggctgtgcgctcgccgggtgcgctccggccccgattcccagcgcagccagtaagtggcgctgggcctcgggtttggcggcccggaggagcgggctgcggattacctgcagcagcggggagccgccgagctcctccccgcccgcccccacaccccacccccaccgctgcactaaccccggctcagctggctccgcgcacttgctcggaggagccggggccgagcggaccgccggctgcaggcagcgagcgcggctgggctgcggggctgcttccccgcgtcctccgggcccgggccgccctcctcccgcacagtgcggagcagggaggccccgcgcctcgaccacccgcgcccgagcgtccgcgcctcctcctccgctctgcaggcggggaccgcccggcgctcggcacccggcagcgcggccccctccagcccccggctcccggcagcagaagcagaaggcagcgccaggggccgccgccgccgccgagctccgcggggctcgggagccggccccggcgaggaggcgcggaaccatggccgatgggggcgagggcgaagacgagatccagttcctgcgaactgtaagcgccgtgcgtcgcgtgtgctgtcaggggaagrgggcgtcagggcatccactagcggggtccgggcagagtgacagcgggcagcggggactcgcgggcgrggcgagggggtgccccctgaggatgcgggaggagcgggcatcaccaagtgtgtgcaggtgtgcgtgttggggcgagggaaggcaagggcgcgtgtctgtgcgcgcgtgtggaaagctagaggatggagcgcggctagccggcggcaggcgcccgggctcggacccggggcaccggggacaggagcgtcggagctgcgggaaccgggagaggaggggacggccggtccggcctgcctggtggcacggctgggacctcccgggcggccgggggcagggtgcagagcagggtggcccgtgggggcgcggggagcggcgggaactcgggctgtttctgggaataccgccgccgggaggtttcttgggctttcgggctggacccgcgcgttgtcacggagcgaagacgttggttcgcttactccgtgtagcgtgcggcgcagctgaccgggggcgggggtgatggtgcaggacgctgcgcggaggtttcccccaagtcaaggtgctgcgaaagcggaggaggagtcgcctccgtggtccccgcggttcccggggctggtgccatccgtggtggtgctgtgaccgcttgcaaagcgtggaaggcatgggaagcgagcgtgtgtttgcgtgtgtgcgcgcgcgcgggtggtggtggggagaacatcgtgaacgtgtcgttctctaaatgctggcttattgcatgccaagtgaagcaaagtgtgtgtgtgtaagtgtaagggcagggtggctgcccgggaaaggttggctccacactaatacaattctttctccttaagtacctcttggcactgctccttcctttctctcatttgttcgaacactgcagatacttcccaggctgaggcattgcacacctccaagctgggactggagagcctctccagaaaagaaaatgccctaacttcctgctaataataacctagttagcatcctttcagtcgttccttctccacttctgtcctccttcccgaaggatgttcccttgcaggattccccagacttccccaacctagaactgcagcttctgctggtacttctttcctcagcagtacaaaaamaaaacaaaacaaaacaaacaaacaaacaaaaccacttcccggttacagttacctataatcacagaaaatcgtagatacggtggaattttggaatattaacttttaggtgtgaaaatagtcttgatgtatttgggtactaaacrtatgaaaacagcgaatttgcaaaggaacgttgtaaacgactgtctctttctcttttgtgcattaaacggactgggagaaagctttgggaaggataaaaacccagggtccacatcagatgacaacctaatagtaatccagtctaatagctgcaggttatgcaccattgcatatgctttttgaagtactgttggcccaagaccgggcttggaagagcctcttcactaataccttggtcacggtgtataaacctgctagtaatacagttgtctttttcatagaaaatagactataagggttttttttttttaagtaattaacaccacattagatttttctcaaaactaaggactrttttattcaggtggacaaatacggttgctgtataatttttcaatcaattcgtatcaaactctgtggggttaaaactagctgggacattttggtaggcttcatgcactcaagggcttcctgcgggcttaactgttaagccgagctcatggaggtggtgttatcagaatgcttaatggggaccgagggaacgtgctggctgatgaggttctgcacatatcaagtaatgtcaactctgtgccactcagcagctgcctgtcagctagagcagcacctttgataagtgggtcctgggtagagatctggcagtcccaggctgggatttttcttttaataaaacatccgtaggttgctgtgctgacgacaaatgaccttgaaggaggtgacacagtggagcagggggatttttttttttttggtatagcattaacatctaaaaggaaaacatgcctttcctcacaattttccaattttcatatggaaattctcaaatcctttaccggcttctccacccattaccctccatccttccctcccccaccccctttttttttctcttaacctgagaatgttggtggttcagaaatgctgatggggtgaataatggggagactgtagtatagttcccacattgaagtcgcttcttttttttctgagggcatttatttctctgtcatgtgcaagcttgtcaatatgagttatttcttcttcttcttctttttttttttttttaaagcaaatagcccaaggagtattaggaatctgtacatcttgataaaacagttgtagatggaagaattcttgatagtgatggatgaagctgttttgcatagaaaaacaaaaacagtcattaagacaccgtaattgtgaatttgatgggacatttcatatgtcctgattagaacatctggattattatcttgagcaggtcattgtctattggatttgtattcagcaccccagcacattgaggcatctttttgaccactgtccacagaaagcttttttgcttttctttttttagaagaggtgtgagatcactgttaagggaagtagaggtgaaatctttaatgggctgtatctgtgagttatgtatgctgctgtaaattaattcctcatttgcaaaggggtttgtcactgtttagcttgtacctgtctctctggcatctctgttccatttgctgctgcttgtcgagttggctcacattccttccaaatagttatgtagatgaatgatcattgattcagtggctcccccatctgttggaaacctgcccacttgggtctgtttatctttgagagagattgaaaatatgtttttgtaaactctggatatgctgggacacttattttatgagagaaaaatcctatcataaaataagctgtcagcttgtaatggattcattcactgtcatatccaaacatatccatgatttggaatgtgtgttttattttaaagattttattaacttaccaatgtagcatcaaactgtcatttggcatttaaaaacacgcatctttttcgttatggtcctcttttttttttttttccaacaatcatacagaatgttatagaagatattcctctgactttaggaaaaccatggtrtaaaatgaccttggtcaaggtttttttttttttttttttttttttgagtactttgtctttctttcatttgtctaagcacagttgagttacccttgtggtgtactgtgtcatgtagttttgtatttacccatagattgagacttaaagcttagtcctggctgtaagaatgatcctgataggaatgcttacggtcttcctcctgtcttcttttgcagaatgaagtatttcattatagatttcttctcagtgttcatacatcttgttccacaatgacaagaagcatctttaaatatactcatctacaaatggtgacaattatgcagtatagatgctggtgtacaacactgcatagtagtttggatgggaatacttagccctagtttgtagaggtccaggaaggttaatggtatgaagtcagtactcagcagtgcagaacgaggactaaaattcaaatcttaggctaatagtgttctttccaggagagaaaggcttctttatctgctgttcaagtatgttttaggtttatagcaaaagaataccaagtcagttttctcagctgtaggaatgtcacagagtacaaatgaaaagatggaatgagcagtggaaattcgcactttttgctcccttcataatgaagctacgaggagctttagatagatatgcactatggtattttcccaaggaactgatggaaagcccacccaggcttacatcatcagacttattttattttaacttagaaattagcatgtacacattggcaggaagggcaagatctaaaacgcttagggcactaatttatttgacattcaattgtatttgtactttggcttcagataagtgtttttatcacggctgaattacccaagaaaggactccagcagcactgggtgactgtgcttctttagatagctttcgggagagagggagaggtgatgaagcacacatttttcctgaaactctgacattgtgggaattagattaattcagaaaacatttgttgaacaccgtctgtatgcatagcatgttaaggaagtattccaaataagtagggaagtggtttgcagctgtaattgcaaagaatagatatagaggatggcatggagcaatcagaaggaaaaatgcataaacaaactccaaaacattagggtaggaagaggcctttagaaaacattaccctgtccaccccatgcctctctgatattgcagataaggaaacaaaagctcagaaagccaaatgacttggcccagtgtcacactccaagttagtggcatttagtaatggagagtatatgaaaatctgtgaagaatttccagaaaggaggtttaccagcacatcattctttatagagtagatttaaacccacttttccattttatccttaacttgaccttcatagagttctgtctccaaatctgtcctcttgtccttccagccagtgaaaaggaggtttcttttgtcttttctaatgttacagtccctcacatggcctgaatcttggtcctggaagccaagattggaatccatcctttctagccttttttttttttttttttgcctccctatccacttactccttctggtttatcttgaagcctgttaatttctcccatcttaaaatgtctgtctttgacccggataccttatttggttgctcccctcctgcagaagtggtcttctcccactgcttgtacccctctccatgtaattatctagcttctcttccttcttcaatttactttccaggatgttgccagtaactccctccttgccacgtctaaatgtccctctctgtccctattcccttagattccttctcaagctctactaccctgactttcctttttgaagctactcttttgactttggggacatggtaccttctgggtaattttttacatttctgatcatgctttttccaggtgcttttcattccttttactccaagtgtgtggttatcccaaaagattctgtcctatttcctgttctggctcttctgccttcatgagcttatctatgtcacaaaatctgggatctcttgaataacagagtctgaaaagacttaacaatgacttcatccagctctgagagccagagagatgaaaggaatgttcccaaagcgactcttttttgtaggagaaacccaccgtagattcgacagccctgggccttcacttcaagcctctgtttagacttccctcttgcctctcggaccccagaaacaccagcttgacatcattgcctgttcggttccctaagcgactttccttcctagtgtctctgctgatcagtggcactgccgtttgtggctgtggctccagtgtgatcctaaccttcagaagacctgagtctgaggccggaatccaccagcacctagctttacggacttagaacaacagtgcctggctcatgggagtggctcaatgcatttgtctagttctctttcttctcttctgcatctaatttgtcatcatagcccatcgtgtttctctttgcaatccaactcagatttcgatgtgtttcatactccgttagcttcttgttctgatcccagtactcatttcaaccttcgtcatccttcctcctgcaacaaatcggcaacccacctagaatccgcctgccattttagtcctcctgaaaccctcgtgtccatctcccagcctcagctcacatccttgcatatcctgtctaatttctctacttggccttttatgatctgccccttgataccttgcttatgcttttcatcctacacagagttttcttggatcactctaaccaattccgattttacctttctccgaccatttatcactaataattaataaaatgtatggaactgattgggaaactcaagcaatggtcagagaatgctctgaccctgatgctctgtgggtgagttgggaccgtgttgggcatcggtttcccatgatgcttggtgcactgttaactacaaggacagacttgagagaaatcttgtggcaaggagaagatcgggacaagagaaaggatcctcctgcccacaagtttaatgtgaacatcacttgaatgcgtccaaatgcagaaagaaggaacctgctatgaaggaagtaggcaaagatagtgggggtggaagaatagaggtaagatctcttctggaagcagaagagtaggagkgttggtgggtgaaattctgagatgaggacaccggaggtgtgtagggtgagagaggccaggtgatgattgctgctttgggaggccgcagtggctcccaggtccagtgggaggggacacccggagaaggcaattagagagagggaagttacagtcactagagcaaatgaacaaaggagagtaagagaataaattaaggattaattgagtctgagtgattagggctgcccaaaagaaatactggtttagagtcagaagctgtatttcaaatgagcagctgtcagggggtgaggtgacttccaggggcactgttagagtgtccagtggatcagtttcatccccttactttcctctttattaatcacgggaagaacattgggatgaggaccctgccaacaaatggttgtgtgaccttggggctggtggggtcagatagagatttgtttgagagaggtaaaatggggaggttgttttctcagagggacttgcggtaatttccattgtcatgttcgtagtcttagggtcaaccagactcaaaccattctgcaggatgagcataacaaaatctcaccctgggactggaaagaaaagctttgaatgatcctggggtccctggaaatcctcatcctggtggattacaggccctgaaagctgacaacaagctttgagccaggattcttgatgatgggtggttttctttcagggaagaggagatgttaacaataagagaagcttgcagacaggcatttagaaggagctaggagaagaattctctcatgtcagtagccctcttagggactacttaggttcggatccatttagtaactgaactcctagtgagcttgtttgcaaatcctctctattgtcccagccgtgaagtacttctctggcttccatagttaccttctccctggctggtgaagaagtggcccatgtttctggggtttcccagaatgttacagtcagcctcaaagcccatgtggaaggtatatttcctggtttctattgcaaaagttctgtagtggtgttgctgcaatgaaatggaagtccaaggcattccctgttagtgacggagtgttcagaggacctacacgtaattgctttcatgttcgttacccaagtaggggacagagagagaggagccactgacacgtgaacccagggagacctcccctggatggctgggtgcaggtacttaccacccaccaaccgatgatgagtatctgccaatttactggaagaaaacctgaaatctagctgtggagccaagatagatgcagaagaaagcgagtggaacaggagaaagtgtataggaactcagaggctggcagggccttcctgagtctgggaagggctgaggcgggaacgaggacacatttgctccctgggacacgtggttcttagtgtgcaggggaaacccgcatgtggtcactgagggagaggcacaggcccacacatctcatcaccatgaaggaaggaacaattcaatgtggccaatttgtttttctactatggcaagcactttttttcctttaacatttttggtattttaagagtttttgcacatttattctgcttctaatgaagttttaattgtttctctttcctcctgagtttagaatctgattcataatgtacatgggaacccatgaatttcactcatatttaatgcataaccaaagatataaactgaaatgatacattttgagaagatcaagaaaagaaaaagaaagcttacaggaaaaatgatatccttagtcttgagtcaattgggatattgttaaaatgaagccgaacagcacactgaggtgatagccactagaagttgtattctcttcttttccacagcaggtttctggttttcaaaataaaagcaattatgatttaaattcttctagcttttgctagagtttatatttatttcataatcaaagaaactttacatgaggaaagttcggtctcacacacacgcacacatgtgtgcacaaatgaatgaaagatattccaccatattttttttcaccaattttgactgtggtgtagaattcagttaaattagttcatgtgtagcagtgaattgtctgttgatctctgttatttcttccagtgctttggggtttttatttttatggttcctttccctttgtctttccctttccctcccctcccttcccccttccctccttttcccttccctccctttccctttctctccccccccttcctcccctttccctccccttcccctccccttcccgttccctaccctctcctccccttctctctctctctctctctctttctctttatctctcttcctcccctcccctcccctcccctctcgtcttctctcctcttctctcctcggggctcatgagtgagttacttttgagagatgctattttgatagtggcaggaccagcaacaaacctgtaccatctcagcattcaggaacaatggtgtccacatgtctttttgaggttgtacagggcattcttaaggcacatttgaatagtcccacaggctgagaggagttcctctgatcttaaatacagcatcagcctgaggagtaaccatttctagtcaggagatcagagcttttttacgccgtggcctacctactgctgttggcaactttatttcttgtaggtgcattgatatgtaattgtctggcaggtctgttctaagcattgcatgtgtattttctcatgaaatccctagaaaatccctcagaggtagctacctgcaaagaagtgaagtgagcccagtgtttgcagacacaggcagtggagcgacagtttcagacctgggcaggctggctctagaactctcacttaatcttgccatacaggggccctttctgctggagatggacatattttaaaatgagagggaaacttggtgccctgcttctacctgcaggaagttactttataatatcaaatgtgaatttcttacaytaccagagccttgcaggctgtgtgccacatcataggtcctgtgtttaatgtttgtggaattgcatcgaactgattccatgagatagtattttacataataaatacagagtagggtaattatatgcagtttactagggtaccttaatgcagtgtgtgtgaacgggatacctcttttatctgtagcattataccaggtacctaagagataccatgaaggtggaagccatagttcccgtagagttcagatgctcaaacagtgaaaccttatatgcatcaacctgggaacagtaagcttatggttctagggggattgtgtcctgtgtaaaattcagagggtccaaaaggtgaagagatgatggatgtggtcatgatattgggctccaaaactcacggartaaatggccaatggtgaagtaaatggtggtaaaagcagagattctatttcattataaaatatgaaaaaaacatgaaaggcagaatccagactatagaacaacatgtaaggcaggaattaaagtttcaatgaaatgccgccttgatctctaaaagtgctccaaaatctcttttgtagcgtttcaggaaattttgattcattttatttttgaaacagttgacatttgggggagtgggctaagggatgaaaatatgttttaaagtgcttgtttttttaaggacaatattttcaagaactgtacttcaggagcatgtcacagttatgagcctgtaggcaagaacagggttttttttttcctctccttttagggaagaacaacatattgaagkatgattaagrcacttgaaaaatgtaacagaaacatacacacacacgcattgcatacacaggatccaatccctgatgccctttgcctctcttcttgttttatttcatttatttatttatttttagacagagtctcactctgttgccaggctggagtgcagtggtgtgatcttggcttactgcaacctctgcctcccagcttcaagtgattctcctgcctcagcctcctgagtagctgggattacaggtgcccgccaccatgccaagctaatttttgtatttttagtagagatggggtttcaccatgttggccaggatggtctcgatctcttgacctcatggtccgcccacctcagcctcccaaagtgctgggattacaggtgtgagccaccgcacccaacccatctcttcttattttttagactatcccgttagttccctttggtcttggacatgtctgtcatgacatgtttccaaggccaatgcccacagctgggagtcatgatcagcttacacgtcctggcttgtaggttcgacgaaacgtcaggagaacatttcttcttcagacaaatgaaaagctgagatgaaacgtttttgattgatggctgtcagagaagcgtaaaaacttcagcttcactgccattccctttgtgacagggaaggggccatcatctcctgaagatgggggtgtcattattaagtctaaatgtcctgctcccgtcatgaagaattgcatcacacagaagcctgcaaagtcagcccgacttgagtcagtcctactcacaccaaagaggatacggaaactggtgaaggataagagacaattgtgatttcacctcttcctgcgccagcgcccggtctcttctccttcattctgaaatgttcgtggactgcctgctacgtgccatgcttcttgctggacttatatccacgcttgtcctgcctttaaagagcttattctgtctctatgggtgggatagggaataaggaaaacgcaaatattctactacacagtggacataacaatcagaaaaccgtcagaggaaaggatgttgaggagggagggatccgtgtcccaggagtaccattatctaaggcttggtggaggaggcagcatttccagtcacagaattctcagactgaaaaggatcttcagggatcagggtctaacccctttatagtgaaggaacatgaaaggacaagtatattggcccacattattccgctcagacaggatagctgcaattcatttgattcctggaacaatccatttagtctataaagcggttaattgcattaatacagatcaggaaactgagttgcaaagaggtgaaatgacttgttcaagggcaattaatgagtaagtgatgttgctggcgagcccagggttttcagatgccaaagcccttctttctccttcctccctccctccttccctccctcccttcttcccttctttcctcccttccttcctttttcttccctccttctctccctccctttatccatcacttcctcccttccttcccttttcctccctccctcccttcctccttcctccctcttctcccctccccgcctcccccctccccccctccctccatctgtcaggaaaaatggtaaaagactgtaaattggattataaggaatgatttatggctgtcctatcacatttgtccatttaggttatctgtgcttttcacttgtctgggagctatcttactgctcttaaattgtggaaaactgatagtaatgattcctgaactgttgattcttgattatagaaaatgcaaattgtgtctactagaatgcagttgtagataccgagtgggtttattcttctcaaacaaattcatctcagccttcctgatgggctgatatctctgtatgtcctttggagtctcctttgaacctgctgtgataccacactggttctttagtgaagaaattaaataaaatctttgatgtgttcattttgtctttgtttgagtcgtatttttactttaaaaaaagttaccttcaacaccactactatgcctcctaaagtaaaagtgagtgggatcttgctgaatttgggtggggagggcaggaagacaggacagatgaaagaggaaggtgagtgggggccatgtgttgtttcttctgtctccccatccccagggccactttccagtcttctctgccctgttctatgttcaggagcctcctactctagatggtgccgggagcactgtttcctttccttgttggctcagatccagggctggggacagtttcccactgttgctggtccctagaagtcccacctctgtcggatcctgtcacgctcccagcccgcaccttggtaaatgatccctcattcacctctcttcagttaaacccttgagagtgccattcccttccttgatgagaccctgatgcgaaggcgggaagcacggtgacacgtttgggagagagatgacgggcgagtactgctgtgtcatcctggggggactggggagccctgagaccagggtcagggatttgttcttaattcataaggtaaaaggggccctggaagttattcttttttctccttctcaagggagaaaaatgggtcagagctgtccattagaaagattaatggggcagcaatttataagataaattgggatgtagagagatcagagcgggaccggagctgagaagcctattaggagacagtcaccacggagctggtgcaagataattcgggcctaaatttgggtggtagttgtgggaatagaaaggagcgggagctttaggacacagtggagaaagggtttatggggttggtaactgattagatacaagaagaggaaaaagacaaagctgagcttcagatggtgttggtcatatggaaatcaggaggaaggggaggtttcaggggaaggcagtgggatttattttggatgtatttattttgagatatgttatggactgaattatggctccctaaaaagtatgttgacatcctaatccccaggaccttagaatgtgaccttaatgggaaatagggtctttacagaaggaatcaagtgaaagtgaggccattaagctggcccctggtcctatatgactagtgccctcctaacaagaagggattaggacgcaggtccacacagagggaagatggtgtgaagatacacagggagcacacctgtgaggactggagcactgcacctgtgaggactggagaccgtacttgagaggactggagcactgcatctgtgaggactgcagcactgcacctgtgaggactggagcactgcacctgtgaggactaaagactgtacctgtgaggactggagcactgcacctgtgaggactggagcattgcatctgtgaggactgaagcacacttgcaaggactggagcatcgcacctgtgaggactagagactatacctctgaggattggaacactgcacctgtgaggactggagcactgcacctgtgaggactggagcactgcacctgtgaggactggaacactgcatgtgtgaggactagagactatacctgtgaggactggaacactgcacctgtgaggactggagcactgcacctatgaggactggagccctgcacctgtgaggactggagcactgcacctgtgaggactggagcactgcacctgtgaggactgcagcactgcacctgtgaggattggagcactgcaactgtgaggactggagcactgcacctgtgaggactagagactgcacctgtgaggactggagcactgcacctgtgaggactggagcactgcgtctgtgaggattggagcactgcacctgtgaggactggagcactgcacctgtgaggactggagcactgcacctgtgaggactggagcactgcacctgtgaggactggagtactgcagctatgaggactagagactgcattgtgaggactgcagcactgcacctgtgaggactggagcattgcatctgtgaggactggagcactgcacctgtgaggactagagactgcatctgtgaagactggagcactgcacctgtgaggactggagcattgcatctgtgagccaaggagcactagggctgagagaggcatggaacaggttccccctcccaccctcggaaggaaccagccctgctgaccccatctcggactctgggcctccagagctgagagataatacatttctgttgcttaagccacccagtctgtgatacgttattatggcagcagtaggagtcgaattcaaggcacaaagctagaagtgtggatttagtgttttggagagaggagtgacccagtgaggcagattggaggccactggtgtgattgagaaaccacaaaaatggaccagatgatctgggaggagcatgtagaggagtcagcaacagaggctcagaggaaggtgactgaggaaacttcttttttttttggacggaatcttgctatgtcgcccaggctggagtgcagtggtgtgatatcggctcactgcaagctccacctcccgggttcaagcgattcttctgcctcagcctcccgagtagctgggactacaggtgtgtgtcatcacgcccggctaattttctgtatttttagtagagatggggtttcgccacgttagccaggatggtctcgatctcctgaccttgtgatccacccacctcagcctcccaaagtgctgggattataggcgtgagccaccgcgcctggccctgaggagacttttgatgtgatcattatgggagtctctgcgaggaggttgaaagtagactcccgattgccagagacccagaagcaacagagcagcagtaaatagaggcagatgatatagacaatcttttcaccccatgtgctgaagaggaagagaggaggtgggagcttgaaaggggaggaagggtaaaagttagggatgcttttcttttctcatgaaagagaccataatctaaggttgtagaggagaagtggtgattgatgttgcaagttcctaagtacaagatgggatagagatgccccccagccccaccaacacacatcaccattgttgggcacacgcctaagctgatgcatcgcctctctttgcagatacctaattactgcttttcttaattcgagagcacatacgattttcatttgcctttggtttagctttgcatcatttcattttctgctagggaccttttgatcattaaaattagagctctataaagctttgttggttcaaagctgggcgtgttttgtttgcaatttgcagtggtttggtgatgaaataatccagctaggcttgaagcaagcatgtctcattaagacaaatgggagaagctgatattgctggcgggttttttctcatagctgttaactcaaaaagaaggtagggcttatataggtaattatgtatactattaagcaaatagtcagtctagggatatattggagggattttctgaaagctcaggtcaggggaaaatgttgaaatatcttargaaacagaatgattctgctggtagtgactgccctcagctctcccactatgataggatctggctaagaaaattccagtaatttttcagaaaattagcaatttatattttgagagtttttttctccacatttttgtgtaattggcactatgctgtacatataatttgttgcttgcaaagcactgtctttcaaaaaaatctaaccagtaaatctatacagtatttacatgtgtaaattccacatttgttccatacttcacactgttgatttaaaggtaaaagctttcaacaaatgtctgcacttaacaacagagcatatatcttcatctcttttgtgttctgaatgagcacctataacactttctcaaaaggaatcttccttggaggcggggcgtggtggctcacacctgtaatcccagcacttttggagccagggcgggccggattacttgagcccagaagcttgagaccagccttccttcctccccggagacttcaccatcttctcacctggttaaggtgcttagagatgctggtctggagaaggggcggggggccggggggcggggtgttcagtaacaatcaggtagcaattagaaggtgggagatagcgcctcacattttttactgtagagtgataaaaaaaaaacctgccatatctactgcttattgaacattctctagttttggtcctgactagtacattttctgcagaaatttktttttgaatttcacatgtctagcagaacgagaaatctggcatacattacaaccaaccaaaacattgctctggacaggcctaaaacaaggacctgaacgtcagtagagaatggaatcagcgattccataaatgacaccagtttcatgcagtcacacagtagggagggaacagagatcatttccgcatttccctctaaatgggcaaactaaagcccacagttttgttaagagggggctgtgtataactcagatgccttactaggatacagaaatggactttaaaatctcggggttaataatgatgatgccattgccatctaacgtgaataatggggcagactaaaatctgacccaaacagaatctgataaataaatcaaggagaaggacttgcaaatctttgcataagagaggagatgagtaatgacaccctcttttgcttgttgttcataccaccaggagtcgagaactctgcataacttagcagtacagcttccaagaagggccctgatattgtggataaatggagtctatttttaaggttagataaatccagcctatttttgtgggcakggaaaaattattgctgaagtgtttttgataagattcttctgtgccataaactgaaatactgagagtataacagtttttcataagaggaaaggaagaaaaactactgtaagttatgggagactaaggccatgtatttatttggggattgcattaataagttttcaagcattcacttttatttagctacatgatcggctttgtggttgtcccagttcatgaagaatgccataaatattggattgaccacggttgataatttttactgcatgataatactatgaatgtattggatggaaccatgattccaatatatgtgtattctttcattcagcaaagatatatatactcactacctcctgtgtgtcaggtgtctgtagggtgctgtagacttatacttaaagcgttcttcttcatttgtgttttaaaatggtttccacatagttattaataagactcctaaatgggaaggtgctgaggctagaatctgatggccaaccaggtaagatttccttcaaagtctgtgtcaaatcagttctacatttctctacatccagtctacatttttctattttattcatagggatattaacaaggaagattaaatgctggctgaaagctctcatatttgtatccacagaaatacaaattatatataaarttatatgattactaccattatcatgattatgttcttagcctttccgaattcctgttatacgcaaagcattctacttaactccatgggtataatgggatatataatccttgcccacaagaaactattaccaacactaatttattagcctttcatagactgtttttttcccctgctaaatctttcttaagtaactttaaaggaaacttaaaaattgaagtgtaatatattaacatacagatagtaaagtacataaatcttaagtgtacagcttgatgaatatttgcagtgtgaacgcagttgtgtaactaccactcacattaatgcattgaatgttaccattacctgcaagcctctctagcaccccctcccaagagttacctgcctttccaaaggttactactctatggacttctagaaaaataaattaattcggcttgtttttccactttgtgcaaatggaatgacaatgcaatatgcactcttttgtgtctagtttcttttgcttcatttatatcagagatgcatccatgttgtagctcctggtggcttagtgctgtatgctacaattcatctatccattctgttgatagacaatgggttgtttctggtttcactaataaaaacaaagctggtactaatattctcaaatatgaaagatttaaatatttaagtgaacacctgaaataagggtatgtatacatttctgctggatatatacctatgagtagaattgctgattgggttatatatatgctcagccttctaaacacttttccaaagtagttgactcagttaacatttccactagcagtacttagtaaatgttggtttcaaaaaagtaggaatcattatggtggatgtatagagggtttcattgtgactttaattttgcatttcactgacaactcatgatggggaacacctgctttgtatctttaatgtccatttggatatactgtattcttttgtgaaatacctattcaggctttagcctgttttaaaaatacagttgttctatctatctatctatctatctatctatctatctatctatctatcatctatctatctatccatctatctatctatctatctatctatctatctatctatctatctatctaatcatctctctagacagagtctcattctgttgcccaggctggagtgcagtggcacagtcatagcttgctgcagccttaaactactgggctcaagggctctttctgcctcagcctcccaagtagctaagactacaagtgtacaaccatgccagctaatttaattttttgtagagatgaggtcttaccatgttgccaaggctagtctcaatctcctggcttcaagtgctccttccaaagtggtaggattacaaatgtgagccatggtgcctgaccagaattgtcttttttaaacattaacttttggggagtattttatatgatgtgaataggaatcttttgttagatacgtctattgcaaatatcttttccaacactcttgcttttcccccctctgttactgatgttgttagtgtcgaagagcagtttttcactttaatgaagtccagattatcagtttttttaaatcatggtttgtggttttttttttgtatcttctttgcctacccaaaggctgttctcccatgttatcttctacagcctttactattttaaggctgatatttaggtctgtgctcttagaattgatattttgtttatagtttgaggtagagatcagtccctccacctatggatgtccaattgatccaggactagttatttaaaaggctaccttttcatcactgcattgcagtggtacctgggtagtaagtcaggtggctgtaagcagggatatctattacttgactctcttttatttcattggtctatttgtcttttcttgttccaaatttataacttttaaattaactccagatttctgctgttttgttatatgttggtgttcatcttctaactttgctctaagtcttcaaaattatctttgctattcttggctcctttcatttcagtttaaattttagaattagcttataaatctccacaagatgagctgctggaatttttaatgaaatagcatcaaatctgtagacccrtttgagaagaattaacatcttttcgatattaagactcccaatctatgaacatggtatatctttcttttatatatttagatattttaaaatttctctcagtatttgcacttagttttccatgaaagactttgcacattttgggggtcagatttatttctaggtatttgatgtttattgatgtcaatgcaaatgtatctttaaaaaattgtttcttagactgtaaaaatataattgactttacatttgaccttgtatctagtaaccttgccaagttcacttattaattctaatagtttatagattcttttggattttctatatgcccagtcatgtcatctgtacatactgaccattttattttttgcttctcagttttcatttcttgttattgcctcattgtacttcccaggatctttgtaaatgctgactagaagacatgatagcagatctttgatcctttccctcagtttcagggaaaacttaagagaatttcatcaaggattttatgatgcttgctgtggtttactaagctgttttgttttgtttttgttgtgtttggcagctgaattctgccttgtattgggagtcttacactgtgcatatgcagcttaaaaatatcagtttagaattatgattttactgtttttttttttctgttagtgcaatggactgtttgtgcctacccccaaaattcttatgttgaaatcttaacccccaatgtgatagtagtgggagatggtagatgattaggtcatgagggtaaagccttcatgagtgcaattaatgcctttataagagagatgagagagctctcttgctctaccatgtgaggacacaatgagaaaacagcaggcagtctgcaacccagaagagggccttcaccagaacctggccatgctggctctctaatctcacacttcccagcctccagaatggtgagaagtaaattcctgttgtttataagccaccaggtctgtgggactttgttgtagcagtttgaactatgatatttattttatttattttttcattttttgcctttctttagattaatatttattaacaagcttctattagcttgtgagttattcattcttttattactccttcagtgtttacactagagattataatatcgttaatttattagtatctaccttaaatgaatacttttatatttttctggaaatgcgagtctgtttatataatactttaaatttatttatcctctctttttgtgctcttctggctatgtattttaattctacacacacacacacatacacactctctctctctctcttcaactccttaagacattattattattctttaacagtcagaattcatgtagatttacttatatgttgcactgtctagtgcctttccgttgtcctgcttgccatgctgtcatctgggatcattttgctgctgtctgaagaagtaccttaagatttattttatgatgggtttactgacaagatattctctcagtttttgtttaaaaacatctgtgtttctccttgtttgcgtatggaattggcagttgttggtgatccacccccgaccccacccccagcaattctggcttccattatttctctttggaaggtcagctgtaagtctcactgttttcctttaaaggtgatattttcattctatttatcctgcttgaggtttgtggagtatcttgaatctgaggcttggtatttttcattcattttggaaaattcttggccagtatttcttcaaacattgcttctgcctcattctctctctcccttctttttgggattccgatgatagatattttgctcctttttctcatgtctcttttacattcttttctgtattttcattccttttattttttctttgtacttaattcggagtatttcccactgacctttctaccagttcataaatctctttttgctttgtccagtcagctggtaagtccatctactgaattcttaaattttgagctgttttattttttagtaattggatttacatttggttctttttccagattcaaattctgttgtaacgttcttcctcttcatctattttcaaatatatttattattgtaataaataagcataatacatgtatcacatttacgtttgtttctctttccttttcttcctcttggttttcagatatttggtcttattttctggcaaaaatggtatttttaaatktattggacataatgtaagaaaagatatagaggttctagatgatgttatcttcttccacaaaacattaattttattctggtaggtaggtagcatmcaggcacatcattgtcatctcattgaggcttatttgtctccatattgcccttcctagtaggtataactcttctgaggtctcatgtgaatacctgcagttttttgtttttactagaacctgtcttttttttttttttttttttactagatcctgtcttgattgtgaaatctcaattcagtatattgcatgcaagcccatcacatcctatgatttggttgctcttcagcgacttcaaataatcttctacttaaactagtttttatagttattctcagygaaagtttagttcagtaccagcgtctctatcataacctggaactgaagtcccccatgagaaactaacttttggtggcacgtaacatcgtattgtgtgttctgttttaacttgttcttaagaaactttttaggttgaaataatgatagagtcacagaaagctgatactctccagtcatttttctcattggttatattttacataatatagtacaatattaaaagcagaaagttagcgttggtataaagcgtgtatatagttttatgctattttatcacccatagattcatgtaatgaccactgcaatcaagatacagaactgttccatcctcaaagagctcttgtgtgcgatcctttttttttttttttttttgagagggagtcttgcatcgtcgcccaggctggagtgcaatggcgtgatcttggctcacctcaacctccacctcccgggttcaagccattctcctgcctcagcctcctgagtagctgggattagaggcacccaccaccacgcctggctaattttttttggtatttttctttagtagagacagggtttcactatgttggctaggctggtctcgaactcctgacattgtgatccacccacgtcagtctcccaaagtgctgggattacaggcgtgagccaccgtgcctggcctgctatccttttatagtcacacacttcctccttagtgccaccatccctagcccacrggagccactgttttgttctccatctctgtaattttgtcattttgacaatgtaattgtattagtccgttcttgcactgctgtaaagaaatacctgagactgggtaatttgtaaagaaaagaggtttaattggctcatggttccacaggctatacaggaaacatgacagtttctggggaggtctcaggaaactttcaatcatggtggaaggtgaagggaagcaggcacgtcttacatggctggagcaggaggaagtgtggggaaggtgctgcacacttttaaacaaccagatttcaagagcactcgctcactatcaccagagtagcaccgagggggaaatccccacccatgctccagtcacccccaaccagaccccacctccaacattggggattacaatttgacatgagatttgggtgggggcacagatccaaccatatcagtaatataaattgaatgatgcaataggtgacctttgagattggcatttttcattcagcgaaatgctcttttcatgctatggacataccacattttgtttggccatttacaaaatgtcttgcaaaatgccttttctcatgtctctttacattcttttgtaagacatcttggtcgttttcagtttttggctattacaatgaaaatggctatgaataatcttatacaggcatttatgcagaaatcagttttgtttctttgggataaatgcccaggaatatgttttgttggttgtaagttatgtttggttggttgtaagctatgtttagtttttaaagaattgcagtattttccagggtggctgcagttttagattcccatcagcaatgtttgggagatccagtttctccacaccctcgtcagcatttggtattgtaactgtttttaaattttagctgttctgctaggtgtgtagtgatatctaatcattgtattaatttgcttttcccctaatggttagtaatgttaaacatctttcatgtgcttatttgccacccgtatctttctttttttttttttcttcgagaccgagtctcgctctgtcgcccaggctggggtgcagtggtgcaatctcggctcactgcaagctccacctcccgggttcatgccattctcctgcctcagcctcctgaatagctgggactgcaggcgcccaccaccacacccggctaattttttgtatttttagtagagacggggtttcaccgtgttaggatggtctcgatctcctgacctcgcaatccgcccgcctcggcctcccaaagtgctgggattacaggtgtgatccaccgcgcccggcatctgtgtcttttaaaagttgaatgtcttttcatgtcgtttgcctatcttctaaatggactttataaaaaatgctgaatttcgaaaattctttatcaattttagatatgggtcttttgtcagatatatggtttgcaaatgttttctcctggtttgtagctcatcattttctccctctcaacagtctttcaaaaaaacagaagtttttaattttgatgaagtaaaatttattggtatttttcttttatggattgtgctttttttgccccatgcctaagaactctttgccaagctcttggtcttgaatattttctcttatgttttcttctaaatgttttatagttttatgtttctcatcgatgatctaattttgagttaatttttgaataaggtatgagactcaggtagagattctatttttttcctgtctccaattattccagcagcatttgttgaaaagattaccattcctccattgaattgcttttgtacaaaattatttgttcatacttgtgcagggctatttctgtgttctgtattccgcttcattcgtctatgtgtctagctgtccaccaataccatacagtgttgattactgtagctatatatgtcaggtagcgtgttttctctcatttaattcctctttttcaaaattgttttaccatttcctttgtctttctatataaatgttaaaatattcttgtctatatctacaaaaaatttcaccggggtttcgataagaattgtagcaaaayttgtgtatcaatttgggttgaattggcatctttattattttgtcttccaatgcgtgaacactgtagcaggtgtttttgatttggcttactgtaacattgtggaagagttcttcctgactaaactcttttctgttaacatcctgcgctttaattattgcttcctatttcctttagctgagtttttaaacctgcagacatgtcaatttcacatcatttctctttgatggtagtgaacctccattgcattgtactatacacagtttgtggtataattaatcatgccctacacttaaatcactagcagattcaacattgcataccttgatttatccagaactttgattttttttttttttttttgctaagaactgtacctatttttagactctttcactttctcatcatgtcaatctcagaatagatagcactagtacttggctttctggggcccattttcctcaaagaaacaaaacgtttcgttgttttttaaaaaaacacttcttgaaaacaagtatatacagtatggtgattacaataaagtcacactgacatgcagagacgaggacattggtggggttatcaaaatacagccagattatcagtaaacaacatataaatgggatacctataaataggcaaaatttatgcctcagcaaaaatattagtttaatagctaatgaaatgttcttatgttcttggcgtggctcaagaacagttgacattgttatgttgcccatgtgctgttgaagcctttattctgataacattggtaaattgtcccttaccaacgtggccatttgtgtaaatacattctttacttcagtctgtggtttcacattttcactggtggatgaatattctcaattcttaggggcttttaaaaaacacttcccatgtgttaatttagtctcatctaccctgtattattcttctcattacatttgccctgacttttgcaaaaatgggttggttatgagaatttcctcaaaaaagtctttactgtgttatgattgaagcaaatatgtaaattaattctkcttcaccatcatttatttttactttgagctttaagtggttttgctgactccattttctggcttttggtgtataaaatgaacttccctttactgtttttagatctccccgtactgtggcctttaactgacatttttcttccaacctgctcctaggtaagccagttgagaaaaaaatacatgtaatggtaacattgcactggagcaaaaatcttcctgyatctcttaatatttggcataattgcagcaactctagtagaattccctttttcagaaaagaagttatcaatgtaagaaaagttcaatgatgggtggaggaaaatagctcattaggacattatgatctcttgaactgtgaattgtttaaaaatgatattaaattctgctcttcattggttgttctggaagagtgctggtgaatgaattttctagtccagaccctagaaaaatccatgcagcttatcccatttatatgttgtttactgataaactggctgtattttgtgataagagaaagtgggaaagattaatgggaaccactcagaggtttagcaatagaacttaaagagagcaattttcaaaaggtaattttgaaatatgtacttaatataggaacataaatggacttctttaggtatttaattttaatattatttatatctagtataagtaaatacatttcaaaacagggcacagcaagttggacatttatagcttatacagtgagtacagagaggacttttgtactggacttaattattaatgcctgtcatccagatgactgaaagtagttcatgaaaatcaggaatgtttatataacatttaacttaagagagaaatatttcccaaggaaaatgcttgatgattttttatcagttaatgctattgcctttcataattttttaaaaccttagtgaagtactgaattattaggagtgaggaatttccttcaatattctggaaaagtccatttttaaaaaatggtgtcaggcaagagtttaggcttcttaaattatgctttattttcaaagctactccagcttatttttattaggctatttctcaaggaatagattttattttattggttttcacgttaatactgtttttccctaacaattgcattttattagaaaatttttcctgaaaacttaatgtttgaaatgaaatgcacatagagtatggcatgatgtgactaaatattttcctttattctcttaaatttttaattgttttccattgctcattataaactggtccagttaagctactggaggctggtttgacatacctgttggtgttttaacttttttttttttttttttggagacacaatcttactgtgttgcccaggttggagtgcagtggcatgatcatggctcactgcagccttgacctcccaggctcaagtgatcctcccacctaggcctctcaaagtgctgggactacaggtgtgagccaccatgcctggactgtgtttaactttttacctttctattttttatgattttttcttgcaggctgacttgaagcaaaattggcagcaagatcctcctgcctcagcctcctgagcagctgggcctacaggtgcatgtccctgggcccagctaatttttaaataagtatatcaaaccatcctccaacagcttaattggaccagttttatgataggatgaataacagaaaacaattaaacatttaggagaataaaggtcttatactcctggtttcaagcatttcttctgcctcaacctcccaaagtgctggtgtcacaggatccttagggtgtttctttaccagctggaacctctgtggccagtggtgcctctgcttgggttttgcttgctcccactgggcttatttcgcccacatggcccggcaggctgtgcttggtttgcactaccgtcccagatcccacacctgccaagggcaagccaggtgcaggaggccagggttgtgtgagcaagtgagtgtggggtccagccactgtgtgtagccaggcatgctggctggggtggggtgggctgctccaggtgctggcacaggtgccagctccatgtgaggctgtggctggatcagacctactgcaagtggcttctgctgtgggcaccagtatctggacaaggagaatgcaatggtgccaaaagctcagagatgccaggaactgcagagccccaaggagggtgttacagcatgtcacagccctggctcagggagcccccaagggccactgctcttctctccttgttgcctgcaatgtggtgagtggggggcatgtttccagcctgtttgtgttacaactctttcggtcctgccaggtcccaagttctagtccagcgtctgggaagaatgaggtatgcagataactggtgggtgagttagtcggagaggagcttcattgagtaaaagaacaactctcatgagacctgaagtgggcagctcccttccgcaggcaggtcttcctgacgagtgtgcgagtccagctgagtccagggttttgatttttgtttttttttttgagacgaagtcttgctcttgtcccccaggctggagtgcaatggtgctatctcggctcactgcaacctctgcctcctggattcaagcgattctcctgcctcagcctcctgagtagctgggattacaggcacctgtcgccatgcccggctaatttttctatttttagtagagacaaggtttcactatgttggccaggctggtctcgaactcctgacctcaggtgatccacctgcctcagcctctcaaagtgctgggattacaggaatgagccaccctgcccggccgagtccagggtttttatgggctcagaggggaggaagtgcgtgctgatgggtccacggtcggccatggcaggcctggaaaaaacactataaactcttactctgtgttggggattccactgggaactggccccctggcccccaggcttcaggtcgtgcctggcttgaaggtgaggcttcaccagggacctaccccttcctgcctaggaacctgtttgccccctgtggcaatcaacattctgtccaagatgcccaggctgtgcacaccgaggggtgcctgccgagctgctctcagccccacccggctccagcctttctccctgagcttgaaactcccccaaagtttcagagggggatgaggcggtgggggtgctggtgtgttatcgctgccttgagcgtgggtatacagctggccaggtcgcgatagcgcccgggctcggcttctactttactctgaaattggagcaggcactggaggtggggaatggccagggagcaggcacttctgaccctgctgggggaagagggtgtcctgggcccccaagagcacatggatgcccaggtctggagccatatccaggtggctgcagctgtgcctgcagcatggggctcccgttctgacaactcagcagggcacgggggtcctgcttgttcctcgtgccctccggctccatggggcatgccgccccggttgtgcctcccccgctgcagctggcatccccacagtggctgctccagaggggccaccgccgccatcactgggattataggcatgaaccactgaacccggcctgtgcagcttttgagatcagttgcagtttagcaaactccactttccactgatcagggtcggcttccaggcattgagcggatgggcagaggagatgagagacagatgaagagaatactcccagcaaaggggcagagacaaggagacatgagctggtctggagagcaagggttcattagagattttttctttagtgcaccaaccagcaagggggaagtgaatgccaaaaggagctgtgggaggttttctagaatgtcagttataaagctacttgttgcacacataaaatggatttggaaactcgtatttaatcttaaaaaaaatcttttagtgtttgccagagcattttaatctgaaaatatttaaaaatactcgyctgtaatcccagcacttcaggaggccgaggcaggtggattacatgaagtcaggagttcgagaccagcttgggcaatattgcgaaaccccgactctactaaaagtacaaaaaattacccaggcgtggtggcagtcacctgtaatcccagctacttgggaggctgaggcaggagaatcgcttgaacctgggaggcaaaagttgcagcgagcagagatcatgccactacactccagcacgggygacagagcgagactccatctcaaaaaaaaaaamaaaaaacaaaaactcatctgttagtataactaatgctccaggaagctgccacatatttacctcaggacctatttctatcttcgccccaccgcacgctgaactagacacttaaggacctagtgtagaggactatgaagaggattgttataaggagttaaaggctaaacctgattgtcattttaaggaatttggattttatcctggagtctttagttgattgactatttgacaaacatctacggaatgcctggtttgtggtgggtgttgagaatacagataggggccctgctttggatgggcctctctctcgagcagacaaggaagatcgtgccaggtagttgaatccatatacaacgtggaccacacaggtagtgagagtcagcaaggccagaggcgaacctcataagacaaaggggaccacgtaggaagtcactgtcctgctctgcatttgaaataagcactgttcagagccccgctgtccagtatggcagccactggccatgtgtggctgttgaatacttgaaatttggcccctctgagttgagatgtgctgcaggggtaagatgcataccagatttcaaagacctatcatggcaaaaagaatataaaatatctcattaataatgcttcagggtgggcactgtggcttatgcctgtaatcccacactttgggaggctgaagtgggcggacacctgaggtcaggagttcgagaccagcttggccaacatggcaaaaccccgtcttcactaaaaataaaaaaaattagctgggtgttgtggcatgcacctgtagtcccagctactcaggaggctgaggcatgagaatcgcttaaacttgggaggcagaggctgcagtgagccaagctcataccactgtactccagcctgggcgacagagactccatcttaaaaaaaaaaaaaaaaaaagcttcagtagtgattgattacatgttgagataatattttggacatattagattatacaaaatatatggttaaaattaatttcaccttttccttttcgtcgtattttttttaaccatggctatgagaagatttaaaatttttttgtgtgggagccctaaatgatggctcatgtctgtaatcccagctactcagggggcagaggcagaagtattgcttgagcctaggagtttgaaaccagcctgagcaacatagtgagaccccatctctaaaaaaatgaaaataaattagctgggtgtggtggaacgtgcctgtatcccagctacttgggaggctgaggcaggaggaccatttgagcccaggagttcaaggctgcagtgagctacgattatgccactgcactctagcctgggtgacagagcaagatcaaggctaggtttcaaaaaatagattaaataaaattgtatatgtggataggctattgggcagcactgccataacctacgtactaactgtgagatggggaagaaaaggatgactccttgggaggaagatgcggcaatgggaggacactgatggatagaggctgctttacacctctgaggcctcaagcaggattcaccatgatgtcatctgcatccctccaaagtcacctgcttttgtcttattgcataacttgtttcaaatgttctgccacaacctcccccagcccagacatattcatgatgttcttttatgattagtcagtcaccacgggtagaatgtgtgttccagtgccacatcagggatgacttatgcaaacccaagatggccctttggcttagtccttcttcgcccagtgtaagagtctgtcttgtgcctggacactgaagactgggggagggcagtccatcagagatgattcaggcgatgttacgttggtgtgactggaactattgttatattattaaacggtagaggggccatcctgggcaagagttgatttgcaggttaggttgatgagtcaccgattttgaagctggtgtatgtctaggtagaaatactgaacatgcagctggattgtgcagccaggtctcggagagggatctgggctgattccacatgtttgggagctatattgatagagaaaaggctgtgggagtcaccccatgtttaggagggcagagacccaagcgctgaacccactctcattctcatgtaggttttatgcttggatatcactgcgtgaatttaaaatctgagcctctaagcaacattttggaaagcctgtttcatagttctgcttatgcaggattttctgcctttttttttggcccatgcatttttctctatgcttagagggggaaaaatatgagaagaaagtgtgttggaaagaaagtctgcgggaggagccaagatggccgaataggaacagctccggtctacagctcccagcgtgagcgacgcagaagacgggtgatttctgcatttccatctgaggtacccggttcatctcactagggagtgccagacagtgggcgcaggccagtgtgtgtgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaagaaacggcgcaccacgagactatatcccacacctggctcagagggtcctacgcccacggaatcgcgctgattgctagcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcacccctccagcaggggcacactgacacctcacayggcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaacacagagcgcctctcctcctccaaaggaacgcagttcctcaccagcaatggaacaaagctggatggagaatgactttgacgagctgagagaagaaggcttcagacgatcaaattactctgagctacgggaggacattcaaaccaaaggcaaagaagttgaaaactttgaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaggttgaaatgaaggaaaaaatgttaagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgttgagagattttgtcaccaccaggcctgtcctaaaagagctcctgaaggaagcgctaaacatggaaaggaacaaccggtaccagcctctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacatgcagagacacacataggctcaaaataaaaggatggaggaagatctactaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccagaaattgaactcagctctgcaccaagcggacctaatagacatctacagaaccatccaccccaaatcaacagaatatacatttttttcagcaccacaccacacctattccaaaattggccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggcaccattccttctgaaactattccaatcaatagaaaaagagggaatcctccctaagtcattttatgaggccagcatcattctgataccaaagctgggcagagacacaacccaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcagcttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctagcaatgcctttcttcacagaattggaaaaaactactttaaagttcacatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagtcatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacgtgaagaaatgctcatcatcactggccatcagagaaatgcaaatcaaaaccactatgagatatcatctcacaccagttagaacggcagtcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgagtataagtcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattcctcactcataggtgggaattgaacaatgagatcacatggacacaggaaggggaatatcacactctggggactgtggtggggtcgggggaggggggagggatagcattggaagatatacctaatgctagatgacacattagtgggtgcagcgcaccagcatggcacatgtatacatatgtaactaacctgcacaatgtgcacatgtaccctaaaacttagagtataattaaaaaaaaaaaaaaaaaaaaaaagaaagtcaacaaaggtctgagctacggactcgatgtacctacatttgctttggttcaggatccacaggtttgtgcccctcagtccccttgtatgggtacccatggcccacacttcagggagggccaggttctaaagggacaaccaagatccacaggaggaccctgtctttgtttatatatgtatatacatatataaatacaccccccacatatatatatatatacatgcatgtatacatatatatcataatttagacatttctcatgcatttatgttccagatatgtgttacatatatggcacacacacacatacgcacacactctctctctccctctctctgtctctctcaatattccatcccaatgacccatccagctggaaagatggttttattggcttttatcaggaacctcgcccttcccaggagacttacctcatttatatggataggaggcagccattccagcctaaagaaacaaaacctttactcatgaaaagtcttcagtttctcctgcggcatggccttcctgtcctagctgcatcctcaaactcttctttcttttaagggtgagctccaccaggcactacttggcgatgatccctgggaggcaggagacatcagcacctgtgcaaagggaaaggctaattactccaagataactgtgatttcttaatggggagaagaacttggtgggcaaagacctctttagagatgaaggtttctgtcctagtgacaccctgtgtcagcgaggtccccagggagaatctcagtttgctatgatctggtgctgataaacattaactgattaaactagtggctgacattattgatcatgtactgtgggacaggtcctattgtaagcagcgttcatgttatattaacttattgactcttcacaggatcatgtgaggtatgggaggttaagccacacagctcatcgttttgtgccagaacttaaaacctgtgtcagagcctaagcactaagcactaagcatgactctattctgctattaagacaaagtccttttgtaggaagccaatgatgatgagcaaagatggcggacatttttaatggtctggaaatgaagtattaaaattgctattgtcgatgcacctttgtattaatttgttggtgctgctttcatgcacctgataactgcctgttatcttgatggaattaaaacccctgtgttatattctttcaaataggaaaacatatatatatatatatatatatatatatatataaaatcggatataaaatcagagagtaaactgcctcttatagccgcccctcctgcagtcttctgtttccaagttctcagtaccataaggttaacccacgaagccttggctaagcagatgtgtgtgggctgagtgcttgttagtttctgtgagtttcttctatatgtaacaagtgttaaattggaccctgctagtgttaagattctttatttgagcaatttaatagggaaagttaggtgtgaatacacgttttcagtctcacctgcagtgtcaggtgatgttaattctttgatctccttgctattatatcgccttgctattcttataaaatactagagaaatcactaaagcctgattaatgtttagtttttgtggagcaaagacttggaaatttttaacaatttccccgacgatttactttctgtaagcccttgcacactttcttctttataaatgtttatagtgacttgttgcccgttcagaattatagcctggccctgcttctgggatgcagtatgggcccactgttgccacaagtcccctttcagaagttacagagagccatcagcagttacccttttcaacattcatttatttgaagactagggagtaggaggagaaaaccctctaagtgttctctggcagtttggtgcatgctttgaagtgagagagaaaattcctcacgaccatgtagaagtttcccgataaatttatgttcaagtggtggcatttgggcagccaacagccagatgaaaagcccgtggaatcccaggatctggtatgtgcttagtggttctcatgccatgccactctcaggcaagccaggtaaccctccctcagcacttctagcctttcactcggggatctcatgcagaatttaaaacaaaaaacatgggagggctaagctccttttttgataaattgcagaatgcctctttattccacagtcatctctcctctctgcttgtgttggtgtatgagcttgtttccagatggttcagtgggactgagaatgtgaactgatgaggcaagtatgtctgtgtctttctggggagagaaggagatagtgggctatttacaaacatctgcaggtcttcctttcagagacaacaaagcaaagtgccctttaactgtgctcctctatttctctgccccaaaatgctagacacagcagtggtttatttacccactgcttcttatattactggmcttaccactcactgaaatggcgctgaaagatgaccagggagctctcaaatgctttccctcagtattcatccccttaaacttccctggaggatgtgggacttttgtccacttaggcatgaaaatccagtgtgtatgttatgcccacggcacacctcagtgcagaccagccacatttcaggtgttctgtggacacacgtggcatatggctaccatattggacagtgtggctctgaagagtgattattttatgacccacctctgttctccctgggcctctcttggttctctcactgtccaagtgtgaatgcctccagagtttggtcctcggtcctccatcatctgcccccacattccattctcctctttgaagatctaattcacaaccacaacaggagctcaccgtggaaaggacattaccccagtgcctcatacccattttcacctggatgctcatggtatttcaaattcggcttatcccaaagcaaatccatctgtgtcaagctggcttctccactttcatccatgcatctttcattttcctgacttctaatgctcccgctaatgttataaagcagttaacaaggcaatcaggctacataagcagaaatctgtgaatactaagacccgcgagctgagggtattatggaaattgaatggcacttgtaagaaagccgaacatgtataatgacgtacataattcttataggcagcaaggtgactaggcatgtctagttattcatgaacattaaggttgttattgctttaattcacaagcagagcaagcgttttgggtaacagatggaaaggcgggggaggggtagtttgtggccctcagtcccctccctgatgccaggaggaattgaagctttgctttcatcatccctcctcccagctgcatttccttggtgccttcactgttcccagtgtcactggttagggaatagtcctttgcttttggccaggcatttcttgaatgtgctagtccctttttaattctctaaaaggagaattaaattaaaagctgacttgggtcccgacmtaatgtggagttaactgctaatttcaccctctgtgcccatgcaggaagcatgaaagtgcctgattgaagggcyggggccggccctcttgtatacataccctggtctcagagagcctggaataaccttgccgacagagctgtattcccccaaatgctgaataatgataggaaagcaccaaattcacatcggctttttattttcattatttcttattttaaaagtaggttatttcattgagttatctttccacaaaaactactcaagggtgtgattgccgtttatgttcattttgtagcatgagtcgtgaaatttgaagtgcaacagatattttagtttctctataggcttacgtagtagagtgcatccaattaatatcaatttaaaattgatctccagggatattagggtagtgtttacagtgacttatttcttttcctaatagaactattttataaaactttagtcatttcagctactgggatggaaccgtgacttatcaaaaggagtcaagtctttggagtcaaaaatatctgagtttcagttattggttctactattggaaaagttactcttgtcttttggagtcccttccctgttgcgtaaaataaaatctaccccatcagataaaattcttaacttgctccgcatgtgttaatttcctctctactgttcctggaagctggaggaggagaagggaagcaatgagaaagatcaggaggctgaagccacaagggtatacaacagctgtgattttagaagagtgtaattgggtgcacgtgtgtgtttaatctatttgattagattgctttcctaatatcaagaaccaagagcatttgaggtgaactgccccattacttgatctcagttggaggggcctggaatcctgggaacttgagggggagaagagagctattcagacagggataggaagatcagtgaggcacctgcttctgactttttttttgagaggaggtgtccctctgtcacccaggctggwtggagtacagtgttatgatcacagctcactgcaacctccgcctcccaggctcaagtgatcctcccacttcagcctcccaagaagctgggaccacaggcgtgtgccgctacgcctggctaattttttgtatttttggtggagatggggtttcaccatgttgcccaggctgatcttgaactcctgagctcaagcgacctgmctgccttggcctctcaaagtgctgggattataggcgtgrgccactgcacccagcctgcttctgacattttagcctaaggcatgctctgttaatgcctgcattagtttgcctgagctgtcataacaaagtaccacagactcattggcttaaacaacagacatttatttcctcataattctggaagctggaaattcaagatcaaggtgttggcagggctggtttcttctaaagcctctccccttgactcttagatggctgtcttttccctgtgtcctcacgtggtctttcctccatgtatctgtgtcctaatctcttcttcttctaagctcactagtcatattggatgagggctcaccctcatttcctcattttaactcagtcacctctttaaaggacctatctccaaatacagtcacattagagctttaacatacgaattttgtaggaggagggacacaattcagtccttaacccttcttgtctcagtggacaagatttttgaacttttctgtgtttcgggttcatccttcccttcttcccagtctgttacctttatcttactatggtgttatgatggggaggaaaggaagggtgctgacctcaacagggagccagcatattgcttaactaatccaagccagggcttgcatggaggatttttatttcccacaatatcatgggtaccctgtgcagggtggtgaggggtgctgggtgggaccatatcactttacttcgcgatgctggaagtgtttgggctttgggaggaaaggtcacaggcagcgttatggtttgagtatgtagagatattgggccttcactctccagctgcagtagaacgaggttggcaaacagcagtcaaacttatgcttttaaatgagatagagctgatactaatggacaagttggtgctatccccggaggaacatgaactgcctgtatttgagtatgtatatgtctgcagctctcrgattatagtgttatggcttgttgtgccagagagttcttctcttttcaggctgcatagaatattttcatggccactgaccttgagaaagcaattctcagcacgcgcaagtgaaaggcaggaggacccctttcacagtaaagctgggattccctgaaggagggactgcattcgggaaaacttccaaattgctgaatttcttttcttccctcattagttgctggtgcttccagatggcacctgaaccagcatctgggccaggagaatagcatcctagccagtcttcactcactgggcttggttttcgtgtgtgtttgtagcaactctgttacatttttttctgtttccaggttcaattccaggtttaggacatactgctcatttcactttcctctcctcctcctcctccttctttgttgctcacctggttacctaccatgatgaatcatctgattttatagcctaccaaaatcaggataaaaaatgtaaatgtttttgtttaaagggagatgcaaaatgtgagaagtataatgagtaatgattcactcttcaagtactatttgaggaggtagatttatttctaatgccagatgcaccaagacatgtttcttttctttgcagcccacagagatgtcaataagcagaaaatggcattcgtatatcttgttagaaaccaagtgcatggaagttgaatttatcagtggatctcaccacattctcgaatttgagatgttggcagaattggtgcccctcttggtgtctgggtggccagcctgggtttctcctcctacattcccccctccacagtggggcttggatgtgtttgtaaaatgagccttaataaaaatgtgagaaagtctccatttaattttgtgtgattttcatctcagaagttctcgcattatttggaatagagaaaacatcttagatcactttagatagatggtattcaacacaattagttctctgtgcatgctgggttaagtcattggtatttgtgccacccatttggcatttgctggcaccagctgagaactatgtcctgtacctttgaatttagaaatgaaatgctgactgcacttgccatttctgcctttggaaattaatgtaatattggatatatgtaatattggatactattggaaattaatgtacatggaagacatgatactccttgactgtacttttttttttccaatcccaagtggcttggggctagccagctgtaaaggcgtgtaaagcatgcatgtctggcatgtttgcatttgtggattggcaacccttggtacgtgtgccaaacgcagatggttagtgaggtcctggccatctccacrctcctgtgaccaccactcrtgaatctcaggagagataaagagagataggatgcaagggcttggctacytgtgcttttctttcctttttctactttccttgcaagactaaaccatatttacaagttccttcaacaaatgtgtaaatgtgtattggatgcctcctggaagttgtgtactggaatcaatgcttttcgcaatttattatctcaaactcctgtgccctatgagacaaaacaaaataaaaaacaaaagycaggggcattggtgttgtacgtttctttttctaagtttgctaatctatgatttatcattcttccatgtttttgagttcattacttggcttaggattaaaccagggattcagaaattgtgctgcattggttttatgttgtagaaaatattcgaggggtaatgttaagttttctacctacaaaatacattctttccagccttgtttttgtggtaggtaatcctttctcatagtacttagacagtttaggttaagttgtcatgtgaaggatacaagatatggctcataatatcttaccttcaaaagaggcaaggacagtattcagagacaacattttatttaatttcagttgtttccagtacttacaaagccaaaataaccctttcttgcctgagtttccactgtaacaggagaagccttttctattcccgaataacaaaccaaacccacatggktcccatagatctggacctctcattcttagattaaaaatagctccaaattcatggaaaggcaccctctggttttttgccctttgcacctgctgagtctcaccttttaaaaacctcagacctctcaggaaattccctkccaattacatccatttcatctgcctccaacttaacccattctcagtgtgggggtaactgtattacataacggagttcagattaatttttcttacayrtaaatgaagaaagctaatatctaggtaggcctgtttgagaataagcagagccttttcttcccattcctttaattgttagattttaaaatgcatttccaactaagatagtagtgtagaaaagaataaccatttctttccatatactgttttattccttttgactacatttattataggaaattattttttgttcagtctagtactagttcagatatgtccctaagaaatagtgagtcagtaagaggtaaccatctagccacatgattttaaagaaatcagacactgagagtgaaattaaactaaaatgtatcttgtcaagtttatatgtgacctcacatttattgccagcctcccttgagggatacagtgaaatccacactacttttagccaatagaattgtatgttatcttgttaagaaatatgaaaaggtaaatagtctaaactggtttagaaaaataagtcatgttccttttagctaatcccagtgtatcccacgtgatgctgaaatgcaaaatgcaagtggaaaacttcagttggtgggagtatatagtgaatttttaagtaatctctggtatttcagaagattattcttagatagtctgcagagatgagtttataaggctggtgtggtcggctgaataagggcctgtattagtccgttctcatgctgctatgaagaaatacccgagactgaataatttataagaaaagagatttaattgactcacagttccacatggctggggaagcctcaggaaacttacaatcatggcagaaggcacctcttcacagggcggcaggagagagaatgagtgctgagtgaaggcaggaagagtctctttcaaaactatcagatctcttgagaattcacttactgtcaccagaacagcatgggggaaaccgcccccatgattcaattacctcccactggatccctcccatgctatgtggggattatgggaactacaattcaaggtgagatttgggtggggacacagccaaaccatatcagggccctccatggatgtccatattctaatccccagaacctgtaaatatgttactttacatggcaaaagggactttgcagatgtcattaagttaaggatcttgagattatctcgtgcgggggcagtgtaatcatgagaggattacatgagggaggcagggggatcagagtcagaggagatgtgatgatggaagcagagatcagagacagttgaaggtgccacattgctggaaggccaggaaccaacagattttcccctagagtcactagaaggagtgcagccctgcagaaccattttactttagatgtctgacctccagaactataaaataaatttgcattgttttaagacattatgtttgcagtaatttgttacagcagcaacaggaaactaataaaggaaactaatataggaatataggaaactggcatatactttgggtgtccttggttataaatgactgaatgactgactgtcctccctgaccttcaggtgaagtgtagtctggcatttgatttttgaatgcaaaacaacttcagttgcagaaaattcacgagactcttttactgggccaagggtttcaagaggaaggctctgttttgagaagaaggttggcatgaaagttaaaggttcagtagctactatgtcacatgtacagttgacttgagaatattatcccatgtgcattacaaaatatagtaattttgtaataagttaaaccagttaaatgaaaattatgtacttgtgtttaatgtcatacatttatttttggaacgactttcacatgacatttgtgtagagtaagagcttggtttggtgaaggagtgttactattctggaggaagataacaatataggttgaattagatggttaactttgaaaatgtggcttgggacatggactgaatagaaaaaagcctgggatcaaacacccctgctaactactggggggttctgtgaacacccagaaacacaattggcagctcttacagcgtgaacttcaccatcaagcaggttgtttcaggattctgactgagggatggaaactttctcttgtaacctgtccagtgagcttagcatcccttaggaaatgacttaccctaaggagggtgccattcccaaatctctgttggtctggaattcaaactgtagaaacaccagggacttttctttcttttttttttggggggcggggggggatagggtcttgccccattgcccaggctggagtgcagtggcacgatcttggctcactgcaacctccgcctcctgggttcaagcaattctcctgcctcagcctcccgagtagctgggattacaggtgtgcggtgccacacctggctaatttttgtatttttagtagagacggggtttcgccatgttgcccaggctggtctcgaactcctgggctcaagtgatccccccgccttggcctccctaagtgctgggattacaggcgtgagccactgcacctgacccagggacggttctaagacctgttctttaaatcctaaacctgaactctgatttctccttcctctgagtcctatccttgccctttaaattccaggcctgtgctgcctaatgtggcagccaccagccagagcattcctagactgaaggtgccctggaagcagaaagcacagcttttgataccagggttcttggctgagaagatgggaatatgcagagaagagcagagagtcaacaggggatgggttaaaaatggagagatgttttgatagccatatgttcattatttcttttattttgtcctgtttcttcctagctctctctggtcttgatttgacatacggatacagctggaatgacaattacctaaatatactagagcacctttataatactgatttcagagggaaagcatgttgagagaaaagatctaccataaggatgcgttgtataatgggctgtagtctgcccacccttgggttaacaatgggttgatgttacctggtgtgccgtgtagagtggtgttaaggtcaaataaaggaatgtaaaagcaggctgaaatatccttaggtacgctccagatggccattttgatgccttatgagtccctcaaattaaagagtgtttgtttccttgaaggagaccctctgctatcttctcaggcttggtgtttgctcttatgtgactgtctgtgctattctgccatgtgaaatgtcccatttgaaaccatgttattttaaaatatatgtaaacattgtttatatatgtggtatactatacagatcacagatagtctttttttttttttttcctttttttttgagacagagtctcactgtctctctgttgcccaggctggagtgccgtggtgtgatttcggctcactgcaacctccgcctcctgggttcaagtgattctcctgcctcagcctcccgagtaactgggattacaggcatgtgccaccatgcccagctattttttgtatttttagttgagatgggagtttcactatgttggccaggctggtcttgaactcttgacctctagtgatccacctgcctcatcctcccaaagcgctggggttataggcgtgagccaccgtgtctggccaaagatagtcttattattatttcaaaatctaattcaacttgcttccttcacagcatttcttggataaatcccacatagcagaattgccttctccctccacatgcagaacctcactttgctgaggccggagcagcagtgtgtgggcgtatatgggtgctctgtgacagtgctgtcccgtagaactcccggtgaagatgggcatgccttatgtctgtgccatccagtaccactagccacatgtggttattaaattcttaaagtgtgacgcgtttcaccaaggaactggattttacattttatctaattttaattaacccaaatttaaatacccacaggaggcttgcagccaccttattggacagcagtgattccataagatcatccaagtagagggaataacaagccgagaacctgatgggaggctccctgaaggacatgttgtagtgacattggctgggacacgacctcaggagcccatagtgatggtgggctaggggaggagctgagaagaaactgagactttcaggaaaacttgagaatagaaatagagggcagatgatttattcatgacatggagctgcccgggcagtcacctgggaaagagatgtcaaatatgggagatcaaggacagcacagaggaacagtgacaggagcaggagccccagggggcttctgcaagagagtccaggctgaccctggcctgggctcaggtgactggaagagagcagtttcatccctgaggacttagacctttgtttctctaggaccacaggctctggatgaagtgatcagccctggatggaggtggaaggagaaataagcattgagcggagggagttaggaaaaactcaaggacccttagaaattggatcttaatgagcagctagagtattggcaggcgtgggatcccagaggccagagagattaatcgattcttttgcttagtgaagttaacagtgatgcttttcctgtaattgagataatctgtgtgcggcctgtgtttcctggggttcttctcacgctgctgtgaattaggccaccttgaacagctgactgaacgtggcaaaccagagtggtgcagcgcaggctgtgggcagagagtcgaggggaagcaggagtcctgggtatttggacgatggatgcctgaaccctaggcagtggcgacaggaagagagaaggcaggcagctgggagagcaggcccggagcctctgtttggaagggccagtggggcaggygagctggcctgactcccttcttcgagtcctccatttcgacctctgtgcctttgcacagatacatctggctttacagatagaggtgttcctggaaaaggaagtcaaatgaaacaggaaaatctatgttcagcttacatgcacttaaggggaagctcgctatatgtaggaagcctgtggttattgctaataattgccaccaatttattggttctatgggggctcagttgtaccgtagttacactttaacttcctctttctgtaggatctgtaaatgctcttaggcgtttttaaaagtgtgtatcactcacccactaggtaatgaaatccttataagcaaaaaccatagtatcgtttctgtttttttgggacgggcagggaggatactgtttctccawscaatctttgaatgcsaacatgcttaataaatattgatggacagaagtgacttaatttttatcaaactcttcacagttttatgaatgcatcatttgttttgtctttataaatattattattattttttgagacggagtctcgctctgtcgcccaggctggagtacagtggtgcgatctcggcccactgcaaactccgcctcactgcaagctccacctcctgggttcacgccattctcctgccttagccttccgagtagctgggactacaggcgcccacmaccatgcccagccaattttttgtattttcggtagagacggggtttcaccgtgttagmcaggatggtctcaatctcctgacctcgtgatcctcctgccttggcctcccaaagtgctgggattacaggtgwgagccaccgcacccggccttgtcttcctaaatattattaacaaacaacccaagccttcatatatcaattgcttcctggatgccttgccctgtgctaaacatagtgtgtgatttatgtcatgtaaacctccagcaactttatagatgggactgaactttatagatgtgacttctgaggctcagagaggttaagtaatgtcttcaggttatcgttgcaaattaaaatgttgaaaataagaccatacatatggtgagccttttctcccttcagtattttttcctaaaagtgttagagacaacaaagggcagagggcatgtcaaaggtatctaagacaaactttctttattgaatcaactttgtcttggcttcaactgtgaaacttggatgatgtaatctagggttgggtaccgtwcatttctagtctctgggtcttccactgaacactgctgtaccacacgcttcaatggtagagggtttcatggcagggccgtgcagcactgttgtgacatagacaatctggaagttacagaacaaccaccctcccacgtatttacaaaaagtgtaacatttcactgggatcgtgtctgaaagcactctgtagctgaaaagtgctatacaaagccaaagggttatttatcataattttagctgacagcagcactgccgacatctctttctcactcaagggaagtacccacaaggcaagctacagagcatccccctagcctggtgactggagatcaaggagctaaccttcagtgttccgtctgtgaggaacacttgccatctgtgaggttttgggagatgctgacaaccatccatttccacagagtggtcccagctggggagattatatgcaaaggagacctctcagaaagcaaggtggcatgtagtgggcatgtgataagctactcactgcatggctcaacatggctcaggcaacaactcaggcaagaggattctgcagaaagagagatggatgtcatcagaataggcggggaagtggacttgtggttgaccttgaagtctgggcattccaggctggagggacagcctgggccctgagaaaaccagcttccactggagccattctactagaatagttttcatttctcatgcagaggtctggtcttcaaataaatgattctgaaaaattggacttagagactatcacgggaaaatgatgaaggtcatagcctctgggatcctgaaaattgtttgggacttttatagactttcacagtcctggatttctgggtgggaggaataaaaaccggattggacagtgtcgtccttcaacagaagaggcctgacgttaagcaatgccctatttcaaatactttccactgcagaaagagtgctgtccaattgccagtctgggaaatctcttcctgggcttgttttgttttgggattaaatcacatggaactcttttcttcagctcatgttgtcatacttgagacactgctatttcttcccttttatttctaaattgtgaaccttctccttttgtttcaacctagaaatgtacacttctcgttaattgttcttatgagaatggtttctttacagcaataggtggcggataacaagactggaaactttgagtacacaggaccacactggtttcagttctaattttcctaagtggctttgctgagggaggcaatatacattggtatatattggtatatatttggcaagggaatatacgttggtatcttatttttctaaccatagtaatggtatctggaattgttgttggcttttaggctaagccattcattatttttaaccttcagaaaaaaatttgaagatacttaattataaaataaaggctgctcagattttaccacttggacaagagatgaaagttccagaagagtacaaactgagctgctctggcatgttcggaacctgttttctatgacatagttggtagagagcaacatctcatgccccctataaatctgtgtgggtgtgtccaggagagcttgcctcctaaattgtattgaattagaaatcctgcaccttgaagcaattggaattggtctgtcctgcaggtcttctgttggagtagagtcccaagagaaagctgtgcagtcgcccatgtgattttagtctattttagtcttgcctgttttttcaaaaccttactgaaattggggttgactaatggcctccttaaaattggatttattttagcttgaatatgtattttctcttctttttcaacttctagatggcatatattccaatgaatatgattcaaatattccaatgcagtacaggatccaaactatgtccctttggtagagaaataaatagagagtggaattctttagagctgccagattgaccttttccatcaaccactaaactgtctgaaaaatggtacaaatggtacaaagatttaagaccttgagttaaaagggggaagaaactgagctatatgagttaaaagatccaggagactctctcctgtttggttgctcattcttgtgtattaatttttaataaggaagtgaaccccagatgacagaactgattttcttttattgggtgacggttgagatctcctattgcttaaatcaggttaaataagagagaatgctgctctgtaagtctggcctctgggtctctggtatatttacaaagatttaaacgtaatacctattcctgtttctcaggcatcctcatgacaccatcttccagtataggagaccaaaatggataagatgaaagcaaaacatcttgtgtaatgcaatcaaagcaactttaattttttggtttctggcaaggaggatatgggcttaagtaaaatactccattgcaccgtttctggggatttatgtttttaaaccaagtataataatattccatgtacatccactaccagtgatattagctattcccagtccgtgtcacccccagggatggagtgggctggagacctggggagggagaaatcaagcctcatatgctgtgatgtcttgacaagtgagtgcccccaatcctgttggcatttgtgctgcaggagtttggttgatcagatttgtattttagataaatatattaggtcacagtttgaatttcaaattgcatgtcctttgccatttttctttattaaaatgtatgcattaaaattgttatgcatgaagacaaatatcaagattgactgatgttttcctccctattaatttcccgtaggaatggtaaaaatgcaattattcatctatgaaaatggtgtttaagaccttgaaaatgaagagaatttggaaagccacttgtgccataaaatttctgaacacagaaacgggccagtgattcagtcgatattgattgattggttgattgattttaatttcttctccagctttattgaggtataattgacaattaaaaattgcatatactcaaaatgtacatatgatgttttgatttcattgtgaaatctttactataatcaagccagctaatatatccatcacctcacatagttgccattgtgtgtgtgtgtgtgtgtgtgtgtgtgtgtgtgtgtgtgtggtgagacactcaagatgtactgtcttagcaaatttcaagggtacaatccagtattattaacatgctgtccattattcacaaaaggcaagatgaagaaacaatctaagtgcctaaggctggatgaatggataaagaaaatgtggtatatatacacagtggaataatattcagccttaaaaagaaggaaatctgtcatttgtgacaatgtgggtaaacatggtggacatgatgctaagtggaatgagtcacacacagaaagacaaatactgcatgatctcacttacatgtggaatctaaaaaagtcaaactcatagaagcagagaatggtgttttccaggaacgtggtggaaagggaaatgaagaggtgtggtcacaaggatacaaagtttcagttgtgcaggatgaataaattctggagatgattcaatcctgactgaaagagaagtccatgtgatttagaacagactgtgcaaaatattcagcgaggagctgagacggtctcttcccctggcatgtctcagctatccttgcctctgaatcgcatatgatgtgcacaagtacaatgaggagggctcagacaaccactgcgcttctcacctgcggggacaacaagccaccttctcccgataaatgaatgggcttttaaagatcatctttcagcagtgagaaggtagtgtgaacggaaaaaaaaacccaggaaattcaatatcagcatacatataacatttaagttaattcagcccagctgstcagcagaggttgctgttctcggtgtgttccaagaccacagatggcaagccagtcttgatggctttttaaaaaaaatatttgagacagggtcttgttctgtgactcaggctggagtgtggtggcgtgatcatggctcactgcagtctcaacctcccgggctcaagcaatcctcttacctcagcctcccaagtagctgggaccataagtgcacaccaccatgcctggctaatttttaaatttttcgtagagatgaggtcttgctatgttgtctaggttggtcctgaactcctgggcccaagcgatcctcccaccttggcctcccgaagtgctgggtttacagatgtgagccactgtacccagcctctcaatagcctctttgacagctctttgmcattggttgcaagatgaatccaaggggagggcataatgtacaaggaaaaatgataaattaaaaatcctacactgtactaggagattgttccataccacatgccgcatggcagatcaatagaaccttcttttgctatgaaaaactayattttgaaacaaaagttttagtgtttatttggggcagtggaaaaagaaggaagaggtgagtattgagtgctaggcactaatcaagtacttactcatttaatctttccccaaatattatgaggtaggcactattttttttcaccaatttacaaatgtggaaactgaggcagagaggagttttgtaaatttccccaggttaagctgcagttggaagctgaactgggatatgaacccagcggaggggctctgcagccgtgccttccagctgcacagtatcctcggtgctgcctcagctcctggggctaaggtaaaggctccctcctgccttccaggaccctcctgcctgcccttgttaacttaggttagaaatgggttagcttctatttttcttaggtctctattgggacaagcttggagcttttaaaggaaggcttactaaagaataagtgggggaagtggtaggaaatgagaaaaaaataaaatgaaaaagcaaagaaatagatgaggtgaaagagcatgcatttccttccgtcacctacacattatttactaagtccctcctgcacatggctgggccttcaaggagttcctgatctgggatgggtggactcaatctcgcttctcgattctctcttctctcttcttcttcctcttcctcttcttctttttttttctttcctctctctctctctctctctcagagtctcactctttcacccaagctggagtgcagtggtgtgatctcggctcaatgcaacctccacttcccagattcaagtgattctcctgtctcagcttcctgagcagctaggattacaggcgcccaccaccacacccggctatttctgtatttttagcagagatggggtttcaccatgttgtccaggctggtctctaattcctgaccccaagtcatccacctgcctcagcctcccaaacttctgggatcacaggcatgagccaccgtgcctggccctgatctgggatttaaaggggcagttgctgagcaaatagaagccagggcaagaaaggatttatgtgcttgggattcttgaggggttttccagagtcagtccccaattctgatgtttttatacgcaacactaggggtccttctgaagttatcccggcccctgggaaactcacgtggcatggggcccccttctgccctggtctctttcatcccatctgtcccggccccagagcctgtccagtctggtcctctctgtcctgcttggtttgtcaccatgtgatgttgggatggcttgtctttgccgcctcacttcctaagctgacagacgtgtctgctagggaccaccagctcccaagccgcatgacggtgctttccttcaaggttcagaggcttccctttcagtctggcccatctcccacatcctaatggctctgctgtctcaggggcagctctcctttttaacttattggcagagctgggatgacttataggtccctggctcagtgagtaagcaagttcagagacttggctttggccattttgttctcttaggctcatccttggatgccaacagggaaattacctgccagatttcagtcactactttttagaagttaaaaaaaaaaaaaaaaaaaaaaaaacctcacaaacaagatgtttcttttttgtgcaggcacaatatgtagtctctccactattaaggggagcaatctccttagcgcagtggtagatttttttttaacattcttcatctgtatttatttctatttttcattctataagttagtcaattaaataatatttattgagcagttactaggttctatagatgatcaaaagcaaacacacacacactctcgatcttacaagagcaagagctctttttcgtacatataatttctcaatcttgtttaaagtacacacgcacataagaagctaattaatagtacaaggcagaatcagttaaatgccacatgggtggcagacagttttataaacaccacccaaacctttatttgtacaaaagcaaaagcaagcaacctcatcgttaggagaggagttactgccccataacccaggaaagtcttaaaaagaaattataccaagtgtacttttcatctctatttctgtttttcactttttcagtcaatcagccacttactatttattaagtatttcttccatctaagcaaggtgggggagggagagaaagagattattcctacgtttatgattccaatcttgtttaaagtgtattcgtaaaacgtgagttaataatgtggcatcaaatgagtgccttgtgggcctcttgatggtgagtgttataggaatgtagaggtcaaaggaattgctgtggactgtggtgtgtgtgaaagcttcatggtagacttttgacttcaaggtcaaagacattgctgtggactttggtggtgtgtgaaggcttcgtggtagactggggctgagatgagcccctaggaaggaccaggatttagacgggagcttgaggaacaggacagacaggtggggggagtgctccaagggagcaagggatagagagggagtagatcagtctgcctggagttgaggctttgtttacaggcgaggtgctggtgagggtggtggagaggcatccaggaaggttgaaaatatatttctgtagccacctgccatcctgcatgcaggcacacacacatacacagcagccgtcctcttgttgaatgcctcttctcactaaatacagatacatccatgaggcttacacttactgctcatttagtaaagtagtaaagtcacagtgggagcccgggaatcaggaaataaacactcagatgttttccttctagttttgatcagctgccctgagagaatgagattttaaaataatttgacaggccggcatggtggctaacgcctgtaatcccagcacttcgggaggctgaggagtgtgratcacttgaggtcaggagttcgagaccagcctggccaacattgtgaaaccccttctctactaaaaatacaaaaattagctgggcatggtggtgtgcacttgtaatcccgctactcgggaggctgaggcaggagaatcgcttgaacctgggaggtggaggttgcagtgagccaagatggcacccctgcactccagcctgggcaacagagcaagactccatctaaaaaaataataataatttgatagagaaaatttttgttttattataaaatacacgtataaaacttatcaaaaccatttaaaacgatacagttcagtcgtgttaagtataygcacaccgttgtgcaacaaatctccgaacagtttcatcttatgaaacggaaactccacgaaaaacaaccaagaacagttttatttgaacccaagggtactttctgggatggaaaagctgggagctcaatcttggatattatagtactgtggagctgggattatggatgtctgaggccagtaggagctctgaggccatccaagatagatgtgtccattggaaattgggcttagagttagaaactgctaagtggacattattttaaaatttattttggatattcagcttccgaacactgtcctacgtttgggaacctcactgttgcgtgagtcatggcatcacctacaacggaagctgaaaaggtcagtacctgctttctccatatcctgctgcccagggcatgcaacttgaccttagcacaaccaatcctcctgtagcctggtactttgaacctgaagtaagcaacgtgaagaacaggggacaggttagggctacctcaggtgttggtgctgaattatcgtaactgcttctgtgtgtgtctgggccgtgggccttctgaccaccaccttcctttggtttctgcccattttccaggctacattgtccagtgtccctgtttttttgagacagaatttcactcttgttgcccaggctggagtgcaatgccatgatctcggctcactgcaacatccacctgccagattcaagtgattctcctgcctcagcctcccgagtagctgggattacagrcgtgtgccaccacatctggctaattttagtatttttagtagagacagggttttaccatgttggccaggctggtctcgaactcctgacttcaggtggtccacccgcctcggcctcccaaagtgttgggattacaggcgtgagccaccgcggccagcccctgtcaattctttgaacacctgttagctagcattccaacttggttggtttctgtcatttgcaaccgagaattctgtctcttttgtctggttgtctctctgtggtcaccatgcctttatcagtctgtgtcatcccgggctgaagttcctcacgtgatatttagttgcttgtggccaaaacccgccttcactgcaaatgcatcggttcctcatcatttctcctctggaccagcaaggggctttcctctcgcccatccatctcccaccttttcgttttgtaggtagaacctggagggagcggcagtaattcatcatccatggaacgtgcctgtctgtggcctggacctgtgggatttggccggcgttccctttgcattacatttggtacttggaagcaagcatccctcagtagggacaaggctccagctgtccctttcattagggccctgccaaggacgtttcctttgttcagcacctcctcctgcctgcccttaggaccatcttccaaaaaactctgctctgccctcacccgctgctgtcccctcccacctgtaagaccaggccagctcagcacctttccctgtctccttgtctagcactgctgcttctgtgtgatgctccggcatggtgagttgaccaacaccatcgcttaaatgtgctgtgccttttacaattatgtggctttgcaggtgctgttcccttgcctttttttctttgcccggcaaattctactggtttgtcagtcacttctcctttctgatagcctttgtgactctcccagctgttactgggtcctggtcaccctctagggccttgtgtaaacctttctttcaggttttacccagggcactgtacttacttgtatatgtacttctctccccgcctagacccccatctccctacggataggaaaggagtctcctcctcatctttgtaccgagtttgcaagcacagtgcctgtgcgtggcaggccctctgtacctgttgactatcgtgcagtggagattcaagctggctgatctgtgcctggtgcttaatggctgtgatgagtttgccacattcccttctccctcgaggtcttctcaacggtctgatggtaatgctgggaatttcaggctttctggcagactgtcagggagaaatttcagtgcagaaaggccttctagaacctcacgaataaggggtgctgctcacatcttgtgagtcctcccccttcctgacatgagtctcagtgccggcaaacacggctggttgaaccctgagctagcccagctgctttgttcaccttacgtttggggaaggctgaaattttattgagcaccgactgtattccacacactcttctaggtgcccgaaatatgctgttaaacaaatactcagccctcatggggctgagagtctggtggggaagacctgttgaaaaacaatcatattaaatgaattgcattgcatgttagaagatcgtaagtactctgggggaaaatgagagtagaacaggataagggggtgatggagggaatgagtggtgattttaaatgtagttatcaggctgggcacratggcttacacctgtaatcccagcattttggaaggccaagacgggcaggtcacttgaagtcaggagtttgagaccagcctggccaacatggtgaaaacctgtctctactaaaaatacaaaaattagctgggcacagtggctcatgcctgtaatcccagcacttcgggaggctgagacggacagatcacttgaggtcaggagatcgagaccagcctggtcaacatggtaaaacactgtccctactaaaaatacagaaattagccagcaatacaaaaattggcagctgtagtcccaactacttgggaggctgaagcacaagaatcgcttgaacccaggaggtgggaggttgcagtgagctgagattgcgccactgcactccagcctgggcgacaaagcgagactctgtctcaaaaaaaaaaaaaaaaaaaaaaatccaaacaaaaaacatagttatcagagtgggtctctttgagatagtagcagttgagcagcttgaagatagcaggggagttagttcatgggcttccaggcagagggagcagccagtgccagcaccaacgtgggagtgtgcctggagactctaaggaacagagtgtgcagcaggactggggcacagtggtggggaggccagaggggctgcgggtgtgggccgggcaggtggaggaggccttgagggctgttgagaggactgggctcttgctattacttttagccatatgggagtcattgcaatcctttgagctgaggggtagctcgttctgattttcattctgaaaagacccgtctggccactgtgttgagaatagatgttcctggtaaacaggggtgggcagggagaacagctcccctgcaccagctcccgctgggctgcagacaggctctgatgtggcttgcagcacggtggcagcagggggaggtggcaccgagcagcaggaccctggatatttttttggacatagagccaggaggatttcctcatggttctgatgagggttgagagagagaaggggagtccggatcatcccaaggtttctggcagacagatgatgtttcaccagctaagatggagcggtcctggaaagagtgaagatcaagartttcattctggaaatgtgggggttttcgctgtctgtcagagagtcgtggagctgctgggaggtggttagtgtggacttctggagagagggctgaaactgtccttgaaaaaatggatttctcagtgtgatgtgtatacagtgtccctttttcagacatggcaccttcgtccatttgggctgctataacaaaatgccatggactgggaggcttagaaaccacagaaattattcctcacagttctggatgctgggaagcccaagatcagagtgccagcaatttggtgtctggtgaaggctcgcttcctggttcataggcggctgtcttcttgctgtgttgtcacgtgtagaagggacaaaggagctctctgaagtccctttgtaaagggcagtaatcacctcccaaggccccgcctcctaatgccattacatttggggttaagattttaacatatgattttggggggactgagggacataaacatttagtctgtaacacaaagggaggttaatttggattaagaaatctaaggccatatgggggaaataaaaggctggagggctaaagaaggatgaaccaataaaagtcttataagcattattatgtttactaaaataaaatagaccaacacattaaacaatgacatcaaaacatcaatggacaacatatactttatatatcttaacttagaagttatagatgctgtactatgagccccacttaggagttcttgcttaatagaaaacattgtaggttctgggaggccgaggcgggcggatcacgaggtcaggagatcgagaccatcctggctaacacggtgaaaccccgtctctactaaaaatacaaaaaattagctggacgtggtggcgggcgcctgtagtcccagctactcaggaggctgaggcaggagaatggcgtgaacccagaggtggagtttgcagtgagccgagatcacgccactgcactccagcctgggagacagagtgagactccatctcaaaaaaaaaaaaaaaaaaaaaaaaaaaaaaggaaacattgtaggttctcacttctctgcagctttagttttaccaagttgcttttacatttaccttgctctattataggtaatagatgtgaagcttccgattcctggctcagagttggtgacttccatctcccgtggaagaygcctctgagtccactcaggatcttgtgtggtcacaaaggtgtaggaaacgtctggacacttgaggtggaagatgctttggggcattcccttccagattcacggtgtcctgcagccttagttctttccagaagcacgtcacacgtgtggcatccacctcccctgcacaggctgggctcctccctccttccctggggttcccctgggcttcacatgccctcatcttcctttatttttcttgaggcattgttgaaaagcctctactcctttgtggggctgttttacctcctggtaaaaaggttccggtcctgagctcacggtttctctcatgtcccctgtgggagtaattagagctaaccttcctggtggtgctggaaacctctgtggaagctggttcatgtatgcctcaactttgcataacagggaacatgatcctagaatattctttagggtagcatttcccaaattttccagggaataagaatctcctgggctccttgcctaagcatcaagcactgatttagacttagcgacccagaacctccaggagaggggcctgggaatctgggttgtgaggctacacctgttggagggatcggaggggcccagtatatgatactcccctttcctgcccagcttctgaatgaattgagacgaaaacaatgactaggacaaatgagaggtcaaaatgtcctcatagaggcttggctggaggatgctgcgttaagtcagctagcccagtaggcctgctarttgaattcctggaatgaggctgatgtaccgcagaggcctccctgggagcagggccgctggagcagcaacagaaccttgcagcctgcagaagctcacaaccaaaacagagaacagggctgagctgygctgagcagagctctgggattctcttaaatctatcagtcgaaattatttctcctgaggcacataggaagtagagagggctgagagaggccgggagtgtgtaggggcgtggaggctgcagggtggaggagagtccctcctcctggcaatcaggaatgggaaaaagcatctcytttacacaccccaggtgatttgcatgatcaggaaagtctgggaagtgggtcttaggaagcctgcaatgttgtctcttgtctgtgctttccaccagcgttccagttttgcacttktggtatttctgagcaagctcagcttctgtgttttggggtactggctcctaagagcagctgggtgtgtgattagacaaggaactgcttcactagtttattttcattgtgagcacacttcaatatcactctttacatgaacatgagcaaatgggtttaattttgaagtcagggcttgggattcttgcctttgtgtctatgtatatgtgtgttcaacagaataaccagtgtgaaacctaacctagccgaacataaccggaataaccagggtaaaacctaaccatctgtgtatatattcacaaatacatacataaatgtgtatatataaaatacatatatacatatacatatgtaaaatacatatatgtatatataaaatatatgtattttattttgaaataattacagtcataggttgcaaagaaaaatgtacagggaagtcccatgaatgcttccagtttatattttttgaaattgagaaatataatcttagaagatggtaaagctggttttttttttaagttggcaaagaatatgcagttaaattcaggcatggagagaaaattgctttgaaaggaagattttttgcattgacttttgtgtgtgacattagctgtctattttggaaaatctaagagcaatatctgattatctatgctttccgtccctaaaaccaccaacacatagaggctactgaatctcccgaagggcctcggtgatgggcctgggcaggaggaggcccctgcagcctgtgggtggtgcatgggcagcatctcctctctgcagtgtcctgcagcagcagtgcaatgtgattgatttcagaaatttaaaaaatatttgctgrcactgcactccagcctgggcgacagagcgagactccgtctcaaaaaaaaaaaaataataataatttcctgggataggtaggggaaacggaaatttacatgattgccaacctgactactgatattttccaaggaagattacctctgtgagggcctttttgctttaaatgtcaccttcatggtgttcagcaatgttcactgagcgtatgacctggctttgtgcaccgagaaaactgcccaaaataacaggtgccacagcttggtcacaagacagrcacagggccagtaaggtgctgtcagttgtgccccctatgctaagctgtgaaattctaatcccccggccccactttctaaccgtggaaatgttgggttgtgccatatcctggtatgaattttctttgtggaatgataggcccatagagttaagttttctctactgctgacttttactcacttaatttttactcaagttcttaaacttgagtgtgcatctgaatcccctggaaagcttgttaaaacgcagattgctgggctctggccccagagtttctgattaggtgggtctgaggtggggcctgaaaatgggcatttttttttctttttttaaaagttttagggtacatgtgcacaatgtgcaggttagttacatatgtatacatgtgtcatgctggtgtgctgcacccattaactcgtcatttagcattaggtatatctcctaatgctatccctcccccctccccccatcccacaacagtccccgaagtgtgatgttccccttcctgtgtccatgtgttctcattgttcaattcccacctatgagtgagaacatgcggtgtatggttttttgtcctttcgatagtttgctgagaatgatggtttccagtttcatccacgtccctaagttcccaagggatgctgatgcctctggtttggagtctgcactttgagaactctcgctctaggcaaagctggcaaatttgtctcaggtaggggcacacctgctatcttccaggtaggcactgttcctctactcttctgcgtcatctcagcttcatttctccctcggggtaccaatgctctgaaacctcctgctgtggactgaaacattctctttggttaattcaaactgaaatattctatttggcatcaactaacatttgcatatttctgggggaccagccactttgctgcaaggtgcttgtatttgttatttaatctctaccacaaccctgcgaggtcaattgtgaagtccccctttaatgagactcaagaattcaatgacattttcaaggtcaagcacgatgccaggtctcaggcttggagcctctggtactgggccactggtcttccttctctctagcttcaacatccttctgaagagcaattgggtcctttgtgaggatgcttcgaggttggaccaagtaaatgaatatctgtttggtaacattgttgacactgctgtatcgagctgctctaagaaagggaaacatttttggttcagaggacattcacagcactgtgcttgttggagtatttgtaccattgcctcttccaacagttacattttgctcttctttccctcaagagtagaagagggtggagaagaggaaatgattataattcattcctttcccctccctgccaatttctcacaatacccttattgggaggccaaggcaggtggatcacttgaggtcaggagttcaagaccagcctggccaacatggcgaaaccctgtctctaccaaaaatacaaaaattagccgggcgcggtggcaggtgcctgttgtcccagctactcaggagactgtgggaggagaatcgcttgaacctgggaggcggaggttgcagtgagctgaggtcgtgccgctgcactctagcctgggtgacagaatgagactccgtctctttaaaaaaaaaaaaaaaaaaaaaggcacatttgaagttctgagtgtgaagtgtgcttcaggatagtaaatggaaatggcaaaagaaaatatccagtggaaatctttgccatctttgggattctctttagtttttgctcatttttgcctatcctgcaagggtaacagaaagctctgagatttggaggtcagacaaacctgtctggctcctgccctgattctgctccttgagggttctagtgcagggaggacctctggcaagttggaggattgtacctctctgagctagagaactggcagaaggacaaaatgtaatttactccactgtaagcccttggaaagcaggtaccttgtctgtttggcaccccagtggcagcccatgcccagcagctgtcattggttgggggtgggtggtgggtgagtgcaccctagtgggtagttggaggattaaatgagatagtatgcaaatagaggagagtaggtaagttccccctccatcactggatrtttttgctacttcccctactcttttgtttgtttgtttgagatggagttttgcttttgttgtccaggctaggtgcaacggtgcaatctcaacacactgtgacctccgcttcccgggttcaagcgattctcctgcctcagcctcctgagtagctgggattacaagcgtccaccaccacgcctggctaattttttgtattttagtagagatggggtttcaccatgttggtcaggctggtctcgaactcctgacctcaggtgatcygcccgcctcggcctcccagagtgctgggattacaggcgtgagccaccgtgcccggccccctcctctctttttatctctctgctctttagttagctggcctcatgattcccatttttattttgtttaccttttctgttaaagaaatttttgcccaggctaccctttaggcagggaggagaacttccccctacctcttctttctaagctacaacatcaaaaaaaaaaaaaaaaaaattagctaatggctctccccttccaggcaaatttctaggattaaacgacttgatgcttttttgctctgatccaggcccacctttccagcccacatatagtaataattatggttttatgtttttagggctccacttttgtttgatttatctccccatgaggatgtaagcctcttaggaacggggatcatgattcttcctgacttttaaaataacaactgtttctggctcctatttggtttatgctccatcatgtaatttgctgtcattcttgtattcagctgatttatccttaatcctgtatctcggttgtttgcttttttatccctaagtgccctaccttgcagagccctggcgtcatataactatttattaaataagcttcacggaacctcaacggggactctgttcacatgtaccagcagtgtgctccttctcctttctgcatccaagacatgatcctcagtaggaattgagaacaaaacccagctctttagccaaaaatggtttctgaggttcggttttcataaattcagaaagggggcttttttcccctccatctggccataggatattgttggcctctcttttatttattttattttatttttatttttatttttattttttgagatggaatctcactctgtcgcccagactggggtgcagtggcatgatctcggctcactgtaacctctgcctcctgggttcaagcaattctcctgcctcagccccctgagtagctgggattacaggtgtgcgccaccatgcttggctaatttttttgtatttttagtagagatgagttttcaccatgttgaccaggctggtctcgaactcctgacctcagatgatccacctgcctcagcctccaaagtactgagattacagccatgagccatcgtgtccagccggcctctcttttagaagactctgtcccattgtcctttaagggcatgtcacttccctggaggtcaaaatcatgtcatactagtttttgcaatccacagctccttgcacaattcctggcccagggagtgggtacatcatcaatgtgtgaggaacagactgccatgaaatagtgtaaaaaatccacatagtacacttgtgagaaaagagataagaaccagaattttacaagcaaagggatagagagctacaaggtggaattcagcaggctcacacctattgggtgttagagagatgaacttagatcacatttatttaaacatctctgagtgcagtatttttaaagatcacacaagaataaaactgtagcactgaacttttctttaagtgttgaagtgaaggaaatgaagaactcagcacggaccctgcttagactccggcagaacaggtggtcttgrcatgacgtcgctccaacatgcacgcaacttgccttttattctctcagctctttgtgccactagtacatggtcacctgggcatttctttagaaagggtgcagagactttcatttcgtgaaaatatagatgtcccagggaaaaataataatccaactggtataagtttatatcaaaccatatggaagtgattttttctggttagtcattttcacggggattagagagtagrgaaaagtcaaagaaccagggattcccaaggacacrcttggcctggtcaatattactaggattggcccagatgccaccaaatccttttttcttcctacttattgaaaaccctgttaaatttgatatgtgwaatatcttttctctaaaattttagccttgcaaataaaattttgcataacatttttattgacaagacattgtgtcacattaaggcttttgaaggtgatgaaatggacatgacatcttcaccttagcaagtaacactgaattaaagaagtttgtatttcagagtggaagagtacagtataaaatatttgaattcagacactttagagcttggaccctgtcagaagcttggaaatacttcgattttaaagctgctactcttccatttacctcactccaggaaatccttttagaaatcatactcttgagggaagaagacctaggggatagagcatgactccactgagaaatttaatttaggaaaataatgggggaaggggctgtagcctagaggctaaaaacccatgctctggagctagactgcctggcttcacatcccagccctaccaccttttaactagtgtactgaccttgggcaagttactcaacctctctgatcctgctgcttaatctgtacaatgggatgtgtggtagtattggctttgtagggttatttggagcattacttgagtcaataccagtgaaggcacatctttagcagaatgtgatgactgaacatgcactcaactggggactcgtttgttgtaaagattatccaggaaattgggaggagcaaggtagtcatcaccaagtataggacttgagggaggtttccagacctttgaggtccaaattgcaaggaggaggggaaggaaggatggccaggcaatagttgggagggaagtgaagtgaagaccccaggctatctgtcggtaccattgctggctgctgggaggggcagtgtctggactctggagaccacgcctccagagaccacaccctccaagaggccacacccttctagaggccacgccttcctggaaaccacaccccccccttgctctgggccagttggcagcccctgctcttggggctggaccactccttcccagagaccatccattgtacaagaagcacggtctttgataggcttggaggaaaatccctcttccctctccggatccataaggactgcagagagcagccctcacacagcaaggctaattcctggaaacccttaagaaccccagatcagcttgattccaacacaaaggagtaatcaaggtggttgcaaaggaaacaatggcaagtgttttgtgaagcatttttttaagagagtgtgatggaaaattttctttttgaggaagaacatgttctccttgttggaaatgaagttgattttagttataattactaccaaagacaaaggttcattttcacacagacaatgtgatgaagccccaaacagtggaagtcagctctgatttcaaaatagacgcgtgaaggtatccgtgcctctgggtgagaacaaacttgtaggccttagttcttttgtaggtgtgaaatgttctcctcaaaaactgcaacgttcacttaatgaagtttgaaactttgctgcaaagttttaaaaatcttttaaataatttactctctctaggaagattgaaaatgatagtgatgttaacaaattgccctatttggtcttagtggattgtttaattccttactctgaacaatacatttcttgtgttttcttatcaaatggctgaaatatgaaagaatgtgtggacccataaggaaaaaggagaaaactatgagaagaattaatagggttgaaagatgatttcaggtgattttcaaggctgaaattatgatattagaatctgaatatcttttatttaagaattgtaattctttctgagtggctttgcaagccttctttgtggatccttgtgaatccctgcagggaggggagagcaggtgccatcttgtccttgttttgcagaaggggaaggggaaccaggctgaacgacttgcccaaccacttacctaccttgcatggactgttgctatccaaggggagccgagacagctgggagatttgttcctgtcctttcttcatttaaggatttactctgtgccagaaactgtggtcaggcattggagagtcacagctggctaagacaccttgcctgccttccaggatgttctcgtctcatgcaggaggcagacataataggaggtactcttatattagtcagggttctccagagaatcagaagcaattgaaacagaagcaattatatctatttgcttacacacacacaaatatatatatttatacacatgtacacacatatatacatacacatacacatatataatttactatttactatatttatttattatgagaaatgggctcacatgattatggaggatctgccatctgcaagctggagacccaggaaggctggtgatatatataataattcagttggagtctgaagagaagctgagaaccaggggagctgatagtgtaaatcccagtccaggggctagagaagatgaagtgagatgtcgtagctcaagcagtgaggcagagaacacaagggggcagattccttcctctgcattttgttctattcaggccctgaatggattggctgatgcccacccacattaggtagggcagtctcctttactgagttcaccaattcacatgctaatctaatctggaaacacccatacagacacacccagaaatcgtgtttaatctgggcatcctgtggtccagtcaagttgacatgtaaagttaaccatcacactgacagtagaggtgtgagctaatggtctgagctcatggaccaggaagcaataaccttggtgtgtgtgggttgagaaaggcctgtgtcatggaaggctgtgtctttgagggcaagtagaagcttcttaaataaaaaagatgatggagaaggaagacaggatagcaaatgcaaaagtagagaaacttacttgaaaattttagacaacagtgagaagtacagtagaagatgaggtattgtttgggcaggatgggggacatggtgggagtgggggataaggcccaggtcacgaaagaccttctccattacgctaagagattctgacccatttctctaggtggggaggtcagtggaggtttataaacagaggaaaatgtcatgttgtataccatataaatatggtcgtaatttggaggatggacaagttaggtaaagggactcattttttttctctttgattgtctgcctcaattgggtatttctggattcctgaaatgaggcttcatgccctggactgagatactggccatcattaggaggagttagagtccatgattgattgacttttcttttctcttcttttttctcttctcttctttctcttctcttttctctcttctcttctttctcttctcttctctcctcttctcttctcttctcttctcttctcttctcttctcttctcttctcttctctgttctgagacagagtctccctctgttgcccaggctggagtgcaatggcacaatctcggctcactgcaagctctccctcctgggttcaaatgattctcctgcctcagcctcccaagtagctgggttacaggcatgcaccaccacgcctcactaattttttgtatttttagtagagacagggtttcgccatgttggccaggctggcctcgaattcctgacctcaggtgatccattctcctcagcctcccaaagtgttgggattacaggcgtgagccactgagcccagctgattgtttcaatcaattttcaattttcaaactttgtggttttgcaacatgtacacaaatacctgcaaatatcctttctcccatttcaaaagaaattgaagggatatatacatacataggtacattttaaattgaaattgattgaaatttattacctctttgagaatttttttttggagaattggagtttttcaggtacatctgaaacttgaggtacaccataaaaaatgatagttcttcccactcaccttacagaaagtccttttctgtatcccatgtgacaactgtagtcattatggcagccacagacgtttgctagataaagtaaagcaactgccgttttcatcatgcagtaacctgccacaactccatactagattctgtgcttggtactggggaaacacaagtaaaatttttcatggttactaccttcaagggtaggctcagtagctattcagaaatagtctatagtcaagtgcacagagacaacggtagaatggtggtcaccaggagctgctgggagggaaaatagggagttattgtttgtttgtttttgtttgtttgtttgttcttttttgagatggagttttgctcttgtcacccaggctggagtgcagtggcatgatttggctcactgcaacctccgcctcccggattcaagcgattctcctgcctcagcctcccgagtagctgggactacaggcatggaccaccacgcctgtagtgataccatgtttagttacatcttttataaagattttcctattctccttattaacaatattttaacaatattattctaatagttatggttcaatatttaaagaaaccggaactacttagtcttttttttttaaaagacctaattcacgtgaaaaaggaaaaaccccttgtgcaaaaaaaatgaattttagaatgaaaccattctgactgggtgaagaagtctatttctaatgtggggggtatgggctgaatgatgttcttccaaaattcataagttgaagccctaaccccctagtaccttagaatgtgcctgtgattgcagatggggtctttaaagaggtaatgaagttaaagtgaggtcattaggttgggtcttaatccaatagactggtgtccttagaagatgaggaagagacaccgggagggtgtgtgcacagaggcaaggctgtatgaggacacggggagtagacagccatctgcctgccaaggaagggcttccagaagaaaccactcctgccaacacttcatctcagatgtccagcctccaggactgtgagacaagacgttcctattaagtcagtcagtctgtggtacttggttaagatggtcagagcaaactgctacagtaattgggaaaactgcatgtgtgtgtgtgcatgtgtgtgcgtgtgtgtgcgtatgctctcatcttggtgcacctgcgccagcatctgaatgcttgagttggtcatggcacactgggccccaggtgtccagagacagatatccaggtgcagtgtcagatgggccgttcaggttccttgggtccatctctcctacgatggccagtttgtttggaggatcacatcggatgaatggaaggaagtggtagctggtctcatggccatggcactcttcagcctaccaaatataaatgcagaagtcaggaccacaggaacagtctctactaaagtggaggacctgccttccattgcctttcggtgccagggagacctgggggaaagcctttcacctggatgggaaggtcttggtattgataccacatctctgccttgaccttcaatcactgcatctcatctctgatcacttttcttcagctttggtctttagttacaacattcatgcaattaagtgataaacgagttatccctaacttttttagattaaaggacacagcaatcacctttctgtccgagagcacaggcaaatgtttttgggtcatgtagacaggaggttgttttaaaaagccgaggtggtaccatgtgatgtttattttatgatctctggagtcagaccactgggttttaactcctgtctcctcagtttgctttatatcacttagcaaatttgtcagcttcctgaccctcagtttcattatctataaaatggtttaatagtcatttttttttatcaggggttttgagaagattaatgaggtaatgtattgtttatgtcacgtggcctgacacacggtaagtgcctgataaatgtgagcaactcttcctacattattaagcatcccatcaaattgtactttaggaattatagtggctaggaaatgcactttgaattccaacaattctggactatttagctccacttgaatttgtgtcagaaatatggtaaatttaatgaagctggctcatcgttaaaatgcaaagctgttctgagtctgaaaagagacaatgcctgggaagtatttaataggggcccagaattttctaagtgatcaataaatggtgacgataaaatgtgcagagtcaagatgggtatgatcttggtttccgtccagctcttccactaagtagctttgtggcctaaggaaagtctcttaagttcctcaagcctctctctcctcattggtaaagtatcaacaatagtcgaacctaccctcctaggtttgtggtgaggctgaaatgtgctttgtggggctttgtatcgctttgtattatggtggtggcggttttcccctgacatagctctctaggatatgtaatggtaaaggatgaataagggcttttcaaaatggagctctgagcggctgtgggagcaatctgtgtggtacatctgtggccccgctggctgccaggtgtctggagacctgtgctccatctctcccctcatgccatgtgcctccctcctgaggctgtgggttgcatccaagagaatgaccttcctcgacagaggagggcagctctccaggaaaagaaatgggaggaacttccttcttctgctggaacccccaactacaggtttaaaatgctgtgtgtgtgtgtgtgtgtgtgtgcacatgtgtgtgtgtgtacatctttagttagtgagaccacggtaggtggtttcaggtggtgtttagaaggtatggtgctgactggaaagggtggcaacagaaatgataactatccaaggaggtgaggcttatgcagtttgcaaaatgcagacaaatcggcatacaccatgtttttaaagttacatttaggtcaaggagaaaaatgaaaaagccttacttaggcttctgatgaaacggggaaaggaagaaagcaagtgtttttgactaccagcttagtgccaagcacggtggctggcactttccaaaaaattcttccattcagataaaaagagagagcactcaactccttttacctcctgttttcttgatcgaggagaaagctgtttacagtaaaaatgtatttgcaagagaattttaagataatttccaagaaaagttaggaaacggtaaactccaaatcagttggtttcctgatccagattaatcatttcctaggattttccccaaattattagaagacattgctggaccattgtcattagccattgaggagctgtagagaaagagggagatgtaatagaggcagagatccraattctagtagctgtagattggtgtttctgatctcagtcccaggtgacaccctagactgatagtcaagtatatgttctgtgagaaacggaggccaccatgggttccttggggcaggcatggcgggtgacctcgtgggtttgtaaatagcatcactatgctagaagcattagtggaatgttgtagatatgggatataaaaatttagaygtggtgtatttgataaagtctctcttagtatccttatggaaattaagtgtgaaatgcaggaaaacagacaatggatgatggttcattgatgtggagacacaattagctcagtggctgattcctgaaaatactggttggtgatttgagagtagaggtcacccttgaggaacacctgccttacctgttttgggctcaacattttttatcagtgtcctgaataaggaccatagataataggcttataaaatttgtggaaaatgtagagttacttaaatgttagttagcagaacattggggttgcggttggaggccggggatgccgaggggaatgatccagttaagagggaagcaacccaccgggatgcgccacatcagtggtgaagtccctccacatcgaccgcttgctgatttgaagtgaaaagagggttcctcagtaaggacagacttaacagaattacaatgtttcctttgcaaaagatgagtgttaaaagggaacatgcagaaaaatgatggcttacatgggatgaataaagacttagcaaactctggccagccatggtggctcatgcctgtaatcccagcaccttgggaggtcgaggcggggggatcacttgaggccaggagtttgagaccagcctggccaacatggtgaaaccccgtttctactaaaaatagaacaatcagccaggcgtggtggcctacgcctgtaatcccagctacttgggaggctgaggcacaagaatcgcttgaacctaggaggtggagattgcagtgagctgagatcgcgccactgcactccagcctgggcaacagagcaagaccgtctcaaaaacaaacaaacaaacaaacaaacaaacaaacaaaacttaaactctatgatcctaagtaaaagataagagaagcagttaactaacttccttttagttaggtactccagggtactactttttgtgatggcagacacacttaagctatttgtaaatgtgtcaccaccttttcaaataattttcmttgaaggttaacatgttttctctgagaaaaatttatttaattaaaaaccttatgtatataagggctacaataaaattttcatggactctgagatgaaaagacatgtatatcttcttgaagttatatagttagcaaatgtaaaggctataggggtggattgtgtattatgcaactgctaaacactgtcttgcaatttgtgtgcgtgtgttttgtattaaaccatgtgctcctgtccttgctagtacagtggcttttataatttttgagatgatgcccatagtgagaaccacatttttcatagtgttccagggtatgcacatatcatatactccacacagaactgcaacaaaaaactcaggaaacaatacttaccctaagatgctttctcatttattctgctttatttgcttctatcctatttttatttaaaaatactgatgagagctgagtgctgtggctcatacctgtaatcccagcactttgggaggccaaggctggaggattacttgagcctaggagtttgagaccagctcaggcaacatagcaagacctagtctctacaaaaaaataggaaaattagctagatgtggtggtgcgtgtctgtagtcccagctactaggaggctggggtgcgaggatcacttgagcctaggagttcaaggttacagtgagctacgactgtgccactgcgctcaaatctgggtgacagagtggggccctctctcttaacaacaaaaataacaacaaaaaagtgatgaagactttctcctttgatcctatcagtcactattttttttttttttttttttttttttttgagacggagtctcgctctgtcgcccaggccggactgcggactgcagtggtgcaatctcggctcactgcaagctccgcttcccgggttcacgccattctcctgcctcagcctcccgagtagctgggactacaggtgcccgccaccgcgcccggctaattttttgtatttttagtagagacggggtttcaccttgttagccaggatggtctcgatctcctgacctcatgatccacccgcctcggcctcccaacagtcactatttttaaagcaatgctctggcagagactgaatacacgtttaatgctatagctgtctcttttcttccaaggagaaactgttttatgttatcatctcatattacatcattttaaatgatgtcaagtgaaatactttgagatagagtttctattttatagctggagaacagggttacggtgagtgtcataattatgaaaaaagctggcatcttgccattggcttatggatcattttgcaatgatttgcccaaagcctgtcagccatcacatgtccaggaattagggaaaagaattgttgcttatagactcttagtgtaggaaggacatgtagaggtcatctattctaacatctcaccgagtgcgggggtcccttctgtagtagtttcacagttgaccattcrgtatctgcttgattaccttcagaaacagagagcccactgtgttagttttttattgttgctataatacattaacacatatttcatggctgaaagcaacacaaatacattatcttacagttttgtagttgagaggtctgtaaagggtctcagtgggctaaaatcaaggtgttggcagaactacatttctttctgaaggttctaggagagaatccgttttcatgcctttttcagttcctagaggttgttagcattccggggccagctatggaggtcatgccattccatcttcaagaccagcaatggctagtagagtctttctcacatcctatcacgctgacccacaagtcttctgcttcttctatctgcaaccttaaccctcccttgacagggaaggtaacattcacagggtctagaaattatgatgtgggccyttttttttggtggggggcgcggggggcattgctgtgcctgaccacccccatcccatctccccaccttttccccctggcaagccaattctactttctgatggttctaattttgggaatcacacatatgttgacttatgacaatgactgctattcatgcagcaggtgagtttttaaaagagaaataaaggaatctgcaacctggagattttcaactttgagaccaccagccgttttgaaggctgagactgagcgaaaactggtagaaactaattcataggcagtaatgtctccctctactggctgcagagttaacacgtgcattttgcagatagaaatgcttggtggttgccagaaagagggtaacaatgagttttgaataaagagccgagaagtatctgtaagatacgaaactggtggatatcttagttgcactgtgcttacttggtcactgtggagaaggtatttttaaggtcgccacgcccaggcctcggaggttcggtgggttgggagggtttatagggagtcctttggcagttctgattttgttagggattcagatctgctgagccgtgtgagtttggtgtgctgcctgtgactctcatccacagaggggaaagaactaagcaaagggatgacttaacaaaagctgttttgctaaaaaaaaaaaaaaagcagacttatagatccttactgcttcattcttttaacactgaaattgcagtagttgagtaaacgctttaacatactttactattatgaggatgccttcattttggagagatgaaaatttaattgaagaccaaaaccagaaagtttaaggaattacataaaaatattaacgtcattgtttttgtgctaagttcctcaaatgcgttctaaatattaaactgaatgaaaaaatcagtgtagacagtttttcaaattaaagttctttgtaaaaaacaaacatgtatcataaaataagtattactttttcctttcgtgcctattttggttttatttaagcatgggcaggaagagaccttgttacttataaatgaaaatatccattttcaaaatgtcactttctgtaatgtacaaaactgagtaagtgttggcaaagacatgtggcaagaagagacctttgttacttaataaatgaaaatatccgtttttaaagtgccactatctctaatgtacaaaactgaggccgggcacagtggctcacgcctataatcccaacactttgggaggccgaggcgggcggatcacctgaggtcaggagtttgagaccaccctggccaacatggcaaaaccctgtctctactaaaaatacaagaattagccaggcatggtggcgggcgcctgtaatcccagctactcgggaggctgacgcaggagaatcgcttgaaccagggaggcagaggttgcagtgagccgagatcatgccactgtactccagccttggccacagagtaagactctgtctcaaaaaaaaaaaaaaaattgaatagttggcagaaaaccctgtggtggccatggaggtgtgccactcagctgtccttccagggaacttgctatgagagtaattggtgacagtcttcagctatggaggtcatgccaaacctaccgtctactggggctgcccccagctgatgactgggcatggtgaggggagctggagctgagccctccatgcccctcttgggactcttctgatgggcaaccttttatctccctccctcctaccccatcagcctggccaaggctttctcagagctccactgcagtctgaggctccttctccataatcctccttccttccctctttcttccacaggtgtcagacctccatctgggtctgaaggttgtctatgcctactcctcctttttcccttcatccttcctaggtatttctcccagaaaaccactggcagttctaattctgtcttggagtcagctccttgaaggatctgaacaggtacctgtgtaaagacttatggaaagaatttttattttattttttttatttatttatttttttaaatttattttttattgataattcttgggtgtttctcacagagggggatttggcagggtcataggacaatagtggagggaaggtcagcagataaacaagtgaacaaaggtctctggttttcctaggcagaggaccctgtggccttccgcagtgtttgtgtccctgggtacttgagattagggagtggtgatgactcttaacgagcatgctgccttcaagcatctgcttaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacttctttctacacagacagggcaaccatccgatttctcaatcttttccccacctttcccgcctttctattccacaaagccgccattgtcatcctggcccgttctcaatgagctgttgggtacacctcccagacggggtggtggccgggcagaggggctcctcacttcccagtaggggcggctgggcagaggcgcccctcacctcccggacggggcggctggccgggcggggggctgacccccccacctccctcccagaagggggcggctggccgggcagggggctgacccccccacctccttcccggacggggcggctggccgggcggggggctgatgcccccacctccctcccggacggggcggctggcctggcggggggctgaccccccccacctccctcccggacggggtggctgccgggcggagacgctcctcacttcccagacggggcggctgccgggcggagggtctcctcacttctcagacggggcggccgggcagagatgctcctcacctcccagacggggtcgcggccgggcagaggtgctcctcacatcccagacggggcggcggggcagaggcgctcctcacatcccagacaatgggcggccgggcagagacgctcctcacttcctagataggatggcggctgggcagaggtgctcctcacttcctaggtgggatggyggccgggcggagacgctcctcactttccagactgggcagccaggcagaggggctcctcacatcccagacgatgggcggccaggcagagatgctcctcacttcccagatggggtggcggccgggcagaggctgcaatctcggcactttgggaggccaaggcaggcggctgggaggtggaggttgtagcgagccgagatcacgccactgcactccagcctgggcaccattgagcactgagtgaacgagactccgtctgcaatcccggcacctcgggaggccgaggctggcggatcacttgcggttaggggctggagaccggcctggccaacacagcgaaaccccgtctccaccaaaaccagtcaggcgtggcggcacgagcctgcgatcgcaggcactcggcaggctgagtcaggagaatcaggcagggaggttgcagtgagccgagatggcagcagtacagtccagcttcggctcagcatgagagggagactgtggaaagagagggagaggcagaccgtggggagagggagagggagagggagagggactggaaagaatttttaaatcccttcagaaagttgttcaatttccctctgccagtgatagcaaagaaggtggtatagctagagtagggtgaataagggagtgagtggtaagagatcagagagaggtggcagtgcagattgtgtaggacctctttgagcagtttattaatttggaccatgactttgagtaagtcaagccatcagaagttttgagcagaagagtgacatgatctcagttacattttagtaaggccaccrtggctgccagaatagactgaatggcagggattgggaggtcgggatgggaaggaccaaaatacaatcacagagaactgctgcagctgcagagagctgttgcagtgatccaggggaggaatggtagtagctggcatcaggatgctagcaggagaggtggagaaaagaggttggattcyggatatattttgaatatagagataacaggaacagaggttggatatgagtagaaaaggtgttaaagaagactttaaggttcttagcctaagcgatttgaaggatagagctgccattttctggtgtggagaagattgaaggaagagtagctttgagtgggaagaggaaaagtttatattttgacttgttaagtttgaaatacattttagacattcaagggcaaatggagaacaggtagttggacatctgactactttctgccacccccactacaaccttcccagcccaaggcactgccttctctcatctggattactgcagtgcagtagcatcccagctggtattcctgcttctgccattgtcccttttctatttccacgcaacagctagagttagttccttraaaatataagtcagacttctgcttcatgtattgatggactaggcattttggacacatattcctgttgaaggcaaccaagaagcccagataaagtctttgaaaaaatctacttgaagacagatgttagtgatggctaataatatgatgaagaattactgtccaggattcgggagaacatggaaatcaagagaggagaaactgacattcggatgcatttttctggagatgtacacttagtctagagaatgttgctgagagttctagaagcaattttgacagattgaagagtctgcaggaatgcagatctctcttcagcatgacacttgccaagatatggaatccacctaagtgtctataatgggtaaagtatgagatatatatatgtgtgtagcataatgatatatataatatatatagtatgatatatagtatgatatagtataacatatatagtataatgatacatatatatagtataatagtataatgaaatactattcagccataaaaaagaatgaaattctgtcattcttggcaacatgaatgaactatgaggacattatgctaagagaaataagccaagcatctgaagaaaagtgccacacatcatctcacttatatgtggaatctaaaaaagtttaattcatagaaatgactagtacaatggtggtttccaggagcttggctggggttagggaggacatgaaatggggagattgtggtcaaagagtatgaagtttcagttagatagtatgaataagttgtgaataagttctggagatctattgtacagcatggtgactatagttaatgtatgcttgmgaattgctaagagagtagatcttaaacattcttactacaaaaaataggtatgtgaggtgatagatatgttaattagtttgagttaatcatttcacattatatacatatgtcaaaacatcacgttgtacacagcaaatatacataatttttatttgtgaattatacctttataaaactgggggaagagtaaaaaagagagtatggaggaaaatgtgaaattcaaagctagctaaggggttatcctctgtgtttgggattggttccctagagaactacataactaggaaaagagtgaactgaaaatagaccaatagcctggctattacagggccttatgtccccttaaaaatcatctcactaggttgggcacggtgattcacacctgtaatcccagtactttgggaggctgaggtaggtggatcatgaggtcaggagttcgagaccagcctgaccatcatggcataaccccatcttyactaaaaatacaaaaattagccaggcgtggtggtgtgcacctgtaatcccagttactcaggaggctgaggcaggagaattgcttgaacccagtgagctgagatggtgccattgcactccagcctgggtgacagagcgagactctgtctcaaaataaaaaaaaaaaagtcatctcactaactgacagtagactaaggtgatcctggattatgatcaggcatctagcagaagtaaatgttaattttctctagagaaagataacatcrccatatgcctcaaattatttatatgatcaatttttttagatacagggtcttatagaaatctaaaatagcccagctgttccctggcagatgggaaaggaattctgagaaagtctcatctctgagacagtcacacagggctgtctaagactgaggctagggtaagagaagtgagaaactctcctgtctccactctgagctttacaccaagtaaaaagcaacactattgtactgctgaggaggggcaaaagccagagaaagatagcccctggcacagatgagcagggtctgctgaaagggaaggtgaagcaggaatactgagaaaagataccccaggcctcacactaagcccaagataatgacagttccccctgggaggaatttgaagtctgtggaacactgaaggcaacttcctgtagttacaaaactcaaacccagtttaactgtatactagatcaactcaacttctcacactaatggcctgatagaagaaaaggcatgtacatttctggttgtaaatattattatctttgattctcttaaatggaatgtttagtattcaataaaacatcatgagataaacaaaagagtcaagtgatggggtggggagggggaacaaggcccattgtcaagaaataaaatagtcaacagaaacagaccaagagatggcccagatatttgaactattggacagggccgttaaaaatagctatgattaataagttgaaggagttcatggaaaaggttaatactaggcttgaagtgatggggaatttcaggagaggtatgaaaactgtaaaagtgaatcaactagaaatgctagaattggaaaacataatatcaaagatgaagaattgttttgacaggatggtagctagcctctaagatggcctgtaatgatccctgctttcaaatctgcatttttttttttaggtagagtcttgctctgtcacccaggctgtaktgcagtggcacgatcatggctcattgcagcttcgacctccagggttcaagtgatcctcccacctcagcctccagagtagctggcactactggcatgcactaccatgtttggctgatttttaaaaaaatgtgtatrtaggtggggacgccctacgttgcccaggctggtctcaaactcctgggcccaagcaatcctcccacctcagcctcccaaaatgctaggattataagcatgagccaccgtgtctggcccaagtattcataatcttgcatactttcttcacacactgaatagggttggtctgtgtaaccaaaagaatattgcaaaaatgactgtgtaatttctgaagcaacattgtaaaatatattgtggcctttgccttgctctctgtttggtgacacgttctgaaggaaactattcactatgtaatgaggacactcaagtaatctatagcggggcctgtgtggagatgaattgagccttctgccaacaactaggactacatgagtgagtcatcttggaggaagatcctccagctctagcaagtcctttaggtggttgcagtcctggatgactccatattggtagtaatgtcatggcagatcatgagctagagccagcagcttaggtgctcttgaattcctgatccacagaaactgtgagatagtaaatgttgatggctttaagccacaaacatttcattgtgggctaatttgctataatagatgactaatgctgatggacatttcagcagactggacacttcagaggcagaattggtgaacttgaagagaggtcaataaaaggcatccaaaccaaacacaaagaatggcaaaaaatgacaaaactgaacatcacatctgagatatgtgaggaaaatatgaaacccatgcagtgggactcacagaaggaaaagaaaggggtagaataagtattttttatcaggaaaaatttttctaaaattaatgaaaggcaacaaatcacatatccaagaagcttagagaacctcaggcagggtaagtacattgagagtaaggattgggaaaatgtcgaagtgttaaggagagaagaaacctgaaattgcatgggatgatgtgagagtgaacagggaaatgtcacatgattctcactggtcccacttaatgcagtgttcaggtaragttgggttttttaccaaggatggttttttgtcaagcaagtaaagggaaggaagagagggtaggcactgaggaagcatgcaagggagatctgtgatgatggctgattgacatgctctgggtaatgaaagaagtgaggacttcagaggagacagcgtgggttgggagacagtgggctggtggcaagattaggaattgtagggttcaggggccagacaagtctgcacacaggacttccgagaatgtaagtgagatgcttggaattggggctgtgggggctgtacttagtaaggtccagggaatgaccttaggtatgagagatggagatcaggtggagagcgaggtcactgggaaagaacaaatcaagaaagtgacagactactttcttgaatgtgataatctgtgtgatttagaccattggtttagaatgcatttcctaggccccctttcttacttgatatgaataagagggagtaaatgatatgtttagtctctggtgaagacctagatattttgctcagctccaggtttaataggagggagggttgagttatttgttggaagttgagaggtctagtagtcccactcatttggaatgtctttattgtaatttatgcacaagaagaaaacatatagatactgtatggtcaagattggattgtcattccaattagacattcccccagttgtttgtcaggagtaggagaagagagcaacttgtataagaagtgggagtcggccaggcatggtggctcacacccgctgacgcgggtggatcatgaggtcagaagttcaagaccagcctgaccaacatggtgaaaccccgtctctactaaaaatacaaaattagctgggcatggtggcacattcctgtaatcccagctactcaggaggctgaggcaggagaatcgcttgaacccgggagatggaggttgcagtgagccgagatcacgtcattgcactccagcctgggtgacagagcaagactccgtctcaaaaaaaaaaaaaaaaaaaaccaagtgggagtcatcccttagttaggaaaggtatgaaaacttgcacccttttggttgtccacgtttccrttggtggttattggaggtgttcccttgggtctgaagtaccaagctcactaggatgacttctgaatgattcaccgctgatctgactgatccagcacttgtgatacttggaggacattgggcagcttctgagacactgtggttcaggaaaccttgaagttcctggcacagaatccacactggtaagcctcactggtcccctggcttggcacacattactgagagagtccctcccttagaaagaacaaccactgatttctgggtgttcagttattttttttaatcagtgtatttgtccatgttcatgctgttaatcaagacatacctgagactgggtaatttacaaaggaaagaggtttaactgactcacagttccacgtggctggggaggccccacagtcatggcggaagagcaagggatgtcttatatggcagcaggcaagagagagcttgtgcagggaaactcccccttataaaatcatcagatctcatgaaacttattcactatcacaagaacagcatgggaaagacctgcccccatgattcagttacctcccactgggtccctcccacatgtgagaattgtgggagctacaattcaagatgagatttgggtggggacacagccaaacgatatcaatcagtttgtctgatgttctctttaatgataatctatgtaaagatgatcagggtgaaatagaatttaatacttcctttcaaagcaagtggtcaaaggtcaaaatatttgattctatcataatcaagtgccagggattgttgtaagcaatctattaacttccttaattcccaaaacactctgtgatgatttttatcatccctgttttacagatggggaaattgagtcatagatcaagtaagtggcagggctgtgatttaaacctagataatgtggccacaaactgttagcctcaatcactgtatgatcctgtgcctcatggtgggaggaaaaatggacatggaatagaaccatgctgataactcgaaaatgcagccagaatctagaaaacataaaacttgggtcagtttcatttaacaagtaagctgtttgcaacatatttagtatgcaagtccctggtggtagatgacgcatgctttcaatgccttatgtaaggttactcagatacatttcatttattttcaggtatcttcaggaaatcttagtaacagcaaccaaggaaggtgcagcatcactttccagttatcttgtaatagaatatcatgaggcaagtaaaaaaagtccctgtaatagactatcttggggaacagaagtttctcattgttctcctgggctacagattctaaaatcacactgtccagcatccccttgttggttttttttttatttttctttttttttttgatacagagtctcgctctgttacccaggttggagtgcagtggcacgatctcggctcactgcaagctccgcctcccaggttcacgccattctcctgcctcagcctcctgagtagctgggactgcaggcacccgccaccacacctaatttttttttttttttttcatttttagtagagatggggtttcacctccttaaccagaatggtctcgatctcctgaacttgtgatccgctcgcctcagcctcccaaagtgctgggattagaggcatgagccaccgcgcccggcccccctcgttggttttaactgtgtgtattttacaatgagttttcacttgtagcttattgaaggtctgtcattgtgatagatttgtcttttgtacagcttttgctttcacacatggcatctatgtggatacctctagagaatctttcctatgctgaatgcagccttttgagtggacgatgtgaagccaagagagagggcagagaagaggtggtgtgtgcaggggcattagtctgtggctactcctctgcttggccatggggcccctggggagtgctggagtggccctggcctgagcagggccacagaggccccactcatttcccactgctgttgtgcaggaaagccactttgcttcccttcttcttcagatcctcytcactggctgttgagaaggagagatgcatataattaccaacataacttgagtgtccatgacaaatgacccttccagcactctcctaaaccaccagcttagcccgttgagttttactaatgctgtttgatgcagtgataaagcggaaacattgctctgctacctgcccaggatagcattgccatgtaaagggcaagtgatgtggactgagaccaccataatgcaggtcttcttggaaaagtatctaatgcaaggcagagttgcataaggggctgaataaccctgggttattcttactgtgaaaaattcccctacttttttcccrtagttacctgggctatataagaggtatgcatgctatgcaggggcctctgagagctataaatgacatagggtcaaattgaaccattttcccaccgactggggtgtcagaatcccaaccagcatgtgaagaacacaccctgcctcctccagcaggactcagacrggcctcctgtctcgcacagtggtggtttagaatgcatgttgaatgcttggatctttctagaccaggctgtgtatgggaaggggaatattggcaagagggagaaggttttcctgttcaagcatactacaatgggaaagcaaagttatgtttcttagtacatcaacagttataggttggtggttaaaaaagatgctgagcaggctgggtgtggtggcttacgcctgtaatcccagcactttgggaggccgaagcaggcagatctcctgaggctaggagttcaagaccagcctggccaacatggtgaaaccccatctctactaaaaatacaaaaaattagctgggcatggcggcgagtacctgtaatcccagctactcaggaggctgaggcaggagaattgcttgaaccaaggaggcagaggttgcagtgagccgagatcatgccactgcactccagcctgggtgatggagcaagactccatctcaaaaaaaaaaaaaaaaaaaaaaagatgctgaacaaaatattctagattcccgtagccagtggctctaccatactgttcatgggctatactatggactttgcaaaagtttactttacttcatgaatcatccagtaacatgatttgtgtgtatgtgtgtggtcctcattgtgaccatgaatttcagtccccttaaggaacaattatttctttgctggtggaaggagcctgggtcagtgacagtggggcatggtacttacccctcccatggtctctgtcaccttgtcatcatgcctttgtgctggtggggctgacctctagttctctagctggaaaataatttataagagagcaagcatgggggcataacagtgcagatgttaaggcttctaatatctactgtgagatatcctttcctcaactcataatttcttggtgaggaggaagaacaggcgtgaacctgagggttgtgcttcgtttagacttgacaagaatgtcaaagagtttatgatcttgcaataaatgtaattttccgtaaattggtagcaaatgatgtttctcgaaggggagtcccctagaagaatgggttatctttgaaagcagtgcttctgtttatctgtacagataagatgtgcgacgtggcatccatttgaataagtaggaaggatcaaaggaagataattctactctttatttgtcatctttagattgattttaagtaatttttttgtaaggcaaagatctctcatttaatactgataagttgcgtgggaaaatatttgtttttaacctttcttattatgaaatgtaaaatccacacaacatctagaaacagttaaataacaagtgaacactttttaaatcatgacctgaaatagaactttatgagtatcacagactctcaacatgcttaccccttccctaatagatagccactatcccaacttttgtgataatcatttatttgtgttactttttaattttaccacttttgcactggatatattttattttattttattttattttattttttgggactgagtcttgctctgtcacccaggatggagtgcagtggcacaatctcggcttactgtagcttctgcctcctgggttcaagcgattctcctgcctcaggctcctgagtagctggaattgcaggcgtgtgccaccgtgcccggctaatttttgtattttttggtagaaacggggttttgccatgttgcccaggctggtcttgaactcctgagctcaggtgatccacccaccttggcctcccaaagtgctggaattacaggcgtgagccaccatgcccatcctggatatattttaaaatgcaccctgaaggtgttttattactgattttgttgttgttcttgttcatttagttctgctagaaagaaccatggcctaggagacaagagactgtgattatttttattctccagctcaatctagttttgtcatttaaagtctcggggcttattttcttatatgtggaaaaataagtgggaaattttttattagattggtggtttcataattattttcttttaaaagtcagatgaagtttatgaaaccacaatataaaaacaaactatttattttctaagttcagatgtatacagtttactcattataaagtcaacaaatgagaacacattgacatgctggcagtattcagcatgtaaacatttggaatctggagtcccctagcttaaaagtaattctactttaaaagtatgtaatagttgaatgtgccaaagccaataagcacatgagaagatgttcaactttgttagttattagggaaatgcaaactcaatctgcaatgagataccacttcacatccaccagaatgactgtaataaaggcagacaagtgttgtcaaggctacagagaaattgaaactctcatacactgctggggacctggtatagctgccacggaaaacagactagatttccttcaaaggtgaaatatagagttaccatatgaaccagcaattccactcctatatataccctagagaaatgaaaatatatatccacacaaaaacttgctcatgaatgttcctagcagcattattcagccaaaaagtgaaaacaactcaaatgtccatcagttaatgagtggatgagcatgatatgctgtatccatacaatggaatgttatttggtcataaaagggaaaggaatactaccatatatactaccacatggatgagtcttgaaaacattatcctgagtgaaagaaaccagtcacaaaggacaacatctgtgggattccactgatatgaaatatccagaataggcaaatctataaaggcagaaagtagatgagtggctgtcaggggctaaaggcagtgggaggattgggtggctaagggatgcagagttccttttttggggggataaaaatgtccttaaattgattgtggcaatcaactgtgtactttaaatgggtgaattgtatggtttatgaattatatctcaagccattatttaaagagttgaatgtgcaaaagtgagatcatagtcttacatgatattaagtagggagtgagtggtagagaggaaagatcctgttcctgagaagaagataccatgacaatatctctgtgagaggtacttggtgtctatctcatgggttccttttcttctacactgtttatgactagagtcacctcttctggcatgcctactgcctaatgactgtcttcattaccactaacattcatatctccaaaatatttctatttagattcatttttacacagcgcaaaacactaacagattcaaataatttgacagactctatggtactgaaactatggtggctttgacgaaatggaatcattgtctggcaggcagtgctgtgtgacgtgctagctcacaacrtgtgtgcagagatgcaggcgagttaacactcagtgatgtgtaggcgatgtgtgcctgaaagtgaggtttgttcaagagctaaacatagaaaagtggatgactgtctgactctaacacatttgaatgtgtatgtttctgtaagaagagttttgataagttcgaaatctaaaaaaagaaatcagaatgaagtgttcatggaacccygaagcaccgttgcagaacagtttgtaaaccacaaagtttaattacacctaacgtcttttttggctttcatattttattgttttatttcatttatagctacatttgaatatctgtttatcagctttcatccaaaagacttgatggattgatttctgatatgtgccatcttggtagggtaattattgtgcttgattatttagacagtagagcttaaaattaactttagtggtattgcataatggaaactttttataaggccatgcaaatttattattaagtgaatcatcacaaattaagttgtgactagttcaccgctctgtgaacttgaattctctcttgcagaacacacaacactgatgccccaattgggggtgtctgaaataccccagcacaaaatccatttactcacagaacttatttatgttctccttataaaattggagacaataaaggcttaattagggataacatgttcaactttctcatttccagatgtgtaaatagagtgaaatcaggcactcctagttggtggagtttgttgataaaatctttgagataattttaggaatttggaattagaccatatttgttcctggggaagtggattaattattataagcttactctgaaccattacaggtgtctttgacttaccttggaccataggatttctctggagtatctgcataaagtccatctataatacaatgacctggcctcaccttacccagcctcttagtatccttcagatatgcagagctaggccgagctcagtgtcttctttattagcagctgcagattagggagtgcatctgctgtgttatagtcacttttggaagcataatgcaatggatttatgtattgtcctgtttaaggacatttatattgtttcattttaaaatttttctcatagaaaatcattctgcaatgcacaatcttgtacatgtcttcttgtgcaaagtgtgagaacagcttctggatgtatttaggaatggaattgctcagaaatagagcatgcacatattttgtttctttttcttgtctggctgtagctgctagaatttctagtaccatggtttatagaaacaatgttggtaggtgtccatgtctccttcctgacttcaagagggatttctaatgtttcatcattaattaatgtgtttgctgtaggattttggtagaatctctttgttgggtaaaggaaatcttcttattccttgtttggtgagaatttttatcgtaaatgatggttgaattttttcaaattccttttcagacaacttgttttgatccagtcctctgagatcttcctaatgaggcgtcccccaaattgcctatcatctcatgtttatggggtagtctgggacctttagtgacttaaatttagccttcatrtcttgggtgcagttgttaagagaaaaactggggagtataatgcctcccctggttccccaactgggaagatgtccagagaccaaggaatgactcaaacaagtccagcttggcaagcggatgagtttattaagacttacatatggggaccttctgggcggcagcgggacagctttagagatcggccctgcctgccatttttaagctgcttttaagctaattttctggctctttgcctacagtgtgtgtgcaatggaactctttttgctatgttcccggatcctctccaggatgtttgggttctcagaaacaccttcttcttggctgggcactatggccttggttcaccacttggacctcagggttcaagcagtggacatatgcccttaagtaacctgatgggggacctgtcacactacagaagtcatgtaactttcagttaacaactgtgccaggattttcacttccccaggacacttgtgggatttgcaaacaacagatcccttcttacagccagccaatcagatatattcttacctaagtggctcctcactggagatgccttatgaccaggtggggcccccattgccctgactgcctccttgggtctttctgaagccctgggtggctgtcctcagcttcttgggcatgtagggtggctccagcagcctgagggaaggcatacacacttgagcacacctgagaggggcctgagccccgctctgtcctatttctcatgttcttatgctgaagagtttgccaggagcttgtatgaaactgaagtgctagagtctgttattcatggacaaaaaggggaatgctgtatttttggtaatatcccaatgccctatctaaaggaaagtcaaacaaggctggaagctggggctttgaattaagaaaatggcctcatgctccatttatctaaggtaaatttgaagaacacttctggggcttgggtccctgggaaggaagcaatatggtaggataaaggagaatacccagtaatctggggtgtaccacagggcatggaggaaaggggaaccctacaacctgactgctgcagtgctgccagggttcctgccaccctgtgatgaggagctcttcattggtggggcagttgggaagagcatgctgctctctttgggcaaagagatttcccatgtcatagactttgatctygtccgcactgtgagctccaggtcagacacacagagggaccgctaagccctagagtgcaacacttcactgcccattaacagtttattttatttttgcctgcccttgtttcactggaagctaggtatggagagagaatgccagaggtatcattacctctcacttttctctaatacagatggaaaccagcattgcaggtaatttcgggggcctctcggtagcaccggctccccactgggaaagacatgcattagatgcctgcctgaaaaactggccggctctcaataggtttagactatcgttcgaacaccttcttccttgaaaaaagaaggttcagtagttcctcggtgttcttaaacttaacattcacagtttgtcttcagtgagtaacccttaaggtccctaaccagaaattcataaatttgccagggcacaaaagtacctgcatttccctattgttttgctgttctgatttgatgatgcagaaatgtaaatcaatgtgaatcactatgtaaaacataaattgagtcattccttgaaaactctctgagaattcccattgcatttaggctgaaacccaaactttctgacatgagctgatggtagccacagtgtcagggtcccgcctgtatctctgatctcattccatcctgctttggctcacagggactttctgcaactcttaccctctcctcaactttggagagctttgtctttccaatgtagaccctgtaactcaactttggaggagattcctccaaatgctgtagctgctttgcctacagcagccagtggctggaattaatgtccctggctgtccccagcctcccataactgtccagtatggaagcatgaaagcccagttcacgctttcacggggcagaacttaccgtgtagagttccactggagtctcccgtggcccccttgcttggttttcaccccatgcctgtcttgctttgtccacaccctcactagcctcctaggagcacttccttcctaatcctcttgcactggactcttccttttagggcccgtgccttgggaatccaacctaaaatacatcacccaactcaaataccccctgtctgaccagtgttggggaaaaagaacaaaaaccaaaatctcccaacccagtaaactactctgtaaaggtagtagaaaaagaaaacagtttacttattgaataaatatcctagcactttgggaggctgacatgggtggatcaagaggtcaggagtttgagaccagcctggccaacatagtgaaaccccatttctactaaaaatacaaaaattagctgcgcatggtgacatgcgcctgtagtcccagctactcaggaggctgaggcaggagaattgcttgaacccgggaagtggaagttgcaatgagctgagactgcgccactgcactccagcctgggtgacaaagtgagactctgtctcaaaaaagaaaaaaaaaaaattagaccagaatgtgacgcatgttataggccatctactaaaagagtgccaagacagaaatctgacccttttatatagccaagtagacagaacccattatatacatgttctcaagacagactactccttaagaaagaggactcgacagcactatttgttacacatagtttatgctaaattcacctggtaattagggtgaccattggtgttaactcattcctatctttatgtcagaaggtagttttgcaacttggagcctggtacctgccgaagttagactgccgtcttccagtagagactgcgagatagggacactatcttctttggatgtttacattccaaagagatgtttctcaggtcctggagaaagacatttctgggtcacagagctgacagaaacatcatttagcttttaaaataatttacatatatttcaaagagataagaaagaacttacaacttttctatagtaaatattctaagaaaaaggatgggcaacatctcttattttttatctgtgagaattaaacctcttatttttaatttttatttgtcttcatactataggtctagctgccctggagactctatcatattccttgtgctattttcctcagagctttctgaatgtttgatacatacacaayaatagatgtaacatatacttaagttataaagtctagtaataaagtaaatacgagtgaaacatgcatccaactcgagaactggatcttgggtatcccctattccaccctcagacgtcccctaacctgaattttgtgtttataatttccttgcttgtaccactatacatgattccctggccaatagttctaaatgaaccctgtagtttagctctggagttgaacaatgagaacgcatggacacagggaggggaacatcatacactggggcctgtcggggggttgggggagctaggggagggatagcattagaagaaatacctaatgtagatgacgggttgatgggtgcaggaaaccaccatggcacgtatatacctatgtaacaaacctgcacgttttgcacatgtaccccagaacttaaagtataataataaaaaaaaaaagaaaaaaagaaaaaggtgcactgtgggtagactcttgggactagccgtttgcaattagcattgtttctaagacacctatgtggttgcatttagctgtgcacgctcatttttgttactatctaaatattcctttatgtgaatatataagcatatatccattctcctgtctgtggacaactgggttgttcctggtttgtgatatgaggaacatgcttctttgaacattcctattgtatctcctggcgccatatgcaagagtttttctgatgggtactcctagagatggaattactgggctgttttgttttcctatgtatgcctctgaaaacatcttgttcattggcttgtttcctgctcactgtctgtccacttgcctctgtaccagtgtcagcaggcctttgtctcagtcttggtacatgttggatatagacctactatacccataaacatgaatgacccagttctagatgaccagttttttgaaacagaccctccagaaatcaataactatctattcttgtaatggcagtgaagaaaaaaagcaaggaatactgggaaactgggatgattgttagcctgaaaatagaagttttaagggaggaattagatgcctcagctatatttttaaacgagggggtttctgactgtcaaggtctattattagttaaagttaaaagggttttctcttccagctgccgctgtatttgggtaaacaaaaatcctgtgtaagacttcagaatctcagtaagcagggtaatgtcggtattaataaaaatgttagagtaaaatttgccaagagttagtgtgttgataatagatattgactgcagagggactatagcatatatttgggtaacaaatttgatatgtggtgttgtgtttggtatcatgaaaacataagtaattgttgaatttctcttaaaaagccagctctttagaaggggtggggaggttttatcagatggtagggtttggaaatttagggagatgtttaagtgtaacttaaaaccttacttcgttgattccagttgttttaaccccacatttttaatttagtgtttggcttctattggctctaagtcaactatctaatgaacacggcactgctgggaaggggcactgccgaatttagcgtatggtttgtgtcttggagaaagttgttcagttgacttggagaggaatgcgtgggaatgcagttccaagaatcactgacacagctctcctgggaacccacttcaaatatgtagataacataacagtcggcatgcttggagtaaacaattcccactgctttgcaggatgcgctccttcttatagcactttgttgtactgccagctgtttttcttgactagttcaattgtgacaatgtaaaccttttaaaaatgcattttttcaccagtttctgtccactagcaaaaatttgctcctagctccactgagagttgggcttttttgaattgtcatgttgccagttttctttcacttggaggatgtgttcatctatttccagaatgcattttaagtattaccctcatctattctagtagttttgttcctgaattttaaactacagattaatcatcccatttaatctttttaaaaaagagattatagtttggagacacagcttcttttggaatttctttctggttaaaagttagaataattgcctgcttataattagtttagtgttgaacatactacttgttaaaatctaaaattgcccttaattttataccagctttaaagtttgggagctgcaaatgccctttgttctggggatggggatgattaatgcctggaaaaaactatgagcaaacttcagggtcaatcagacaatagatatctcattatctattgaaaatatagatgtgaaatctcaggaaactctttttacttaaaaatattaagtgccagaaaagattaaggctactatgctgaattgcatatttacatgagagattgagaaatctttctttttaattgacaaattaaatgatttttagagcatttttagtttgggttaataattaagcagataagtgagaactttgttagtcttgctaattttgataaaattccctatttctattactgtaagaggaaaagggtgtgcacctgttctggtaataccaacagtatccaatgaaaaaatattatgagggtatgggggtaggggtggaaatacacacaaattatctgttgctttgtgtattcttttttcaatcttttcctctaaacttgagcccctcacaattcacgttccttctgttcaatgaccattttgtatcttcagtttgaatttatctgagagcagtcatgcaattaagatttcattggtgatcacattttaagtttcattatgagtaacttttcactaagagatgtctgccaacctcatggtgaatacatcatgtaaaatcagctcctggattagaagagccatttcttaacatttgtacattctcctcatggtatacctggcacattatccttgtgccttgaatgtttgttgaactgaatcctttgcgatcccgcaacactgtggctatcagagagtcacaaagtttaaactggatctagcaaagtccaagcgagtatagtttctgcaaaagcttcttatgttgggataacagttagtgatgggatgttggccaatttcaatggtgttttattaaacagacctccactagttaccttgatttggccttggccttttcatggcaccctatctggttttattcaggccagagttaatgatagttaggaagtcatgtggtcgaatcatctggaaattttgcataatatgacagttttctcctgaagcaagttccaccgcatgtcgtgtcacacatatattatggtggagatgacatgggcctgcagatggacttcggctgaagtgttcagggtctcatcaagtcagatggtaggataaacaagatagttaataaaacagcttctaacctctctttttaaaaggagattggttttcactgaaatacctgcacgtgcaggaacagaaaaccaaacaccgcatgttctcactcataagtgggagttgaacaatgagaacacatggacacagtgaggggaacatcacacactggggcctgtcgggagggctgggggatgtgggggagagcattaggacaaatacctaatgcatgtggggcttcaaacctagatgacgggttgataggtacagcaaaccaccatggcacatgtatacctacgtaacaaacctgtgcattctgcacatgtatcccagaacttcaagtaaaaaaaaaaaaatatatatatatatatatatatatacacacacacacatatatatatatatacacacacwtatatatatatgtgcatgtggtatggttattgtaaacacaagtttattgaaaaaggcagcatgggagaatagaaagattttgggttttgaagccagctagacttgcatttcaatcctgtttctggctgtgtgggttttggacaagccaatctgagcttccatttttctctcataaaaataatgataattataccgacttcgtaggattgttaccaagtgtctagtacacagtaggcattaaatactaagacctttgtgattttattgtcgttggaattgccctgccctttcagatctggataagattgcctttgacctctatttttcagattttgggaaatccagccccctaccccaaattttgtgaattcttcaggttcatacatttttgtkttcacttctgttcccaagctctagcttcctctgaatgaattttcctcttcgagtgagcaaatcaagtaggataaattgttcaaagcatttctggagtgttcagagagtcaaatgtattgggagataattatactttgaaaacttaggcaataattgataccaaccatgatagaggaaatatttttagagctgcataatttgtttgaaaggtgtcgcttattttctatgcctatctatatccttgaaattttgggaagttaaaagacagttttagtttgaggctagcctgagcaacatgctgagaccccgtctctacaaaaaacaaacaaaaacaaaaacaaaaacaaaaaaccaaaaacaaacaaaaaacccccgaaaacaaagcaagaaaattttaaaggaggtagaatacaagctttgagaagtacatggtatggctggtcagtttacaagggtgtgttgatgagatttagcagttaggcctcaaaacatacttgaagccaagtgccataaacacaataaaataatggctcatttaataggattaaccataggtagcattccaactctgaggggaagaatacaagacagtagcagaaaaattgtcaaattccattaagagtggaatgaaggcttttttcttctgtgaagtgtgatgaagtttccctcccacacacctgttatacattaccacaatgtatttgattagtttaacttttattttgacttctccgttaatttcattggaacattaagatattttatagcttatcattggctatcctatttccttgttttcatgtgaaatgaagtccgagctacttcaatgctatcttgaaatgctgcctttctgggaatttttaggtgaagaagatagatgtgagtattttcaaatacatgagccgttgccatgattagttacatatgctggcccattttccacccgagatagctcattaggggggttttgtgttataagatgagtttgaaggctcaacttaatacagtaactgctactgctgttgtattagtattataaaagcaagcaacatttactgagaacttatatatgccaggcacagtgccaagtattctctgtgcattgtcacttgcaataaccttatgaagttctctcattattttcctttgttcctttcctttcctagggtttggaaatcttaaataactttcgcaaggacatgcaagtgtatgtagcagagttgggcctcaagcaagacctgtctgacttcagaggtcacagtcttgatcactgctctagggctctgcttctgtaacagctgcttcttgagatgtaggaattaagaggcatgtaaggaaagctagcatctggtttcatgttggatttggcttggccctcaatctatcaatatcattgatgggatgaattcagaggatggaagattcttggaaaacaagtttctrgatagggctgggatggaatcttttctgtttttgtatccccggtgcttaacctaatacctggcatgtggaaagcccctgaagacagatatggcaggcacttttcttggattggcagttgaaaagaactgaaaacaatgacaacaacaacaacaaaaacacaaagaacacatagcatagtctgtacraacatctcctgtattctatgaaagaaaaaactagaggtagaamataggctaatgggaatattgaaactatggtgccttttccaggtttttaatcatagatttggagaatttgacaatgccgagatgaagctcttgaatgttttagctggaggattctggaaatccttctggagttcatgtctggaggaattaatagagaattcctccagattttggtttcaaaagctttaattttgcttttgattttcaggggtctacttaattccaagtgctctggaagaagagtatgctgatttgttaacatgagggccaagtgtttaagttggtggttttagttttacttggagaacctttcttcttttagatctcagggtttcgattttgaaagtgagtttaaacaaatacacaggagtcactggaaaaagtaggttgggctgattaattttcatctagattttaaatttatgattcattttagatctaggaatcatggtgctgttaggaaaatagttttagaggttatttaattttgcattaggagtatactgtgcctgagctttcattttaagcttgatattaagaaattcatattcagatgcagttctacatttgctagaactgtccagagacaaaattatgcttctcccgaagggcattattacttacttgaaacagaaaccgagtatgtgcctgttccagtaatggatatgtcagggtggaataatcaccctaacagaggcagccacccaaagtttttgtgttttgactagagaaaatgactcttagcgatgcataagacacccctcaacatgttctttgaatggttgctgatgttatttagcaataattcaaattaagtgatgtttcttgctgtaaagaaaaactgagctgtaagcaggatagtgatatgattatagaactcagtcagaaagatctaagttaggagtttgctacttggaatctatctgtatttccttaagacttcagttttctcatctgctgggtgaggatataagtacttgaaaaggtatacggtatttagccagtgctaacttagccattgtttttgttgttgtgtgtaatgatgcagacgtcatgatgactgctgaaggagcrgaggaggacctttacaatcaacaccctttaggaaatggtggtgggccaaggacagagtcaaaggtttttaagcagtggggtgtggcatggacattgatcttgcagctattttcttttctttttaaattttactttgctttaagttccaggatacatgtgcagaatgtgcaggtttgttacgtagataaacatgtgccatgggtggtttgctgcacccatcaactcgtcacctaggtattaagacccacatgcattagctatttgccctgatgctctctctcctctagcccccaccgacaggccccagtgtgtgttgttcccctccctgcgtccatgtgttctcattgttcagctcccacttatgagcgagaacatgcrgtgtttggttttctgttcctgtgttcgtttgctgaggatgatggtttccagcttcatccatgtctctgcaaaagacatgatttcattcctttttatggctgcatagtattccatggtgtatatgtgccacattttctttatccagtctatcattgatgggcatttgggttggttccatgtcttcgctattgtgaatagtggtgcaataaacatatgtgtgcatgtatctttatagtagaatgatttatattcctttggtatatacccagtaatgggatggctgggtcaaatgggatttctggttctagatccttgaggaattggcacactatcttccacaatggttgaactagtttacattcccaccaacagtgtaaaagtgctcttatttcttcacagccttgccagcatctgttgtttcttgactttttaataatcgccattctgattggcatgagatagtatctcattgtggttttgatttgcatttctctaatcatcagtgatgttgagctttttttcacgtttgttggctgcatgaaacaaaaattaactcaagatggattaaagacttaaatgtaaaacccaaaaccataaaaaccccagaagaaaatctaggcaatgccattcaggacataggcgtggacaaagattttatgatgaaatcaccaaaagcaattgcaacaaaagctgaaattgacaaatgggatctcattaaactaaagagcctgtggacagcaaaagaaactatcatcagagcaaacaggcaacccgcagaatgggaaaaaatttttgcagttacccatctgacaaaggtgtaaatatccagaatttacaagggacttgaataaatttataagaaaagaaaaccccatcaaaaagtgggcaaaggatatgaacagacaccagcagccattttctaagggctttggtaacagtcactgtgctggttgctgaatcagatttgtgttttaaaaagatgagtcagagtgtgtgtatttagacagggaaaccaattaggatgctcttgcatgggtgagagatagtgaaggtctggacaaagagtagatgtatgtgatggacaatttggagcaagaatgaacaagagacaaagcggtgaagattttgagatttggggggaggggaaggaatgaattaggaagaattaaaggtttctagtgttggcagttgagtaacttgtggctttattaatggatgtaggacagataaaaggaacaagttggtaggggatcaaacagaagacagggtcttccctagaaagtctttaactgaaacctaaactgttctgtgtgtgtgtgttttaaataacgatggacctttattacccatcattattctggcagttcaacttggcgataatatttctataaaataactgtggtgcactgatgcaatacatttggaataatgaatttaatgttgagttgagctggcatggaacagttatagatagtctgggggatgtgtatgtgtagcattttttttttgcagggatagttgttgaaggttataaactataatcaataaatcttttttttttaattttcccaataattttgcagacaatctgcaaaaccgttattttaggccacaggtagaaaatgagcaacataaatttagatgatgcttctctgaattgttacatatttttcatttaagttaccccaaggctgtgtttgtattggaaataaagaagtggttttctgctgtaaaaatactgttttgctactaggcaaacagggtttttgttttgttttttattctgaaaaggtagattttatctacttttaaaattttctgggttggtactcatgactttcaaaaattttcattctaaaggacagtagatttaaagggtggatgaccttgggaagcagctttgtcataaattgataagtgcaatttaagagggagatgagtaggaataaaaactgcaacttgcaagaggggctctgggctgcattgcagtcacaagataacattgctaacttccagtgaaatccctggtgggaagcagctcaggagttatggatgcggattatgagttatgtagtttttatgcaaataagattctgggcttctcttcaatttagatttacgtttccaaacactcctagtggggctggtttggtactccattgttattttatgatgacacaaataagaggctttatccaatgataagcgtgtgattcattgctgttctgaagagctgtgagccgagtgctttggtgcaggcagcctgagatatgttgaaacctgcagtgattcagtgatgaagatatcccttgcaaggcttgaaggactattggctgaggaaagtcggttgcagcttattttcagtttttggttggtcagtgaaacactccaaacctgcttacctagctttctaaaaacaatgtagattttcaggcaggtgcagtggtgtgcctgtaatcccagctactcatgaggctgaggagggaggattgcttgagcataggggttygagaccagtctgggcaacatagcaagaccctatctcaaaaaaaaatgtagtttttaaactaaagaattcaataatggcctgtacagatttggacctccgtcctatccctagagggacattttatagacttcattatatatartatatgttgtttaaagtgtattatatgtatgtatgtttttcctattttcttcttgttagctttaaggatgaagtaggatttttaaaacagttgttaaagttcctcaaaacagttgtttaagttcctctgtagcaggccaccattcttgtcagcaataaaggtgaagaatgccccattacagaaaagaaaataaacactttctcattgttcatactttctactcttgtactaagcttcagatgccactgggcgccagttgctttccaagcctcaaggatccttagggatgttggggctttctttggtgactgttgtctccttgtttgctcaaattaagctccccagcaaaagagggaagtgaaataaattaatacatgaaaccaagaactgttactgaataatggtatatatatatttttttcttttctttttttttttttttttgacagagtctcgctctgttgtccaggctggagtgcagtggtgcggtctcagcgcactgcaatctccacctcccgagttcacgccactctcctacctcagcctcccaagtagctgggactacaggcgcccaccaccacgcccrgctaattttttgtattttttagtagagatggggtttcacaatgttagccaggatggtcttgatctcctgaccttgtgatccacccacctccacctcccaaagtgctgggattacaggcatgagccgaatagtggcgtatttaagaaagaaaggggaaattagattccattttggaattttattgagcggaaaggatagatgatttgattggaaactaaagggagatacttccagttttgtattggaagacaagttattaaactttcacgaaataatgttgatgttcatttaaatgttcttacagtttgtttctaaatgatttagtagtttatgtagggccagctatttaatgatcctttgatcattaaatatgcagttatatatctcattgggatgaatgggaatggctaggattgttactgattcttgcccctaaaaagagaagttgaattcagaatctcttagaaggcataaaaatttaccatcaccatggcattgaggaaggcaacacaggcataaagtgatctcattgttcaacctcgtcaccatttaaccagctgtttccttacatatggtggcaccctttctgagagcctgtaagtattttttatagccctaatcatgtgctgtccctcttaatcctgggcatttaccctgctgttccctctgctgaacctcacacatgtgttccctctctaactctggttagacatttaggcttctttctgttggagagacctgccctggtccttcaatcgtggcttgggctctgtgttctctgacctcttcctctgctgtattcctggccatcatgtcaagtgtttctcaaaatgtgttccgtgggaccccacccaggtgctattctccacaaaatctattctcrgaaagttctagaatggatagtaagatagctgcactacattgtgaaggtactaaatgccaccaaattgtacattttaaaggttaattttttttgttatgtacattttaccacaacacaaaaacatcttttgaaagatgtttctcaaaagaaagtctcagactcaaacatgttacacttacctcctggaggttttacaatgcatattagtaaagaatctgagatgtcttaaaggaacccgcttaattttgcttgattcartgttcccaaagctattaatagactttaagaaaatgcacaactacctgttaatgtccagctagttaatattcttagggatacaaattgtaattgcctgcttaatcatgctctcctatactaagtggtagggatgggaccatatttgtagttctagaccagagatcaggataagccttcagtaaatatgtattgaatgaaatgcttaagtgaatatagtaatatgtagaatgtggtggggcattgtgaaaggaacacagagtcacagagatcaagggttcaatcctcccatgatcacatttagctgtgtaaccttcagtgagccacttgaactctgacctttgatttcatcctgtattaaatggaaatacaccccagttaaaatggcgcttatcaaaaagacaaaataatagatgctggcaaggaggcagagaaaggggaatgcttgmgcactgttggtggcagtgtaaagtagtacagccactgtggagaacagcatggagatgcctcaaaaaaccaaaaatagaaccaccatacgggccgggcacagtggctcacgcctgtaatcccagcactttgggaggccgaggcgggtggatcacctgaggtcaggagtttgagaccagcctggccagcatggtgaaaccccatctctactgaaaatacaaaaattagttgggtgtggtggtgtgtacctgtagtcccagctacttgggaggctgaggcaggagaatcacttgaacccaggaggcggaggttgcagtgagccaagatcacaccactgcactccagcctgggtgacagagtgagactccatctcaaaaaaaaaaaaaaaaaaaaaaaaagaaagaaagaaagaaagaaaagaaaaagagaaagaactgctatatgatccagcaatcccgctaagtaaatatccaaaacaacagcaatcagtatatctaagatatctgcactctcacattcattgcagcattatccaccatagccaagatatggaatcagtctaagtgtccatcaatggataaatggataaagaaaatgtgatatatacacacaatgaaatattcgtcagctgtaaaaaagaatgaaatgctttcatttgcagaaacatgggtgaaactggaggtcattatgttaagtgaaagaagccaggcagagaaagacaaataacacatattctcatgcatgtgtgggaacttaaaaattgatctcacggagatagtgaatagaatggtggttgctagagaatggaagcgtagtgggaagggacggtgggaggagctggttaatgggtacaaaaatacagtttcatagaaggaataaattctggtattcaatagcacaatagggtgactataactaacaataatttattatatatttcmtaatagccagaagagaagatttggaatgtgcccaatgcaaagacatgataaatgtttgagrtaatgtacatcccaactaccctgatttcatcattatacattgtatgctgttatcaagatagcacatgtgcctccacaagtatgtacaactattatgtatccataaaataataaaattgtaaaaaccctcagaattaaagtttacaaattgcttaaaaaatggaaataaaagtaccttcctggagtttttgcaaggattacaagagttaatgtgttttaagtacatggcatagaaagtaccaaataagtgctagtttctttctcttcccatagaaagttaattaccataaaatagttatagatggagtgagttgggtgtttagagtgagawgactttcagctgtggggatcagggaaggtttgtggtcttatgagctaaaggattggaagaattaagacttacagaaataaagggaaaggacattgaagagagagaacaagataagcgtctggaagaaagagattagagttcagatgctcttaaaaaatatcgtgttcactttcatattttatccttttcatatatgccttctcccgggctttgaaggaggaaattggtgatgttttcctcattagacatttatctataaggatcacaaatcagacaattttcccttattttcctttttctctcctgttttcttctgctattcttaaaaatgattggatcccacccttcccatcttcagytgtagcattttgagacattgtgcctttttgtctaaaatattctatttgatgaacrgttaaactaatagtctgtgagctcctttagggcaagaatcacktccaggtttcgtctcctcagtgctgagggttgtgctcaaaacagagtaggtagggaaggaatgattgccgaatgaatgaatgaatggagaaagagtggatctagttccatgggcctaagactgaggcccatagtctctaatgtgtttatgcaaaatgctgcatggtagctgctaatagaaagcaagttctttcctccagttctgatgtgatgtgatctggcagagggcagcatgcccataaatcaacacacggtagtgtaagtcatccactggtgttagaaagttatgagtaaggccaggcgcagtggctcacgcctattacataatcccagcactttgggaggccgaggcgggcggatcacctgaggtcaggagttggagactagcctgaccaacatgaagaaacctgtctctactaaaaatacaaaattagctgcgcgtggtggtgcatgcctgtaatcccagctactcgggaggctgaggcaggagaatctcttgaacccaggaggcagaggttccagtgagccgagatcatgccgttgcactccagcctgggcaacaagagtgaaactccatctcaraaaataataataataataatgagtaaaagcaaatatagaaattggaactaattaatagttattttggtacaggatgaagtatagtctatggggcgtttatctaaggaagaagaggtgatcaaatagacaggagagatgtgttacatgtgtgtagaaaaaggctccgtatcattacatagatgagaaatacacatctgttttatggtatttttcattcaattcctcacatacttacttaaatgtgaactcaggccgggcacagattacgggctcatgcctgtaatcccagcattttgggaggccgaggcaggaggattgcttgagctcaggaattcaagaccaacctggacaacaaagtgtgaccctgcctgtaccacaactactactagtagtactactactaataatagaaaataaatatgtacttagcagtgggttgtgaatcagagggctacaaagagattatgatggagcaatgctttgggaaagtttcaacttatagggaaataaaacatacaaatctgaaccatcttttaaggcctatattaatcaccatctccacaaaatcagcttcatttagtggaaacactcccttgaaattattaacgtgcacttgaaaacttaattttgtgccaccttatagtatgtattaattgcttgctctttgagtattaatcttgtttttccctccaatttgaatatctgagattagggaccatgctttactaatgaaatgatcaataggaaataggaaatgctcctagaataatcctatgtgattcctgaagtctctaacaattaatacttgacagacacagactgttatcaacagcagaatctttggattaactttcttaatattgaagaagggtatcttatactggtataaarcagttcaatttacaaaacaagtttatatgtattatttgtatttcgttaggatctgcaggatacacatgaatgatctcatttggaaacaatggattgtcagtgtttagaggaaatgtttttcagtggtgccaatatgattcaacaattttattatggtcttcaattacattttcttccttatttctttagtattgcttctaaattcttaaagcctactgatcaatagtatcaagtgatgctcttttctattatctagattttgccatcctgaaagacaatgacatttcatttttatttttttgtcaggtttttaagtccttgttttagatttagaactaatgtctgggttttttttggtggtggtggttgttttgttttttaatggaagggaygatgggcagtgtatccctgggtgtctgagtgtatattcatcctgctaattgagttgtccattttactaatgtcttctgacagcctttcattgatctttatagttcttttctgggaaggtgagattttacagactcaaggtgattggtttaaacttggaatttctttccttctaatagatagtttttaaaaaaaacccaaaagaactaagaaactaagagttgattctgaaaattgataaaagaaagaattgttctttgtaacttcactctaaatcattataatttatattttattactaatgatttatacatgcagaaagataaacagtttccacaaaggcttattcacattcctggattttaaacctatgatgagactgtgtttaattagaggtacggcccacggcagttgttttctttacaggaatttaagaaatcatatattttaaacttgcttaagataaatctaaataattctttggatggcatgttaattaggagatgctgatatttatagattaggaattatttgtagactctgcatgcaaatattatgggtaaaaagaaccatttaagtattttgaaaataacattagaccagatgatgttgtaattataatgtgtatttgattatgaccttttacttcttacaacaaacaggatggatttgaagcactcttttctaatgataattccaaagatttaaataactttctagatttttgtaccttccacactgtataaaacacccctgtcttccctgtcaagaaaattttkggggaaaaaaaaagaaaacattgtgcacagagagttgataatgaatttaaatattactaatggaaatactttatagttatatcaactaggagggtttttttagtttgttaactcaggagttttaataaaaaattgtctctaagaatgctgtttccactgcatttacataaggratatataatttattagacatctttttcatgtaaatattcacatgagtatttcaaattgtgaaattacaagtgggtctctttccatgcatactagaagacagcagttattttggcagacagtgcttttcatacattcacccctttactcatttatggatacatgcaaatattcttattaattaaactcttttcctaatgtaaataaagatactatgtgctgatgatacagtgatgaaaaaagacctgacaactaacctaaagaaggtcacatctgggtagaaatgaacaaaacaataaagcaaaatattgaagccagtaaaacagctaaccaggtttcaaataaaagtctattggttccaaaacccacctgttttctatagcaaatacgtcaaatctttgttcatttgtgtagtgaacatttgttgagcacctgttatgtgttagaaattttttttttggtttggtttgcattgcctagtgtggcagcctctagctctgtgtggatatttacacttaaatgaattaaaacaaaataatattcttctgcttcctgtggcaaatgtgacaaccagggcatcatcagagtgagtagtggagtttgggatattctgttaatcctctgcatcataaaaggtgctgtgctggaattagtgttctgaagccataggtagcttcctctggggaggagaagtttgcaacagattggccaccttactgtttatgtggattatgtatgatcaggcatttgtacctttatacagtatgtgaatgtggaatgaacacgccatcacataattacataagtcatcaacaaatctttattggccatctgcttgtcagaaagcctcttcctcatgaataaccttagtctctaatctcaaggagctgaaaaatggttaaatagggctgggtgtggccctatttaacattttccacaacttttaatttcatttcctatcaatattactcaacaacaacaaaaaattggttttgcaatccaaatattgtattaacaacataaagttggaaactttcagctaatgttcattctatttaaacatgctttgggttgttggtgcccaggatacagcaccccaaaatatgattataggagatcagaatatacctcaaaatacatgtttttggcatattgatgattttgagctggttattttgagaaactgcaggcacaggcagggaaggaggggtattgtaaagtggaagwgtacttagcctgttaagtagagaaacaatttccataggatagggttttgtgggctggaaagataaactgcaaggctcatcgtctaaatgcctgctgttcatagagttagaacgttctgcaggagtctaatggggctgttacaaaagggtggctactaagcaatctgagactctccaagggaaagaggcttcatctctacaactgctacttcagtagaaacaggagtccatcagaaactccatctgcttatccagtgctatttgatattatagttattatgtactctttatggactasagacggagaggttgaacaatagcacacactggccttagatatgttcctattttatcttttaatttttgacttgaaatatacaaccactccggtcaaacctctctactggttgctgattttgggaatccacmgtgatctctaagatacctgcaaccccattcctacatgcagtgttaaccagcagttctcccttttactgtccacctaaggaacatgccataccacattcccatcaatagcatttcctcaccagttacagaaaagaggttgtagctagcaaaaagtaccgcccacccccaaccccctaccccccccacccccacccctccacaactgctggtctttccagtatgcaggaggtatgcttgagtaccctccaggcctctgggtttgcccttggcattactaatgtaaacactgattggtttatctgcagatctcctggttttatttttgtttatttggatgcacacatctgggcgtacatctcattaggttaaggtgagtaattccttgaggactattcctttgacctcttcttataaagtgttatttacttgagcatacccagttctcttaagttcatgtagttaatgggtggtgggaaaattggtcttctgaaaaacagagacggaagagggagtggaaatacaccccatgtttgtgttagctcctcagcttctggagtgtgttagttttaccagaaagatttgatcaacaattgagaggtctagacttcagatgtcaaaccttttgagcctgctcatgtgcacacagatacacatgaaggaggtgagctaagggaccgccaaggcggtctccgggtgcctgactgctcacccaggctgctgacggaggctctgccagacttcaggatcagaaacctaatgtcattagtggctgggagttaatgagactacggcttcaaattcagaaagctcatatgtaactgaaggctgggatgcagtggcttacacctgtaatcccagcactttgggaggctgaggcaggtggatcacctgaggtcaggagttcaagaccagcctggccaatgtggtgaaacctcgtctctactaaaaatacaaaaaattagatgggcgtggtggcctgtgcctgtagtcccagtcagtcaggtggctgaggcgagagaatcgcttgaaaccaggaggcagaggttgcagtgagccgagattgcgcctgggccacagagtgagactctgtttcaaaaaagcaaaaacaaattcagaaagctcatatgaacctgagggataacatcagartgctgatttgttaactgatgctcagaaatgctactgtcggccaggctgggctttcacaggtgcccagctgtagacgtggtgagccatgtcattgttgggtgcacagtaggtttggsctcttggggtacagtgtaaacaagacaaatattcaaggttgggctgagagggtggtggggtttaagcagagacaggcgacaaataaataaaagaagaggtaaagctcccagttaatgatgaggrccaggcagtaggggctggcagtaggccaccgtggcagggactggctgatggctgggttaggtgggctggccagtgaggcttctcacacactttagccagagggcacttggtgagcttcaaatgaaaggtcacggcaacctcttacctttttgatagacatagggtttctttagttatgtttataaatacaatccagttcaggccagacctcaaagttgattttgcatatctttattttcagttttgtttttctccacgtttactggggctttgtctagctcctgtccatactccgtatacctattctgatatatttaaaatcatgaaataatcctaccctgtgtaggaatatatttcagagaattatttgctatgtaaatgatttcagattttgtgctgtttattcttttttttttttttaagagacacggtctcactctgttacccaggcaggagtgcagtggtatgcttataactcagggcagccttgaactcctcctgcttcagcctcctaagtagctgggactataggcgcatgcaccatacctggctaattaatttttttttttgtagagatggggtctcactatgttgcccaggcttgcatttattcattttatttatattcctggaataagattacagatagggcaggaacaagagtgaggtaaagtggtggatgtcctggagatgactgaaaatcagtaacgctgtagaaatgaaacttattttcaggggaaaagtcttaagtgttaattaacaagttcatgggcagactcctgctgaactaatagaggcaaacgttcttaaaatggatcaaaatcacttatcttttggcttgcttcactgaaagcactgtaaagacagatttgtgaattacaaatttttgagactgtcaaaaattgggccctagctttccttagggggtggaaattatgatctgcttatcctcaaattatataatattgtttaatatagtttaaataatgtccttttatttgtaattaagtgaggctgggcatggtggctcacacctgttatcccagcactttgggaggccaaagtagaaggacgggttgagaccaagggttccagaccagcttgggtatcatagtgataacttcatctctacaaagaaactaaaaacattagccaggcatggtgagaagtgcctgtagtcccagctacttgagaggctgaggcgggaggatcacttgagcccaggagtttgagaccagcttggcaatatagtgagacctcatctctcagaaagtaaaaaaaaattagccaggcctggtggctcatgcctgtagcctgttgtcaggcaagggtgtgaggactgcttgaggccaggagttcaaagctgcagtgagctatgatgctgctgctgcactccagcctgagtgacagagcaaaatcctgtctccaaaaattttttaaaaatccaataaacaaaaaaacccacaaaaactttaaagtgaaaaactgtttgaagatgatcttaatgacccactatcagcatggtgagattcctctgtcaggccaccactgggtgtttatctacgtgtgtgtttctgggggctggttccattaggctgaaatgagctgggaatttagcttctcaagggccaatgccagtcatctgacttagaacacctgggtaccttgccaacttccatctgcttctctgatattatttgtcagcaatctttcaaaaataatattagacagcaccagcaataaaacagatactttctgcatgagtgtgttgggagcagaaaatgagccaattaagcattctgttttctgatgcatgtgaaacatttgtacacatggatggatcttttgaaatttgagatttgctattctttacaataaaatttaagctgaagtctctcagggctggagcctagatttttaaattatttgcattttttttttagagtgaaactctatagtaagtgaaattggccatatattttaaaatgcatgaacataacaaagttagtcattgaaaagcaggcaaaatctagcatgtatgtttttctttggatwtgttacgtcattgagtcatgtaatgagtatttaagaaaacaaaacagttctctggaatgcctgaattccatgttggcaattgggtacaataaagcatttgcaattctagtgacaaattgtactgcagtgcagaaggtctcatcgagcttagatcattcgttgccttacatattggttcagagatgagaaaataaaaacatcagagtgaattcactaggttctagggtttcaggttcaatctctgtacagaaagacttaacaagaaaatcagtagtcaccagagattatacttggcattagattacacgagatgaagttaaatgcttttgtttgggtttgaatgaaaatatgctgacaaataatgaagcaacaaataaacaaacaaaagcaacctcttcactgcagatgggctattaacacttagcattctaagctcacccataaaagctgtaaccaaagcttttttatttgattttgaaagccgtgctttgttgaatatttgatgaaaccgactgcagagatctgcagtgatgttcttggtgaatccctgttggcagctttaggagtctgtccttttggagatttccaggggttgattctcattctggggaagaggggaaaaaaagcacagtgattacaatcaaaggagtaggcaccagaatgatatgaaacactcagaattttctgccttttgataaaaatttcacatactggctagatagagcgatagttatcacatcaaatagagtaacggtcccactcttcttagagggccaagaactattcaacagctcacctcagtaagggctgttttgctgagtagtatctctgggaatgatggtgaggctatcctttcgtttgcaataacttttagactcggtgaatataawagcatgatcattcttgcctatagaacagagaggtaagcaaagcagctgtcaaatagtagttttctctaaattagggaataaatatagttctttaaaaaatttttttggaagttgatatttcaaaatatgtagtatgtgaaattgagtaatgtgatattatatgaaactgaactgatgtctgattgatccacctcctttttttttttttttttttttttttaaatttagagatgaggtcttgctgtgtcacccaggctggactgcagtggctgtttacagatatgcttatagcagccttgaactcccaggctcaagtgatcctcttgtcccggctttcagagtagctgggacaataggcacatgccactatgccagtccataagtagagttatgtgaagtcagtttagacaagaaagttctttaaaaatttgcatgttaggagcctagtcaggaaataagctgaatttctgtttcttaaagcaaaccccaaacaacaacaattccttcttttcctggatacttaccaagccaaagagaaacggattcattgagatactgatctcaggagaacagtaatcctggagcttgggctatcacagtgtgtcttggaaaaggcctgtagtggcacacaattcatctgtaattgggattagtagccctggccagctgtagagtggaggacaaatgttggcttcattccatgtcagtgtccttcttagattcctgggcattaatcgttaaatgttgttaggaatgaagcttaaagaaaagcaagtttgaacttcttcatgcagggggtgctgggttgggggagagatggagagagacactggtttagaaacttcatattagaatttttgatgccatacttttgctttgggtcatttatttgatggctataaactttgattgatggtttctatcttctcataactctgctcattgaaggtggagtcttctatttcttaagaggactgattaccaggttgatagatttccaagccttctgttgttctatactctctcttttcctgcctttcgccgagaggaatatccgtgtttcctgaggatgggggtgaaaaaatgtctatccaataatgcttgaattataattttggtgacaaaagttttcttttggggagggggaaggaatttagaatgtttagatttcacttttctctgttcttgctaaatgtgtgtgcggcataaagaacagagctgatggctgtcagttatacgccgctttcagatgtcgaatgctctacattgtctgtagacttaatttgatggtcaaatgtagttttgccttttgatattttaggcattgacttaaatatactaggaatatttaagtctatccgagtctttcctccccatgggatccaggccatttgaaacaatatggttattggtgctctgtttttgttttattcttcgtagtcaaccaaaaagaacagagttgattacatgtttcatttgggatatttattaatgacaattgstttcatctttagatcttccataatcagaataggaaatttaaataccttgggtatgtcatggttatttcactttttaaaaatagggatacaatgagatgtttgtaattatataaaatactaaattgttattaaattttagttagtgtcaacatgtattcatcattttctaaatgtcatctaatcagactctaatttactttcccccaaatatcaagagatcattctgaatttgtcttgctcatgatatggatgggttactctgtgtgattgccttttttttttcttcttctttttttttgagatggagtcttgctttgtcgccaggctggagtgcagtggcacaatctcggctcactgcaacctccacctcccaggttcaagcaattctcctgcctcagcctcccgagtagctgggattacaggtacacgccaccatgcctggctaattttttgtatttttagtagacacagggtttcaccatattggccaggctggtctcgaactcctgacctcgtgatccatccacctcgacctcccaaagtgctgggatgtgagccaccgtgccctgccatgattgcctttttgctgggtaaaatacacttttaatttcttgctgggcttttaaaataaatacggctgaaattttacattcacatttctaaatacataacatacatgaaatactttaaacaaaaaatgataaagtaagcagacttgcttggcgctctagaaataattatactatttgtatctaaataggtttctgttgtatggataattcatgtattataggcatgataacctgtttacagaaaattctaagcatgtggatctcctatcttttatgattttttcgtgtaaaagtttcctttaaaatcagctgttttatattgatttaactcagtttgggcatctctttttcatcctttattcattcattgagtgctttttgtggaaagttgttattataggtgctggggattcaatggtgaacaaagtagataaatgtttttctcccttgaagtttattttggaagatggagggattctggcgataraataagcaaacaaggtatttgcaggcagcattttgttgtaaagaaaaaaaagaaaaacacatggtaataggaagagagcaacatggaatttgggagtaaaaaggaggaaaaggtgggttaatccagttctccttttctrtggatgtgccatttggtttgagtcataatgatgaaaaggagcctgccctggaaacttctagggggagagcattcaaagcagagaagcagcaagtgccaggctcttaggcagcaggaagctccacatgtttgaaggcatcgggagggagtctgcrtatccactgtagaaggtggaagggagaggaggcgggttcggaatgaggacttgaacgatgataacactgagagctgtgaccctcctccgtctctgccaggtggtctgggtaacggcaggtgctaacagaagactggctaattataaaatacgactaagcggaaacagctttgtagcttaaaaaaagtatgtatttcatttcactctcatcacaagtctttgttttgttttaaatctttgcaataaatatttgttaaagtgcctcatgaggatacaagaaagaaatttggaaacaraagaggttattatcctgcagatatagaagatctttcatgaagacattgaggaggaagatatgacctatactcagctattgtgttgtggggctggaggaagacatggctggtgcaaaacacagaacgtgtctgagcttagaggtggttctggaaaacagaatatgtgtaggtgtaggtttctgtttaggtgtcggtggagaagtaagtgtaggcatctgcgtgacaccagtgattttcagtctgggttctgagtagttctagttcctggaggttccaggagggatattgtttatggtaaaggggaggatgaggccagctgggtgacttctcttgaaaatagattctccccatgaggtcgggagatcgagaccatcctggctaacacagtgaaaccccgtctctactaaaagtacaaaaaattagttgggtgtggtggtgggcacctgtagtgccagctactcgggaggctgaggcaggagaattgcttgaacccaggaggcggagcttgcagtgagccgagattgcaccactacactccagcctgggcgacagagcaagactccatctcaaaaaaaaaaaaaatagattctcccattaaaaaaaaatatttaaagtactctgctttaaaatgtcagtaacagtataccttttgacatgtagtagttgctaaatgattgatacagatactgatgtttttggaggtagaggactttctcattctaaaccctgtttgccatacatctagaactcactaagcctgtcctgttgatgatcacctctagaggaaatacaggtgccaatatgaataacggaatcagaatgcctttgatttatttaatctcacttctgtatactcatttccttactatgtgttagaaaccctctcagcccagtgtcttaggtaaccgttctgttgaaattttggctgatcgccacttgtactatcaaaatattaatcacatcttatctagaaacaaacaaaaatctctgagactcctctggaagccattattcaaaacctaatttcctcaggcttctctaattatgcagtgcagtgggttagaaaaaggcttccatagcttcatctgcgtctgcctcattgcttcctatttttgccacacacccagtgagtaatggtatggctttgcttcccaaacaggttaaagattatgaagytctgtgctwtcataaggaggttttcaatgggaatatctgcttttacccaccggtctttctgttttgcccccaagaggttaaaagcagttttcattctcatccattttgtgtttcctggatgttggcccaatttgccttaacatccgtgtctgctaagcagcaagtcagcttagcttggctgtgcccttacaaatatgcatatgtttgagaagagaggaggaaattaatcagagcccctggcttaaatgatctccattcttactagcactatcgggatgtaatkaaatcatggtttaattctttctgttagggaaatcttattcctttttaaccaagttcttaatgtatggtcatacaaggtgaatttaatcagtaagcagtttcattagactttgaatgttgtttgctgttgggtaggtgaagctcattatgcttcctaggcttggatccagacagacaagkttttatcattaacctagttttcatcaagggaacagtgtgcaaactgggtaccacctgtgagaagcatcatttaagaggccagaggtgagatcctagaaaattatgtcaccttgcttgtttacaggccattgtacagaaaaaacaaaaaagctgataatttaaaaacggctatttttgatcttaaatacctgtttgatttttttttttaatgaggaaaggcagtgctccaatgagaacattctcacaggcaggtaacagaatagcacacttttattaggaggggtaaaaagagatgcagaaagcaaggaaatctttttagaaatgtattaaatactaaattttcttttgctgtaggttgtttctggcaaaaccggagttttattgatggacttcctttatgtactcactctgcgttagcatgttggagacataggatttgctggcatcatctggttatgaatgtgactgtggggccccwgggaggttcccaaggttctggttggtggttcgagtcaggactcaggttttcctgtctctggaacagtcgtttgtgttataccaggccataggcacagaatggtgagtggatttctatcctaggagaggtcctttgctgtgttcaagtacttgggatatcgaatgacagaacttgtttttagagagatgacagcaataagcctgctagtatgagctgttggcaatcatatagcccatttaacccttatgataactgttaaggttgttattattattactaatactacaaaagcatgttgacttaaatttgcagatgaggaaaaagaggttcagaaagatgaatctgcaacccaggtgccttgatatagatgctgtagatacgacaaactactctttttttktttttatcagcttattgcatccagacagggtttgaaatggctctgaaaacaaaaaaggaagcaagaacccagtagttgtgtgttttcctgcttctactggggtttgaaattgaagacaattggtttgagtcctagcactgttcctcattagctgtatgccttgggcaaattacttaatctctccaaacctttatttcctcctttgtaaactgaggacagtaatagaatagaatccatctcactgggttgtggagagaattacaggactcctacacttgaaaagtggtcggaagggcacctgcacaaggtcagctgtttgtgattgttagtaatattgagattgctttgagaatacacactctgacaataaactgaggatgcttgttggaaagagtagctgggtcaggtgagtctttcaccttggagtgactgatctctttctctgcatgttaagttttctacacaccgcaaatacctgtctatacacgcacacagtttatatgtgtgattcttaattgcttggtaggcattataaaaggggacaagagcattaaaagagagtttgactttcatgataaaagattaagagtgttggccgggcgcggtggctcaygcctgtaatcccagcactttgggaggccgaggcgggcagatcacgaggtcaggagatcgagaccatcctggctaacatggtgaagccccgtctctactaaaaatacgaaaaaattagcctggcgtggtggcgggcgcctgtagtcccagctactctggaggctgaggcaggagaatggcatgaacctgggaggcagggcttgcagtgagccgagatcttgccactgcactccagcctgggcgacagggcaagactccatctcaaaaaacaaaaaaaagagtattggtgtcatttaatttaaaagagattgtttcaaggatgcttagttatgttggagtattcaacattatgagaattttttaaaagtttcatttttcttcattcaatctagtttaatatttaaacagaaggtgtatagtgaggttagaggatggtgcgtttataataaatcggtgtggcagagttttccttaagtatcttgagtttgaatctgtctttagattagtggcaacattaaagaaatagtaaataaccagtctgttcttactaatgtcrccctggcttatatcctcttacatgacctggtttcctgctgtgctagagcatcatccttagtcctttcctcctaaagtaggcactgtttgaaatgaactttgatttcaaatgcacctgctctctattgatgttggccatttgcatttatgaatcttcctccctcactgttcacccactaccccaacccctgacctctcttttcatctggcccttycctacctatgataacactcaatggagtgagtggccattgcctacttggtttttgtttccccttagacctaatctgagatttgccaatctcatgttctaatatcccgactgctttttcaaataggagttagcagagtatggtgactccattttaatttgtgctgaatatttaggagtaaactcataataggcctattctggactctgctgttagaaatactccaacaatgacacaggatcaggaatcaatagtatttgtcaagtatttccatttctagcaagggaaaaatgatctattaaatatactccacattaacaaaaaagtccctgatttatgtatgttgatcaatgaaggttaaaaaacactgttaactaaggttttctatttgcagtgttttctgacaaatatttttcctccagattttaagyrtgttatkatgagtcaacctttatgtttgtaaagccttagtcttgttaataatgtataacttccaaatgaatcatatacttatgcatagcacttgaatatgcagattttataatacaatctgaaggctcatatttttctgtttatttttaaaatgttaagtctcattagcattatattttacagatatattatgtaccatataacctctacaaatcacagtcaatctggatagtgtccccttagggcaccttaattatatgctgtagttctagaattcttttatgtggttttttagagataatttctcctctttattttccttatgaggcatcttaaaatagcaaaaaatggttgctttggaacctactgttatagatgccagtcttctggaagtgtttccagatttttttttcttttttggcctttagaacattaagtattctgtagagttatgcccattatccataaatgatttttttcagtgtatgtctgtctctatgtacctacctatatgctcatacttgaatgtgtatatgtgcaccaataacatacctgaaaaatggatgagttgtaattgttttagtagagataactgaaccattgatgtgaactctttgggatctacagcatcatccttaatgcctgtgtcataccttgtatatcattttgaatggcttttggagcttaaagtatctctgatttcaagcagagtgccctgctaaccaagacagtcccagccaggacaatatctactgggttccaggttcactctggtcttgttcctatattcctcatttccaggcagaaggaactatcacagtcctctttcctgtctcaacagttgcaatttgtaaagcctatagcaggtttacttttgtgctccatagcatcagctctgagaatgttaaacacattgtagacgtgatgtgttggaaatttaaagttatgttttctgggccaggcgcggtggctcatgcctgtcatcccagcacattgggaggcagaggtgggaggattgcttgagcccaggagttcaaggccagcctgggcaacatagtgagaccttatctctgcaaaaaaatcattagccaggcacggtggtgtgtacctgtagtcccagctgtttgggaggccaaggcaggaggatcacttgagtccaggagttagaggctacggggagctcggggagctatgatcacttcactgcacttcagcctgggygatagagcaagactctgtctcttaatgaaaaaaaaaaawaatatatatatataaaatgaaatatataaaaatatatatataaatatatatttttttattaactctggcacatagcaaatattatttcacttacattcatgttgtagaattttctcagataattttgtctaattacaactgacagcacttcctaatttactttaaaatatgctatcatttataaacatgtatggttcttatgaaaatcacaaaaatggccaaaagatgattttactgggttctggcactttgttgcactgaatagcctttgaaataaataaacccttggttttgacttgaaagttttatttatttatttatttatttttttaaaaaacacctttaatatcacagatttccttatagcaatacatgaactttctgatttctattgacttttctgattttgttatcaaactgtcaatacattctgtgccttggcaactacatgttctttaaagaagtaaaatgtttaacatttcaggtgttaaatttttgcttgggatcacagtgaaaatactgatattttgatacagttggtaaccttccatttgtgttttattgctgtgtgtctggtaaagacgttctctaagtttgtgtgaaagtgtagtagaaggttcaggaacatacagtacttcaagaaaactgtgtatctacaacaagttaatattgggaagagattagtgttttgagatgtttatagaggaggaaattatatcttgatatttactgagattaccagtgcttttgcaaatagaataactagatctttttgtaaacaaaaacgttgactttagtctatgttgtattactgttggaaatattacctccttatgaacctcataagacatggagcctggctatggtcactgttaggagtattttgctgctctcttgctggcaaaaatctttgcatgggtcctccttctggactggctactacacgatcaagtcaactgtctgctttggaatggcaatatgtcatgacatatcaaattttatcttaaaactttttttaattgttaaactttacatatttaaaataacattacagatatgtaaattatgaaagctagtcataaaatgaaaatgtaagagcacacttcccaatttaagaagcattactaactttcagtggttctctgtaagcattttcctgatcacaattcctacttcccaactgataattcctatcctgaattctaggcttattctcttgctttcctattttttaaaaactgcatacgagcatgttacttgcttgtttctgaactttaaaatgatttcacataccatgtatgtattctattgcaacctgctattttcacttagcattacatttctaaaattgatccacattgatgtttatagctatagatcatttatattcacaagtatacagcactctattttgtaaatatgcagcagtttatgtgaactactgttgatggtcattagattgtttcttttaaaaaccatgctgctatgaacaatcttgtatgtatccttctaatgtacatgtacaagaatttctttagggtttatacctagaagagawattactgagctgtagagtatgggcatgctcattttcacaagataataccaaattattttccagagttttcaaagaaacatatataaatttcttatgtatggaaaatatgtattttccaggctagcaaatacagattataagacaatgccaaatgtcttccagagttttccaatgcatgctctcagtgataacatgtaagaattctggttgttccacatctttgccatccttgatattgtcaggcattaatatttttgcttatgtaatggatgtaaaataaaatcttggggttttaatgagcatttctctgattcctaatgagctcaaatatcttttcatgtggttactgggtgtttatctttcttctggaaatgcttctcatttgtctatttggttgtcatttttgttattttatttattctagatgctgtcagtgacatgtgccaaggacatcttacttcctctaatttttggcttgtcttttccattctctttccggagttctttgaaaaggcattcttatagtaggagaatttgtctgtcatttttctttgttgttaaggcttttttgtttttgtagttaaggctcttttgtagttaaggctctgtgtgtgtgtgtgtgtgtgtgtgtgtgtgtgtgtgtgtgtgtgtgtgtgtttaaaagagatccctctgtcttctaaggtcatagagttacagctttaaaaattttctcttagatgtcaaagttggctagttgcggtggctcacacctctaatcccagtgctttgatcacttaaggccaggagttcaagaccaggctgggcaacatagtgataccctgtctctacaaaaaaatataaaaaattatctaggcatggtggcttgcacctgttgtcccagctccttggacagaggtgggaggattgcttgagcccagagttcaaagctgcagtgagctatgattacaacattgtactctagcctgggtgacacagcgagaccctgtttcaaaaaaagaataaagtgtcaaagttttgctttcaacctttaggttcttaattcaccaagaatttctaaatttccatttatgtactatgtggtgtgagatagatatataatattattttttcaaaaaatatataaactactatcctagcagtgttgattaggctgtctttgaccattgccacctttgttgtatgtgtgtttctgagatccctattttgttaaatttgcttatttctgtgccaatgtcatcttgctgaattataatagctcttataataaatgtgatagcttttagggcaatcctagctctcttcttctttaggaatgccttgagtagcaaattttatctctgctgtatggctggtaccagagaaacagaaatagaattggagcttctatgttgtttcagtcatcttcagaaatatttcagatatgaagagacatactcttagagcttgttggacaaagattcattaaaaccatgatctgctgataaggccaattatattgtgttgaactcagtctttctcattatatttcttacaggcaaacttgaagatttaccaagaaattcagaagttagtatcagattttacttgggatcaccctaggaaatgctttatgtttaggagactaggaataccttcagaagtccttgagattgtcttctagaaatggggagggagaaggaagcagaggagaagaactggtatttattgatgtctatgaataccaactgttccactgaactctttatctgcgttatttcatgtaatgccccagcatctctgagatggaattcttcttgttttatagctgatatgtgatctgggctacataccgtctctctgtatccagaatgtacattcttaccacccatataccagctgcccaccagctgcgttgctgatggtgctctggggctagccaagaggaatgtctggaagagctgagggtagccttttagagaggagataactttcagcagatgatgcatctggagaagcgtgggggaatctgccgrgctgagtctgaagaaccttggccatagccggcaacatctattgtctttgcagagctctgtgctgggactaaattctgcctgattgaccaagaaaaagcaaaagagggtcagcatgtcctttgtaagccggaagcgcagagcaaggtttcagattggcagtggctttctgatcaaatttcrggtcttgacacagcaagtgataaagctttgacccctgggtatattgttgatgggagacccgacttactgagccatgtccgtgtcgtcctgttggtaagggctgttcaggatcctcagtgatgagaattggttgtgagttagagcctgggacaatggcctgatgggaaatgctgcatttggtccccaggtcaggaaggcgaggctcctggggctggctagaggacagacaggggtgagcacagctcaggtgaggaatgacaagggaagattccacgctgcctatccctagccctcagagcttgcctgttctccctctcctttcagctgtggacactgggctgctggatgtgacttgcatttcacattttcccagtgatttgggcctgatttatctcttgattgctctctggtaaccgactctccagcctcttcatttccagtacacaacttggctttatagcccttggacactttcccaacttttgatctttcagtgcaacccttctttttctgcttagtctttctggttggctcagattgaaaaaaacccaaatatatatatgtgtgtgtgtgtatatatgtatatataagtatatatatgtatatatgtatatatgtatatgtgtatatatgtgtatatatgtatatgtgtatatatgtatacatgtgtatatatgtgtatataagtatatatacacatatatacatatacatagatatatgctattatataataaatattaatatgttaatagtaatatgctaacatgaattataccaattatataataattactaatttcaatcatgtaaatatatatcaatattaataaagtatatatttatactaattaaatatatttgattatataattataacaataaatatataactaataatatactaattaataaaaattgctaaccctctctgagcagatttatccaatatgctaagcacttttattatttatttgtttatttttttaagacagagcctcactctgtcacccaggctggagtgcaatggcatgaccttggctcattgcaacctccacctcccgggttcaagcaattctcctgcctcagcctgccaagtagctgggattacaggcacctgccaccatgccctgctaatttttgtatttttagtacagatggagttttaccattttgcccaggctggtcttgaactcctgacctcaagtgatccgccctcctcggcttcccaaagtgctgggattacaggcatgagccaccacacctggcagctaagcacttttatacattaccgtatctaatcctcacagtagcccacaagacaggttccgacgattattcctatttgaagacacaggaaaagtaagttctttactcaaggtcaacctgttggtgagtggcggagtcaggatttgaacccaggctgggagctcaagagaggctctttaacatccatgcatgagctgtactgtcactcaagagacagaccagcagatgtagaaactgctagggtgtgtcagatgagagatgtttttgatgctgtgacagagatgtttttgatgctggggacagctgagactctcatacatacaattggctctggtatgcctcaactagaaataaagcagtacataggacacgaaacccatcagcctccacatcctgtgaaaatcactgctgcacaatggctgctgagtgtcttaataggtctaatgactgtgctgcatgaatgtaaagtaggttctgtatgcaaagggttaagaaactggatgatatagttagttttgatataaaaagaaggattaatgatgaccgaatttttttcaaatctgcaattcctgtaacagctgattagttccgtgatggttaatccagacagactagcgtcacaatctggccatcaaaaagcagtgactcaccattgccagaacgagtacgtgttaaattgaattgcagtctggttggaggcagctgtggtgtggctcagcaaatgtggtcttacatttcyttttaaactataagacatttgctacatacaaaagaatgtatgttatgcatatgtagattatgtgagatgaaactccctggggtttatttatttatttatttatttatttattttgagatggagtcgcactctattgcccaggctggagtacagtggcgcgatcttggctcactgcagactccgcctcccgggttcaatcaattctccttcctcagcctcctgagtagctgggattacaggtgtgcaccaccacgcccagcttatttttgtatttttagtagagacgggattttaccatgttggccaggatggtctcaatctcctgacctcgtgatccacctgcctcggcctcccaaagtgctgggattacaggcgtgagccaccgcacccagctccctggggcttctttttaatcatataccctgcctcaccttcccttcctggaaattgtcaccatcttactcttatttcttactctcctgctttcctttatttttgccacaggaatcatgaatatattgttaaacaatctatttttagatttgcttgcttttgaactttataaaaatggtatcacatactatatattgtctttggtgacttggtgcttctaaaatacatccatggaaatccttggctgtagattgttagttacaacggtatactagtccattgtgtggacatacacaatttaaaaaatctattataatagtttttctggttttggaggttggatccagctggatatatttgtgaaacccccagagaaggccaggaagatgggaaaagtagccagaggccagacatttaggcattacaggccagcataaggagtgtggattttgattctaaatccattgagactctatcaaggggttctaaatagggacctgatatgattgaatttatgatgatttacttcattttatctttcagagtatcccatttatctggtgaaacagccatgaaaacaggtaactctggtttagtatgataagcgcattagttggtttggtgatgagtctctgctctttgccaacccgatcctgactcaggcccttctatattcaccaccacaaaacaagtcggctgttaggggcttgcagattggaataaagctataagtcaccaccaatccttctctttttcaaaatatatcatcctaacttcttaaccgtttacatgcagaacctactttgcattgatttgctagatatattagtagaatcctagggcaagctattcatgaagcatttggtagaggaggaagaatctgtaaaaagtgactaggaaagattagttggagcaaaaggactagaaccaagaaagaggaatttagaaggaggctggctttcagtgtataaagaaggcagtggctggcaggattaaataaaggctatgggtttgcaaattacagatagtcctttggatttaccagttaggaggtcatcagtgaccttttgatagtagcttaggaaagacacgggcatggaaccactgagcacctaatgaaggaaagagtattgaaatgktaatatgacgtattcaggttaggagaaagagaattctcaggtagtaaagataaagcatacacatagaaatgagttttgggggactctttggagataacctcagaacgaaagtaaaatgttgcagtggagagttagcctaatcaagaaacasagagatgactaagtgaccttcccacacatgaacacaatattttgtctcatcctttgttcaatttagagactgacctttgctaaaatgccggtgacaaggagacagaggccagtgagaagggaggacatttatctgtcaatgaaggcagctgatactagttagatttttcataatctgttagagttgagctgacaagcaaagaaattgcttcatattgcatattaatttcccgagaagtcaatagtgagaactctgaaactccagctgcataagagaaagagattccaaacaccataagatcttgcagttaaactgatcagaattaatgacataatcctttccgcatatgttgttgctataggaagccttctgggagtacctgtcctagcattgatgtgtaacccttgggcggggtaaacccagagtcaggttagctgcaatgacctggcctgccacagcagcggggagttggggaaaagcctacattccaagcaagactgagtgtggctgcaaagaaggatgttggttcccaggagcagaggactggggcagaaatgaggaggtggctgaagagtgcttcatctccctgctgtcttaggaggaacgtggctcctgccctttctcccaattatgagatgagaagatgctgactcaggtttctctgctctacatggtgcaagtttttaagtttcctcaaattacggaatacaattgacaagagaagaactacttttcgggagccataaataacctttattaaagcttaatgttatcaagagtgtatttttcagagacttacgtaactcattttctgttaaataataggcacagttgcatgacttgcaaggttttggcagartaaatagtctttgacaaaaataatacatagtctacttttatttaaaattagataacgatggactttagctatactgaagtaccatttgaggtacaatggtggacttatgaacggtctaggaggtccacagctttgtgttcatacattaatatttatcagatgataatgcttatatttttctagcataaatttattaggttttaaatttttttaattaaaagtatacagaacttactatggtcttgctgaaagtgatgtcagttttgtctttagttgagttgaaggttatcttagtyctttgtgaagagggttttttttttttggacagggtcttgctctgttgccaaggctgagtgcagtggcatgatcacagctcacagcagcctcaaactctcaggctcaagcaatcctcctgcctcagccttccgaacagctgggactgcaggcatgyaccaccacacctggctaatcttattttttgtagaggtaggatctactgtgtttcccagactggtcttgaactcctggactcaagcarttctcccacctcggccccccaratagttggtactacaggcgtacgtcaccacgcctggctaattttttattttttgtagagatacagtctcactatgttgcccaggctggtcttgaactcctggactcaagcaatcctcctaccttggcctcccaaattgctgttacgggcatgagccaccacacccggctacatagaggycctttataccaaaacttcctgagcagcactattttacaggcagtgttaacataattgtaacatatttagatcttggcatatttttcaatattggctttagttaaattttgtgctccatatatctaaaacagaactcattatctttcctgcacgtgctactttgcctctcacattctctatttctagcaccttcactcctggtcattagattggcagcccttggattcaaaagaagcatctctgactctctctcggtgctcctgtgtcagtcaaataacaaacctttgggtacttatgtgcagtggggatacacacacacagaggataagattcccttcctcataacctcctggtctggttgggacaagaagtgatggtgtgtggttgygcattctcagggtaaagcraatggcattgaycagtgctgtggaaattctcaaggctattatctctctggggccgttagacttttagaggtatagacaacaagtgagtccaaagtgagtgaaggccaagcaagcataaaccttttggctcttcctttgctgtttttgtacaccaaggttaaacagcaacatagctcctggacacttctgccacacagtcttcactgagtatagcacctgtttccttaggtgcctggctggaggattttattgtcaggattgcactgacacaaatctatccctaggtcttaggcccctgctttcttcagtttcaggagtctgagggttgtccctgcaggctctcatgggtctacaacctgggagctgatttttcccttgaaacctaaagccctcttgtaggtaaatgccacatcctgatccgtgaagatgggatattgccttgcagggctttacagctgtgaattagaaaaatgtttttctctctctctttctctttttctgtgttcctttcccagacataattactccctgtggcaaagctccctgttagtacagacagtgcatttagcactattttaacacaggcgtgatggttatgtttgcctcttttataacatgccattctgtatgtaaaaacaagtatcgtactaaggtcctgcaagagccttagtacaataatgagaaatccgcattccactgtcagtctaatgcagggacatcttagtgtctgtttaactggactcaattgaacacctggagctgtgtattgaaatggcttgaatttttaacttttatggtatcaatgatccctaattttaggccagatgctttggtttacatttgtgttttttcaactttgattccccagattgaaagatttattctggctgaggattctgggcgttccttctaatggatcagcagaagcagaacaagacccacttgcataagagtccccatcactgtgccgaaaagcacaggctgacatttccctcatgtccccagaaatcccatcatcttgattgactgttgaaaacagagagaaaagccttcaaaacataattattcgcatctccttgtggctgtggcatagctgaagcctgcagtaaattttcagcatctggatatatttgtgtcaaatagctgcagagctgataggctgcggaggctgcagcccgcattgagcagcctccagagagccttgctctgccggccttgagctccttccactgcggctttttgaggaggagacacatgcctgagagcrgctctgggacttgccctgacaagtgaagggaacttgtggaagggaggtcagctttttgcgaactctgaaagtcaaagatagaggtggctgtgttgagtttagaaagtgaatcaatgggacagttggcacccctaccttccaaattcagattagccttgtagtaaaagtatagtggcaagaatgtcacatagactttttttttttttttgaggtggrgtctcactctgtcgctcaggctggagtgcagtggcgtgatctcagctcactgcgacctctgcttcctgggttcaagtgattctcctgtgtcagcctcctgagtagctgagattacaggtctctagtagagatggggttttaccatgttggccaggatggttgtctcgatctcctgaccttgtgatctgcctgcctcggcctcccaaagtgctggaattacaggcgtgagccaacacgcccgrccgactttttttttttttttttttgagacaagtctcactctgtcactcaggctgaagtgcagtggcatggtcacagctcactacagcctcagcctcccaggctcaagcaatcctcccacctcagcctcctgaatagctgggactgcaggcatgcaccatcacacccagctaattttttaattctttgtagatacggtgtctcactatgttacccaggctggtattgacctcctgggctcaagtaatcctcccacctcagcctccccaaagtgttggtattacaggcatgagccactgagcctggcccacatagagttgtaaatcatgaaactgttctggacagaaagcagatggcagaatcacaatcttctgtgtccagagagactttgagattattttaagaacctaagtacaccttttagagcagggatttcttggatttgaatttttaggttacaatttgctttttagttgtattgcctgcaaaaaatcttaaatctctttgctgtttgtgacattgtgcatacttctcaatgatcttccctcttcatactttaacttactcctctccttgcccagatcactaaagcggcatgactcagccagcagaattgtyatcatccccaggccttgagcagctagtttgaaaaactgaaatagatctggcctcattgaatgctgttttaggtgaaggaaggtaattttgctctggcaggttggcgaattagtatgttacagctgtaaatgtatttctccaaaggtggttttctagcatcgtgtgcctcaattcagttgtttctttaaagttcagcattgctttttttttttcacctattcattcttggttaattaggaaaagacagcatctgttgtgggttttgttgtctggtgtagatgactgtttaatcagagaaggcattatgtcttgcagttagcagtttgaccctttgcagcacaggcttggggcgtgacctcaggatgtgactgcaccaaaccttactattttatagaaaatggggataataattctgatctaacaatttggatgattaaatgagataatacatgtaaacctctgagctcagtgcctggcagttatcattaggttatttaacatggattctttttttttctttttctttttgagatggagtttcactctttgttgcccaggctggagtgcagtggcacgatctcggctcactgcaacctctacctcccaggttcaagcgattctcctgtctcagcctcccgagtagctgggattacaggtgcccaccaccacactaggctaatttttgtatttttagtagaaatggggtttcaccaacatggattcttagatgacttgatctagggagtctagggttgcagcattattttgtagactcgatgcggactgccttaatattttacagcatttttattttgtcttcttgttttttattgtgataaaaacataaaacattaaatttcccatcttagccatcctcaggcatataatttaaaagtgttaaccgtatccacattgctatgcaatcaatctccaggactttttcatcttgcaaaactgaaattctgtacccatttaatactaattttcccttcctcccccgtcctcctcccagcccttgacaaccacctttctactttgtttctgtgattttgattacttcagatacttgatgtgagtggaataatacagcatttgccctcttgtgactggcttgtttcccttagcatgatattcctgagcttcatctatggtgtggcatgccatagaatttccttcttttaaggcttcataatgtcacgttgtgtatatatttatctgtatacatgacagtttctttatctgttcgtctgttaatggacatgtgggctgcttccaccttttagctattgtgaatcatgctgcagtgaacacaggtgtgcaaattatctctttgagattctgcatcttgtatatgtcttttggatatagatacccatgtcgtggatggaatatgtccccacaaaattcacatggcgaattccaagccctgatgtaatggtatttggaagcagggcatttgggaggagactaggtcatgagggtgaggtgctcatgaatgggatatagtgttcttataagaaaaggccagagagctagcatgctgtctttctgccatgtgaagacacaacgtaaaggtggcagtctgccacctggaagagggcctccaacagaaattgaccattctggcaccctgatctttgtccattctggcacagtgaggtctctaattgtgaaaaataaatgtgtgttgtgtgtaagccgcccagtctataacacctttttatagcagcacaaactaagacaacgtaaaaatgggattgctagattgtatggtagttctattttaatttttgagaaaattccatactgttttatttttatttttttttttttgagacagagtttcactttgtcacccaggctggagtgcagtggcgtgatcttagctcactgcaacctctgcctcctgggttcaagtgattttcctgcctcagcctcccaagtagctgagattataggcacctaccaccacgcccagctaatttatttattttttatttttattttttttagtatagacagggtttcaccttgttggccaggctagtcttgaactcctgacctctgatgatctgcctgctttggcctcccaaagtgctgggataacaggcttgagcyaccgtgcccagccatactgttttctataatggctgcaccattttacattyccaccaacagtgcgtagtgttctgatttctctgcagccttgccaacacttgctattttcctttctgttgatagtggccatcctaatgggtgtcaggtgatattgtgattttgatttgcatttctcttattgaggtattgagcgtctttttgtatgcttcttggccatttgtatatattctttggagtattgtctatcaagtcctttgcccatttcaaaatcagggttttttggttgttgctgagttgcagaagtttcttattctgggtattaattccttatcagatacagttgtctctctgtgtgttccttatctttggattcaattaactgcagattgaaactatttgggaaaaaaaccaatacaaataacgacacaacaataaaaaatacaaataaaaaatactgcctaacaactatttatataacagtcacatggtattaggtattataagtaatctagaaatgatttaaagtatacaggagaatgtgcataggctgcatgtgaatatgacaccatttgatatcagggacttgggcatccactgattctagtatccattggttctggaaccagtcctctgaagatgccgagggatgactatataagatttgcaaatattttcccccattctgtaagctgcgtttttactctgttgactgtttcctttgatttgcagagggtttttaagtttgatgtagtcccagtttatttttgtttttgtggcctacgcttttggtgtcgtatccaagaaatcattgccaaacccattgtctggaagctttccccctgttttcttctaggagttttatagtttcatgtgttagtttaggtctttaatccattttgaattaatttttgtatatggtataaggtgtgggtccaatttcattattttrtttgtggatatccagttttcccagcaccattttgttgaagagactgtcctttccccattttgtagtcttggtacccttgtcaaaagtcattggccatatatgcaagggtttatttccaggctctctattctgttccatcggcctatataagtttctgtgccactaccacactgtctgattactgtcattttgtagtatgttttgaaatcagggagtatgaggcctcagctttgctctttttcaatattttttggctatttggggttccttgagattgcatttgaattttatgggttttttttttttcctttttctacaaagaatatcattgaaattttgataggaattgcattgagtcttgactgtcttagattttatcgggaagaagctgtttaccaggctgagcaagaaatgtgagctgttggatagaaaacacttcttttgctgcggaggggcttgcgttgccaagtgcgtgttccgattgaggctggataaaagaacggcacaatcaaacygtgcagtgcagtctgtgaacaaattgtctccagctcgaaatgatgaaaagaatattttaacaacttttgacttcatttaatgatctaaacagtgattatttcttattcttgctgagaaataccggttttatgtgaaaaaccctcaattaacaatttaagatagcaaatgactaatggaaatttttgccagaggaagaagtcagataggagctctctgttkttgttgctgttgttacttgccaaataatatttgctacatttttgggtcagtaatgaggcttaagtgagaataagtgggttttgtatatctaagtccctaattaacaacagtgatacctttttgaattccttccatggtcttatcacctgctgtgaagtaggtgaagtaggcagaacaggagtttttggaaaatattcagtatgaagatactgagcttagagaagtcaggtgatttgtttgaggcctgatagcccacagggacagagccaagacttcaacccatgcatcacaatactgcggcctctgctttctccagaaaaaaaaaaaaaacattttcttattttttcaaaattttatttattgttttgagacagagtctcgctctgtcacccaggctggagtgcaatggtgtgatcttggttcactgcaacctccgcctcctgggttcaagcgattctcctgcctcagcctcctgagtagctgggattacaggcactcgcccaccacgcccggctaattttttttttgtatttttagtatagacggggtttcaccatgttggccaggctggtctcaaactcctgacttcaggtgatccaccggcctcggcctcccgaagtgccgggattacaggcatgagccacagcgcctagccaacaaaaccattttagatagcatataatamatttattagtaattccaaattctgtgatctcacttaatagaaaccacacattctactagtaggccaattaattagccttaaggcattgcctttacacaggagtcaaaagattatgggagacattaatcatcttaaaattccagaaaggaaggtagagggcatttattttccgctaaggggtttagaacagagatacgtaacttaagtatagcttactaagagccagttgttttgatttttattttacttcatttaaatgtgcttcttcaattaatagcagtaaatactcatcaatatgtatgatctgtgatagtattctagataatatatatagttaaattatttgatgttatttagaatccaaacctaatgacacagataaagcagatgtgtttttcagtatccttccgaatcccaaatccgtgggcaaggtaacacctgtttggagtttctctaaaaattacctttctctgcctttaaaaaatatcttgaatgcggccaggcgtggtggctcatgcctgtaatcccagcattttgggaggccgaggtgggcggatcacgaggtcaggagatcaagaccatcctggctaacatggtgaaacctccgtctctgctaaaagtacaaaaaaaaaaaaagaaggccgggtgcggtggctcaagtctgtaatcacagcactttgggaggccgaggtgggtggatcacgaggtcaggagatcgagactatcgtggctaacatggtgaaaccccgtctctactaaaaatacaaaaaatattagccaggcatggtggcgggagcctgtagtcccagctactcgggaggctgaggcaggcgtgaacccgggaggtggagcttgcagtgagcagagatcgcgccactgcactccagcctgggcaacagagtgggactccatctaaaaaacaaacaaaaacatcttgaatgcttttgagtgactccttctaacttgtcacaatggtgatgttcagtgattaaaatgtggaatcctgagggagttcattgcatgtcacaaatcagtacttctactcccctcagcactaagcattgaatactgcttttttttgaaggggtgagggggaagaagctgttttaaattgcagatgtatttggatttcttttttatgtaactcacatttcttattttccaaaagctctggaaacgagttgcatatttccactgatgtcaaaactgatgatcctcacaaagaagcacaaatatgatataaaactataaaacaaaaatattgatagcaagactttgaccagattccagaagaatgtatttgttacatctctgtcactttttttcctcactgcatttctaatagtttaataaaaaatctcttatgaagaaaagattgcctttctcttgcgtcaaacattctcataacttttcattctatcttgaagttttccttttttcttctaaactttgaagaaacagaatccttttgatgtctttgagtatttgccattgattagagcacttggaaaggaattttgcttggaaataaatgtcttttccctgcattctaaatatttcctttgcataaatgcatttcatttcttcttttcttgaccttgacatagttgctggcagagtacagcaaggaactctatgaattttgagttccttggcttctactgatttccttttcttatcctggacattcagggctggcttggagagacccggattagaaatctagagaagaaaagagattttttggctgtcgcagttctatcaggcacaaagtcaagaatattaatgaattcattatttataacccctttgttggacccaccgtactatacatgagtgagaaacagcggcaaggagctcatagtgcagcctctgagattcccgtgtgggagaggtaggcctgggaatattgagcagtggtggcaagtccaggagaacaaggggcagaatccagggcaggtggccgagacaggaagggatcgggagggcccagagcactagaaaggcaggtgctggggtgacagagttaaggaaatcaatactgaccaccaatatagacactgcccaccaatgtagactctgaccctgacccagaggcgggtccatactcctgtactgaagtaggggagagcgagtgagcagggctgtcagaagtgttcttgtgggagagaaagatgacaaagcatctttgcttctccttgaggctgccaagaaaagccaggagtttgaagaggttttagctgtaagtttccaaacatcatgctgtcttcaattgaatctttccttggcatctagaaaggtggctgaagaatagtgggaggaaacctgggctagaattttgctttctgtaggaattacctgaaccgcagtttcttcataggtaaagtgaggaatcttaagaataggatgatgtgtgtacaagtggctcacacagtgcctggcacctattagggcatcactaaatgtttattcactgacctgtgaataggtatgttaagatttttccaaactcttttaggtcttttattactgaattcatgatcataaacatattttcttataattttcctaatgtttacttttactagaaaagttgaacgtgctcattgtatacattttataaaatgtaaaatacagaaaatacagaaaatgcagaaaaataaacttcaattctgaaagtatttaatttaaagtgaaaattaaatgacccaatatctcggcacttagcaataaccagtcgctcgtgttgcccaaactggagtgcaatgatgtgatctcggttcaccacaacatccgcctcccacgttcaagtgattctcctgcctcagcctcctgagtagctgggattacaggtgtgtatcaccatgcctggctaattttgtatgtttagtagagacggggtttctccatgtttgtcaggctggtctcaaactcctgacctcaggtgatccacccaccttggcctcccaaagtgctgggattacaggtgtgagccaccacgcctgagccaccacaccaggcctccttcaatcttttctatacattcattaggaagtgttctctatttgcctttagcacatatgtatgcatatattgaaggagtgtggattagtggttaacaartatcatatttggcatcaaattggcataggctctagtctggtcattgtatacccttgggttagctatttgtccccttttgacctgtttcctcatcagtaaaaggaggtaatactgcccacttcattgtgcagaaatgaggaataaatgagaatatatgtatagggcttaagaaattacccgggaagtaatgagcactcaaccgacgttaacattgcttattattgttgaattgtgaatattaatgacaaaaacaattatatgagaaaggtgctttataatttcagtgttaaaatagccaatgatcttagcatgtcttgtccggcatgttgtaaaacatttgggtattgaagagttcctgaaagaaattcatgcgaccttttaaggacatcgtagcagtgctttgctttttataagaaatcattaattacaaatgtcaagttaatggcagcttaagaaacaactgagtatattgtggtctaggaagtgtccttttggtaggcttttcatgttctagtaacaaattatcttcagaagcatttttaactacaataaatatattgagacaaaatttaaaaaaattttggagtcagataacttgggtagaacatggaaacatacttgtctggctctataataataaaattgccttctatgttttatggtataccttgtgcttttcaaagtgttttcatttgcattatcttattcacttctccacaaaattctaatagctagctagatattaaaatgacaatctctaatttaaaatttttcttctatgtctttgaaaattttctaggttttacttttcataattgcttattgactccacttagaatttatttggggagttaacttcattttttccatattgatagtgatttattgttgttcatttttaacctgattattttatatgtcagctctgacatatatcaaattgtcctacacttatggatctcatttgatctttgcaagtctgggccagtatcacattattttaataactatggctttacartaagtcttgatgagaagtactctaccttgctttcatttttaagatgttcctaactattccgggcactttgcattttgacacaaacttaagaatcagcttgtcaaagtctgtaagatacacagtcagtattttaattggaatggcattgaatttatgtatcaatttgggagcagttcataactttataatatygagcctttctatccataaacatggtatagctctacatttattttgttcctgtttaaagtaactgataaagttttataattatattaaaaaattcttatgcatcttttgctatttatattcttaagtgtgtcatttttttcttgctgttgtgaatggaatctttaaaaacatatatgttctgtttgttcctgaaatatattaagtaaagtgatttttaaaaatatactggtcttatatttagctaccttgctgaattgtcattcarataatttaccgaaagattccatagccaatcatattgtctgtgaataatgtcttttgtaatcctcataccttttttattgtcgtttcattgcactagctcataccttcagcacagggttcaacagaagtggtaaaaagcaggcattaactatgatatttgctataggatttcaatacactgtatcaagttaaattcccattcatctcaatttactgagttttcataaattggtgtaaattttattaagtacttttctactttcaccgaacttaattttctgtgtcttaatatcttaattgtatatttcttaattatgtaatcatgtaatattcagatattgaggcaaagacttttccagatgaaaaagacctaacagtttttatcacaatgaggaaaaggaaccaatatgattaattaagcaaattactgaaagatgcacttacgtgggtgtgataataggagcatatcatagttgatgagatccgaagtgatgtcatcctgtaggaatgagggtggaagggattgcatagggtgcttgaagaagtggtgaatgtctgaactgcagtggagggaataggaagcaaaatgaatagaggtagtgaacagctacagtgtacttaaaattacatttttaatagcagctgttggtagagtcttagcagtcctgctccatagctggagtttgtgggcagaacataggaattcaggtagttggattgatctaaggatgtgagtttgcaagctggttgtagcacaggggagggaactactgagggaactggtttgaaaaagcagctgatttggtcaatcataggttggcaggatgtgctgcttaaggaaggaaatggaacaggaacaggtctgatacacatggacatatttttgctaatgaggcagtgggaaagacggaagaagattaggatcagatggggggaaattcaagtagaacatttcagagagaatggcccagtccgggttatggccatgcactttggagtttttgatagaatggtttccagaaagcactgtagatgagtcagttctggtcagactgcctgaaaatgaaatgaaccacttgttctcagctgtgataaatacagttttattactgcaggactatttagtttatgtgttgagtctactaaagtgttgagcagttatacaaatgtattgctatctgaactatgcgtcattttcatgaattgtggtgtgcggtgttataaaatccttgcattttatagcgattagatttttagtaatctttttaagtatgtttgaatatagtgtttccttgattttttttttttttttttggtatggaagtattttcctttgaattccttatcgtatgctagtttgtacctctttagcatttaggagaaatgctaaaggagaaaatctttgtttcctcaaatagtttttcactctgagaaatgttgaaaaatgtgaagaaatagattttcagcctggggaattatttattcctggcaatttggcatgaacttgactgctcttagagagactatagtaagtggtaaataaataatcttcccattggattcagcaaaggtcagaatctaatgaggatctagactttattttgaaatccacaatttttagggccttggaaaacttgcaaaggattcagaaaatcactgtggaagaaaaaggttttagacatatatattttcttatcttttttttttttattttctggagaagtaatagtccatgcgtgaattaagaaagattttcaacaacttgaaaaattataggctaaccactttggttaggttttcttcatttgcaccaagaatttaacaaacttaattaaattcaggtcaatgccatgaaaattattgtctggttaatccggttatgatcaatttgataaatgcaaacttcaaaggtggttccttgccggggtcctgcagagtgtgtgaaacaaaagtgagatatggtttttgccttcaaggaaattttgctatcaggatagaggtgcgacattctgtattagtcagagttctctgtagggacagaactaacaggatagatgtatatatgaaggggaatttagtaacgagtgctgactcatacgatcacaaggtgaggtcccacaataggccatctgcaagctgaggaacaaggaagcccgtccaagtcccaaagcctcaaaagtagtgaagccagcagtgcagccttcagtctgtggccgaaggcccaagagcccctggcaaagcactggtgtaaatccaagagtccmaaagctgaagaacttggagtctgatgtttgagggcaggaarcatccagcacgggagaaagatgggggccaggagactcagcaagtcttgtctttcagcctttttctgcctgcttttattctggctgtgctggcagcttattagctggtgcccacccggattgaggatgggtcggcctctcccagtccactgactcagtgttaatcttctttgccagcaccctcataggcacacccaggagcaacaatactttgcatccttcagtcctatcaagttgacactcaatactaaccatcacacattcattggtgaaaaatcagcaatataaaacagcatatggttgcataaattctcaggattctttcaactgtggatctatgaaaactaattttatatctgaaaacatcatctcatatgcatggaaaagcctgaatattaatgttttctactaaaaattaaatgatatgttatctacactgatattaaataaattccaaattgtgccaatttgaatttacatcagaaatgttcgttaattagccgagttttgtttattataatatttctgtagtacttgctgtatacctgtactaagttctttacaagtgatagctcatgtcacctgtcttaggaactgtatgagataggtctgttactatcatcactcttytaaacataaggaaaccagacaggttaagtaatttacccaaaatcacatacccaatatgtggaggagctaggatttgaattctgccagtctaccttcaccaggctatgctgcctctttatttttaatagcctcagttttattgtttaccatctgtttgcaattttatcctttaactgccccaaccattccattctttttttttttaggtagagtctcactctgttgcccgggttggagtgcagtgagcatgatcttcattcactgcagcctccgcctcccaggttcaagtgattctcctgcctcagcctcccgagtagctgggattacaggcgcccaccaccatgcctggctaacttttgtatttttagtagagacggtgttgcaccatatttgccaggctggtcttgaactcctggtctcaagtgatctgcccaccttggccctccaacgtgctgggattataggcgtgagccactgcacctggccccattccattctttaatgaatgaagtaaaagtagatacgaatcagaaaataagtaggaaaactgmagattctggggggattacttttgccattctcgggcatatttttaataatggtgagcaaattgatactttgggttgatacccctctttcttctctggccaaataagagacagaaaccacagaaaacagcatagtacattttctataactgtagtataattttgagtgcatatttctttgaatttggtttaaaggaacctcaaattttccatcgattgctaaagttatgtgttctgtgactatctactttagttgtgattctctcagttgtttgcttaggagtctcatccagtatagtgatggagctgggatatcaatcattcaggaaactgactccatcagtgtgtcagtcacataagagtaatcaatgtagggttcccaaatctcattacttctattccttctgctgtgcctatggcacaggatgacagttttggaaagacagtaagggtaatgataagaaacatcaaagtatccttttcttgagttctgattttaaaataagcctcatttagccaagaattgacaatgactagaccaagacatgtttgacctgtgtctgtcattagcttcctcagtaactgaatgaagaaatcaacgtcacctgatacctgttaacttctaaagtctattagtgtcacattgaggtcctggmactgccctcactattattcaaggtcttgttttactggaagaacttgatctcgacggctatctgcttttgtttttccctaatagttctggacagatatgttgatttgtaacatcagatgagatgcacacgtgtgagtccagactgaaatagctttgtgagtcttgctgtgaaatctcatttgtgtttttctggccattccagggaaattgcaggcagacatgggtaggatgcttttcttctaaaaacttgatgtattagatatgaaattaattattggcccctagtttcagtgcttagagtaatttagggaagcccattacacaaactggcattagcatcctccccacctccttttatcatcgtcattatcatcattactgaggttgaaaaaaagacaccactttctgggtggaattttcactggatgaggggctcccagggctgctgaggcctcactcctcctgtggctctctgatgactctggcattggactcttgtcgggaaggctgatgacagtcccattgtgggctcccattatctgttggagatggactggaaggtgacgtatattcaggatttgtttgataggcaccatttggttctatctgagttattttatcatatctactgatacactgaattacttgccagatgaatcaacaaaggcctatctcaatttggatggatttcctcagagaagagaaaggcagctctagataaatatgagtgcaagataaaatgttcgtagagaaatgggagaaatagggctggggtagacagaaaccttaatgtaggattcaaaagatgctatttgttactatgaattttattgtacacaaaaaagtagttttatcctaacaccattaaaatatgatatttacttatacaatttgcattaacatttccctcaaggtaggcatgtgtgcctgatatgcctatgaatatatttttgtgtctgatgatagtctcccatttctttgtcattcatttcttattgcagtctctttttctacctctttttgagtctgagcacttgaacattgggaatagatttgatggtcacttrgcaaaatctcaatttccctcagtgcatgtcttttacaaattatacctgtactttcctttaaacaacattttttttttcagtcagggtctcgctctgttgcctaggctggagtgcagtggcactatctcagctcactgcaacctccrcctcctggcttcaattgagtctcctgcctcagcctcttgagtagctgggattacaggcatgcatcactgcacccagctaatttttataattttagtagagacgtggttttgctatgttggctaggctggtcttgaactcctggcctcaagtgatcaacccacatcggccttccaaagtgctgggattacaggtgtgagccaccgggtccgtcctttaacaacacctttttaatggaaatcttgttctgaacagttttcgttccagcattctgaagatggcatctgcatcttctgagcatgcttcttcctcagccgtttcctctgggctctgatctctttgctgtgtggtggaagggatggaaaggagggaaaggacaattggaaccagcaacgcaacattgtgaatgctcagcccttccaaacaacatagtcaccatagaaacaactttctaaagtaacataataacattttcttgaaaagataacctgtttgccattcttggaggcaggggaggcagaggcccagacatgctgtggcccagacagcagcttctaagcggatggagcctgaacccacccagtttggacaaagaagcctccatactccctgtgaaaaagatttccagaagctgttgtgaaaaaaccaccatcaccaccaccacacacaccccacccacccaccaacactaaagatcattcttgagtctgatttgaaaactagggtcacatgttatcaggttgttttgtgtattaaatgggtgttaatacaggtaggttacttagaatagttcctagggtatagtaattgtgtgagttttagaaattgttgttattattgctgtttagtgtatattattcttaaatgtttataaaatgacaatatctgatgttggctaagtagaggaaatgagtattttcatacattgtaggtaagagtatatattggatcattattttgggaagaaagttttacaatatgtctcaaaagtcaaactaaatgaaatctttaataaataaaattctactttgggaatttaaccaataatctatacaattatttgccccaatggatattcatagcagtgttacttacaatggtaaaaagttagcaaaaacttgrcctccaggtaaataggtggtttgaatttattcattgaatttcatttactttctaagcttcattaaaactgtagtaaaaattttttttttattgagggaaaatttacacaaaggaaaatatacatatattaaatggacaatttgatgatttttgagaaatgtatacacacatgttaccaagctcctaatcaagaatatctccatcctcctagaacgtttcctcttgccctattccgtgcagtctccacctccatggactacactgttcagattcctctcaccatagattagttttccttgttcttcgacttcacataaatgaaataatacagtgtgggctcgtttgtgtctggcttctttcattgaagttactatttctgagaacccattcatgtcattgttttgttttgtttttgagatggagtcttgctctgttgcccaggctggagtacagtggcgcaatcatgacgcactgcaaccttctcctcctgggttcaagtgattctcctgcctcagcctcccgagtagctgggactacagatgtgtgccaccacgcctggctaattttgtattttttgtagagacagggtttaccatgttggtcaggctgatctcgaacacctaacctcaggtgatccacccgccttggcttcccaaagtgctgggattacaggcgtgagccaccacgcctggcccatgtctttgttatatcagtagttatccctctacttttgattcccatatcctctgtccctttattgttgagtagtgttctatttttgaatatactagaatttattttcctattgctgatactgttgttgttgttttttgactgtcatgaataaagctgttatgaatgttcttgttaccaaaacaaaaacaaaaacaaaaataaaaaataaaagaaagaaaactagggtcgaatcctgcaaatgcattcaggtgacggggtcccaccctaacagccatgtcagtagctctcatccatcacgcctgggaaaatgctccattccgcattccttagctctggttctggtttcagacttcactttatattggcggggttttaaagctagaggagtmtttacctacttactcttatgtacagatctgaatatggaggtcaggaggggcaaatgacatgtcctaagtcagaggagattcaacaagaaaaccagacagtcaacgactgagcccctggcatatgctgggcattggtgagctgtagggatgtggtgatggagaaaacagagtcccttcttcaaggagctcaatccagcaagggaggcagattctttgcaggcaggaccaggcttccctacagcagaaggaaactaaatcagggtaatgagcctcagcagggacgggcctccccactgccctgagaggacacagggctgtggcatggycctgctttgaccggctagctgtgcagtagggccaggtggggcctggagtggcctgagctaggggctgacatgagctcccccaaggcactgcataagtaacgttagcctctatttgcacagcaaaatcaaggacatggttttctagaacacaggctgcaccctctcccccaagcctagcaaatgggctacgctggttggtgggcccttgtttgtgacagggttggaatacaccacagggttccgagtgctgagttgtggcccacaggtgactggcaaggggaggcagagctgtagagcccttgggagccatggagggcttgctgcctgccacgaaatgctctctcagcagctgctggtccagctgtgggcagccgtacaagctgtttacagcatcctgggacaggtgcttgcaaacatatggatgccatgggggatccgagcctgcagtgccatggtggcgtttgtggccaagagactatgtgcaatcagaaggagggaagagctggcccagcagaatttggtccagggtgagggccacagaaaggtcagaggcaggatggggctggcaccyaggctggtggtggcctcacatcacctatgcctgaggccagtcctggattgccccagaagaaacaatttctttactccaaagaaatccaaaggagttaaaaagtgagagcccaaatccartctgtgctcagggagcaggcctctctgcagggggcaagggcacggctggagacggaggtcctgcagctgcagctgaggcccccactcttcctgcactgggcagagagccgtgatggggcctcagcaggagtgcatggaggaggacscctactgtctggacctggaccggaggcttggcaagatgcaggacaactggaagccgtgagtcagacccgcgactggctcaagaagattgcacaagacctggtctagaaattggagaagttccagygggagatcctcttccacgaggaaatggctcaggaagtgtggatggccaccgggtccaccaagcgggtgctccrggagctccgggaagaatatgacttcaagaggcagaagccggctcactgggaggccaagttccagcctttctggacagtgctttggctcctagggctccagccacagtctgcagggcctggaagtaccagggggaccgtgagccactaggacccccaggagggaggtgagtcatcacctgagggcttgggtccagagcatctacctgtttgattccattttccctgcagccaggtcctgaacaccctgaaactcggccgaacatgagcctgagctgctccctcgaaaacacttttatctcttgttactttaggtaccatttattaattgaaactgaaattgttcttagtgaagttggatagatagcrttaggagtgtaagatactgttttaccaataaagattgttggatgtaaaaaagaaagtttttcacacttgtttctccataataattcaagtacttctatttgcatttgtgtcaaattacatccctatacatataatactaaaagacttatttatatgtttacagatacacttggcattgtgtcatactattatatttatctcataatttaaatgttaaataatattgtgtcatgtagatatgctttaatttatgaacttaattccctattgtgaactatttagtttgtgtccattctgtggctattgaatactgcaaattagtttgtttattcagaaaatcctcattcgggcattcaccaatctactattggacactatcccggccattgcatttttatggaagaagcctaacattgaaaagactactgataatgagttccatgggaccagctgttacaggaaaagtagtttttgtggaatattttaggttagtttacctaaattcctatgagaactgtcctttcaaaatattcataacgggctatagaacaaaatctatttattcacttgctgtggtttgaatgtgtttcctctaaaattcaggtgatkcttggctgggtgcagtgtttcatgcccgtaatcccagcacattgggaggccagatctcttgagcccaggagtttgagaccagcctggacaacagtgaaaacctgtctctaccaaaaaaaaaaaaaaattaaaaaataattcaggggttgccaatgcgatagtattaagaggtagggcctttaagaggtaattaggtgatgagagctcctgccttatgaatgggatgaaggcctttaaaaaaaagtcttcatggccaggcacggcggctcacgcctataatcccagcactttgagaggtggaggtggatggatcacttgagggcaggagtttgagaccagcctggccaatgtggtgaaaccctgtctctattaaaaatacaaaaattagctgggcatggtggtgggcacctgtaatcccagttacttaggaggctgaggcaggagaattgcttgaaccgaggaggcggaggttgcagtgagctgagatcatgccatcacactccagcctgggcgacagagcaggaggcttcatgcagccttcatcttcttttgcccttctgccttgagaccatgcagtaagaagccctcaccggatgccggctccttgatcttggaattcccagcctccagagctgtgaaaaaataaatttctgttctatataaattaccctgtctcaggtattttattttagcaaaatggactgagacaccactagtagaatagctatcctctaaaacaattttcatccttttcagcctggcacataactgcaaaacaatagtattaggttggtgcaaacgtaactgtggtttttgcaattacttttaattgtaaaaactgcaattacgtttgtatcaacctgagagcatattaatcttttcttgtttttcaccttaggtggggtctttgaaactagctggagagtattaggtgctgaaaagagtataaggattcagatttgttccaggtgaggcccacacagctttcacccactgtacctcccaggatgaactgatgttggttgaccagcgggagttgtggtaatagttcatacacaagggcacgtttgctctgttgcagccagcaccggcacaccatatgcatgcattttgtaattgttttcgtctgaatgaattaagatatatgttgcatagctgatcattttgaagttatcgctggtaaccattgagccagagacaaaaacaggtgctatcctcatggagtttgctgattctaggatttcttgacaatagggatgattttgagtgttcaagacatcaggctaatgtgggctgctgagtgattgccttctgtgtgggtttatgtgtgtgttttcctctgctgaagcattctatagtctacattacataaaataagatgttccatgtgatttcctttgaagaatgcttgagtaatatagctgttgaactagaagtgctgagcagtatatgcttcttgggatgtcttatgtaacatttggttggatggacctgattttcaaaatgtcatcatcttaaaagttttatttctgctttatggtggcataattgtcaaaaattatatatattcaasgtatacaatgtgatgttttgatatacacgtacattgtgaaatgacgaccaaaaccaagctaatgaacgtatttatgacctcacagagttaccttttttctgtgtgtgtgatggaaacacgtcagttctactctcttagcaaatttcaagtgtccaatacagtgttattaactacagggacccaycctactgtacwttaggtctccagaacttatttgttttataactttaagtttataccctttgaccaacatctttgtatttyccctcgctatgacccctggtaactaccctactactctctctcatctgtacaaccaaatgtgtgtgtgtgtgtatatatatatatatatatatatatatatatatatatatatatatatatgtatactgtaattgaactatgattcagccatgtgaaaattttttaaaaagtttaatattaatataacatatgtatgtaacacttatatataaaaatataggtatacatgtgttacagcacacataatgattatatatgtgtaacaggatacatatttatatatataaatgtactgtaattgaactatgattcagccatatgaaaaatattttagaaagagtttatgcatatagaagtgctaatgatatataaagtttaaaaaagacatgcattatatgaacaagatgattccaaattcagttttgaaaataaaagcataaaatatacatatatttagatatatctgtatctagctacatcacatttgctctatccatttatccattaacagataaatgatataacaggtctttacaaattgcatataacatataggtatatatgtcttatttacatatattaaagccttattctgatactatagttatggtacagtgtaaaatctgcatatatgtgtgtgtgtgtgtgtgtgtgtgtgtgtgtgtattttttttttttctttgggaagtgtgagtccaagtgatttgaaaatgccagagagggctgggcacagtggcttctgcctgtaatcccagcacattgggaggctgaggcaggcggatcacttgagttcaggagttggagaccaggctgggcaatatagccagaccctgtctctacaaaaaattttttaaaaattagccaggtgtggtgatgcatgcctatagtttcagctacttgggaggctgagttgggaggatcacttgagcctgggtatttgaggctgtagtgacctatgattgtgccactgcactccagcctgggtgacagagcaagatcttgtctcaaaaaaagaaaaagccagagagccaagtgtgacagccctaatacatgttcaggattttagagaggttgtgcatctctttctgtgttttaaatctttgtgatatttttaatgagaaatataacatgtagaaaatttggaaaacacaacaatacagacagaagaaaataaaagctacttgcaattatgccacccagagataaattgctgttgatatttcacatattttattccattcatttttctgtgtatctgcatatattgttcttttatttttaaaaataaatttggaatcatcctgctcatgtaataaatgtatttttaaactttttatatcattagcatttttatatcaataaactcttttttaaaaaaatttttaacatggctgaattctaattcagttatagtacatttctcttccgataattttgggactatttcatattagagaatcttgtctccttgtcttagatgctattttaccccatgtatccatttttgaataaaaagagcctgtctttaacaaaggtctgttttttttcttgagtactcctgaaatctctccttggatctggaggtcaaattaatatagcaatccctggccaattttggatgtctcatttcttgtatctctcatgcatggctctggggtggatgttggactgagtcagggttttctcttgcttctcttgtgaggggatgctcctgttttttctgtctctgccattccattatatgctggtcctataacccaaggcccatagactccctggtctttgttttttctcatagtttgcatcactgggtgccgtgtgttggtcttgtgacaatctctgcaaagaagctctgatgctggytgggtgctgtgtgttgtgggggtgggaacttatcccrctatcttggaaagcaggcaccggggaccacaggtaggcttagattcctagggaaggcagcactaggaccatccaggccaaagttcagggtgattcctcagggattgatacctacttaattggtattttacatcttcagctggtttacctttgaagcttttatgtgttgtcatggatatttctgttggaaaatgtgggatggcaaatggagcttagcgagttagctgtcactgccgcagagacgtctcacacagatttgtcagggacgatgtttgggctgctgggatagtggcctaattcagtaccatgttcaatctcagcctgtgccctggataccgcttaggttattggatggcattactatatggtgacacggacgcggatgcattttatctttggtgagatagggcacagaaactttaaaccttacatgtttgacagcwtcacagagtacaaagctcaccgtggctcttttcaagtacagccccattccatggcactgactcaggaagcttgtcatagactgtgccagtatttagatttgactatatgtgtacaagttatcaatgtgctctgcagtgatggtacagaggctaagatgtgtaggcatttgttatgctctttacaagatatctttgttagcatgataattttgcatttgtactctgaacaatcttctgatttttttcagagttaatattctttcaggtgaggaaatgaaggtttagatagacaggcttgctggagttttcccagctagtacgtggtacagctgggatgagaacagagattttcctctatttagtctaggacatttcctaccattgcaccaatttttaaaacaaaccactgaatcatctactttccagaaggaaatttcattgcaatggatttatgctttgctttatcatttatccatttgacagttctctgaaccatgattgccccagtttaaagaaatatcaagaatgccacacttgatttccctgaatgccaaagtgctttcaatgtgtattgaataattgtggtgtgtaaggatcgttcctagtgagccactccccttaatgtcactccagacagcatgatttatttactcctgaggatggttgataagtaggatacctactcgagggaggtgtcacctttatggtgggacatacaataaaaataattattgaaacaaatgaagttaattagatgagagaagttaaaatatttgaagtcagatgtgcacagaacagcaaagatacttggaaattttatgatagtgttataatctccttggcagatggctaagcattaaattgcagacatctctcttgtttttgactttttttttttgctgcatattttgttttgttgtttacaaagaaagttctttggaaaaagttcagaacatactagaaataatacagaaaatattaggttcacccttaatcctatcatctagacataattacccccatgcttattttctcaatcctatatttattaatcttttctcatttaaaactacgttgtggacatgtgttctggatattagcaaatccagttgcccaccaacatttttaayggcttcatggtgttctgtaatattcatccctctattaatgaacatttaagttgttcccagtatttcactattgtaaataataatacatagaatatccttayacatgtgtctttgagaacttgttgaattctttttttaacaaaaattcctactgggcttggtggctccagctactttggaggctgctgcgggaggatcaattgagcccaggtgttggaggctgcaggatggtatgattgcaccagtgtactccagcctgacgacagagcaagaccccttttgttacaaaatgaaaaggaaacgtagaaacaatattgctaaattaaaaggcatgcacattttaaagtatttggaaacattttgccaaaaaagtaataatactaatgtactaatatgcattccaacacatggaaaataatgctcattttcctgcgtgttaaccatgattggttattattattattattatttgagacgaagtcttgctctgtcacccaggctggagtgcagtagcgtgatctcggctcactgcaacctccgcctcccaggttcaagcaattctgcctcagcctctggagtagctgggattacaggcacccaccaccacgcctggctaatttttgtatttttagtagagacagggtttcaccatgttgtccaggctggtctcaaattcctgacctcaggtgatccacccaccttggtctctcaaagtgctgggattacaggcgtgagccaccacgaccggctgattggttattattattaaccatttttacttgccattccagtagtttttttwaaaaaagcaaaaaaccccaaaacctatttttgcagtttggcttattttttaggtttttaaatatttttttttgacacagagtctcgctctgtcatccaggctggagtgcagtggtgcaatcacaactcactgtagcatcaacctcctgggctcaagtgatcctcctgcctcagcctcccaagtagctgggattaccagcatgcaccaccacacccagctaatttttgaattttttgtataaatgcgatctccctctgttgcttagatttgtctcaaactcctgagctcaagtgatcstcctactttggcctcacaaagtgctgggattacaggtgtgagccattgcgtctggcctttttttgttttgtattttagtagtgaggctgaactttctccatggttgagtgtatttcttcttttgtgagtttcctacttaatacattatttgcctgcttttctaatgggagcgcctcttctcaatatataacagctrtttataagataagattatttacccttagtgaattaagtacaattgcttttcttagtttgtaatttactttccacgaggtttatagtgtggtgcttttacatttttatgtagtcatatatgtttatctcatctgatctatattttattaaattatttcatatttttcccactgttaggacttaaatctttaacctatctgaaatttattctggcaaaggatagggagagctttaatttttttttccccaagttgttagctaattgtcccaacccatttattatctttttttttctttttcttttttttttttttttttttttttagacagagtcttgagctgtcacccaggctggagtgcagtggtgtgatctcagctcacaacaacctctgcctcccaggtttaagcgatcctcgtgcctcagtctcccaggtagctgggactacatgcatgcaccatcactcctagataatttttgtatttttagtagagatggggtttcaccatgttggccaggctggtcttgaactcctgacctcaaatgatccacccacctaggccttccaaagtgctgggattacaggcatgagccattgtgtctggccctaatcaacttattatcttattgaatgtagctgcatttttcattagtatattgtcttagtccatttgtgtttctataaaggactaactgaggttgggtaatttctaatgaaaagagatatatttggctcatggttctgtaggctgtacaaggggcatgacaccagcatttgtctctggtcagggactcaggaagattctactcattgcagaagggcatagaggaccagagcaggcatcacatggagagaggaaggaaatgaggaggaggtcccaggctctttaacagtcagctctcacaggaatgaatccagtgagaactcactcattactgcaaggtattcatgagagctctgcccctatgttccaaacacttcctaccgggttccacctctgacattggggatcacatttcaacatgagctttggaggtaacaaatatcctaactatatcatatatatttcatatgcatttaattaccataactttagatttcattttaatgtgtagcaagggtagtttcactcaatccatktctctttataatatttcctttgccttttcatgaatgtattcttccttatgaactttaagaataaaatacaacattcattgaatatatttgcaaaattgatatgagaaatgtacttggaattagattgtattctcatagcaaaggcatcctggagcacgtatatatctaggagtttgaaatggactagtaattttgcaagggattatggtattgagcaggagaaaggaaatgacccatggaatgtgtttctcatatcacatgaagtcaactcggagaaggtgaggatctttatggtttaaattcattctgttctgtggataagaactggcaacttaattctgtcatgtagtatatcttcctttggcctaagaattgagccaggaatcccagggtaaagcaaccttgaaatttgtttttttcccagaatcatttgaaaaacattccaggaggaaaatatgtagcattggcaggatctgagtgagatacagtagtcccgtcctttattctcaaggaatacataaaacatgaaaggagagattaactctgggattatgtggcaacgctccaggcatataggaaaaaaacactatatacagggttcagtactatccacagtttcaggaatccagtggattaagatgttgtaaatgaggattcttactttttatttacctgtgctggaactcctggaatcatatgaagtattttaaaaagcatatttgacttcatatttccttttattatttcatatttttttctctatatttttgcttctaagcaggtattttggtgctatagtaagcattttaaacttatcaaaatacttgtgttgttttcatatacaaataaagagagaaagcagactgggttttgaagaccagcagaaaaaggtttcctagtcttgtaaacttaggaattatataggatgatatatgtaaaattttgctccgtttttgggatatggtaggtactttccatgataatgaaaaagcttctctataaattcatgataaatagtttgggggatcaatactgtttacaaaattcccctccaaagtttcacattttaatggattcatattttagtaagcctagggactgaactttacaggttgtggaaagtcctccaaatattttttactacattctagtaattaygttactaaggttttgttaggttacacattttaaccaattaatatggagctctcacaatgtcatttcacgccagtagtatttacacttcagtttgttctagttattaagtcaatatttgcaactttaggtaaacataaattaacgatatttaactaaggaaataatgcattatagcatcctctatataactcctgtaacaacatatggaatgaaaaatattaatctagtaaaatcatatattaggaccttcaacttaactttaattctaatttttgaagaattttcaggttcatagatgaaagtttaggttcaatattacatctgcatctctatgaattcagtcttttcaacctatgtctgtgtttcaatagttatattgaattcagtattcacccttgaatattgagtttgaaaacaaaattatctatgattttttaaaaaatcactaggctatcaygaattttattaaatcttagaaaagtgaggattccaagccttaagttgaatgttcaattgattttatcttttaaaaagtataatatgggctaggagcggtggctcatgcctgtaatcccagcactttgagaggctgaggcaggcggagcacctgatgtcaggagtttgagaggagcctggccaacatggtgaaaccctgtctytactaaaaatacaaaaaaattagccgggcatggtgggcacctgtaatcccagctacttagaaggctgaggcaggagaatggcttgaacccaggaggtggaggttgcagtgagcgagatcgtactattgcactccagcttgggcgacacrgtaagactccttttcttaaaacaccccccaccaaaaaaaaaaaaacaaaaaacaaaacaaaacaaaaaaaagcaagaaaaacccctataatgtgttcaatatactatataggtattgcaatttgaagcatttaagttagggtctgagtagcacatgctgaatgaatagtggcccagtgctttgtgcatagtggctattcaataaatatttaccaaagtgaaggactcttccccagatcactccagctcctccagggtacctgaaatttctgtggctggacattacagtatttagtcccgaataagaagcagggttcttacaaattggaagggctcctacaaaattggttaattgggattagactatttgtatccttgcccaaggaagggtggcttttctggggaggcttttctgatggggacctcgactggtaggacactgagtatcatgggtagagaagtagcctctgacatggagtatttattatattgtaacatcattgcattattataatgtaacctttccctgctcgatgactcaggctataggtagtctacgtgcctgacttgttgatctatgcaccttcttgaggttaggaattaaaacactttttttttttttggtaatttttaaacactgtgcatgtacctaaagtgaccataggaatatttgggaaattttacttttggatatcagctagttgttaccaaagtgctttaggtggtggctaaaaatgtcagtttgcctgactttgaatcttgactgcacatcgcataacagctgtgtgaccccagacttcttttctgtgccttcgtttccttctctgtcaaatgggaataataatagcaccaagttcataggacggcagagtatccaagcagtgtctggtacatggtaagaactcagtacatgtcagcggtggtggtgataatacgtgtatgagttccaaggtactgagtaggcacagtgtgaagtagttgtgtttgtgtcctgtgattagatagtagtgatgactgctgactcgctttactctgtgcccaccagaagagacctcaggttctgtgggatgcaccctgagtatgccccaagaaagagcagagacttgtacttaggatttgtgatttgcagacgcaagctttgctgtatttgttttgctcgaagggcttaytgctgtggtattcagaatgtgaaataatagttaatggagacaaggggattaatagcagcatttaaaatcatttagtgactaataactttgtrgcttataaaatctgtaccttgatatgcaggggtggctgttctattaacatttctaagctatttaaaagtcagttggatgcttttcggttgcacattcatttttcatctttgcccttccattcaggaaacatcaataaagtttaataattttctgtcatttctggaaaaataaacaagattatagattattaagggttatttttcattttgatggtggataaattaggaggaatccttactgaatgaaaattgtgaattattgattatgatcacaggattaatatgaaaccactcatatatctcgatgtgcatagcttcttttctagtgccattgtagatggattgaggaatactgtgaactgggattattgtgtattaatcattgaacacctactgtgcaccacactgattataggacgtgtatgcattatatctggcctgactttagcttctcaaaataggtattttatggttgaggaaatgcaggctaggagaggttggacaactgacccaagatgctataggttttcagcttgctttctttctggcatactttgccatcaaggcttttaatataattttttgctcctcaaaaaaatttctttcaactttagtgaaatctagcctcgtataggagaaggttcaccatggggaatttggcatttgagtcttgaagtcaaatgctggggtatgggggactacattatttgtactcaggatccagaggggagttatcacaaagccagtgctttcttttcacctctggtttagggttgggctcccctcatacagtcaaggtccagttgaatatggtaatcaaaagaacaagctggggagtcagagagaccttagcctggatattgggtggtacatcagttgggatgcttttggctgtaagtaagagatgcttatttccatttccaaatgcctcatcccaaaagcaatttatcatcataagtccagacgtggagccagtcaagaggtagcggctgacccacgtgatccatctttctgctttccttatacttgatttttttttttttttttttttagctggcgtctcactctgtcacccaggctggagtgcagtggtgcaatctcggctcaccacacctctgcttcctgggttcaagtgattctcctgcctcagcctctcgaatagctgggattacaggcctgtgccaccccgcccagctaatttttttctttgtatttttagtagagatggggtttcaccatgttggccaggctggtctcgaactcctgacctcaagtgatccacctgccttggcctcccaaagtgctgtgattacaggcatgagccactgcacccggcctatactttatgttaatccgtccattcactcatcataggacggctgcaggactttcacatatcccattccgaygtgtcaatgtctggaggacattatggctccatttcttcttgtggctctttcttagaggagaggagcatttttccagaaccctcttgcccccggagacgtctayttaagtcttattaaccagagtttggtcaaatgcctgttcctgaaataattactaacaaagtaaaaataacctctacaaatcagggtgtgatagcttcccttggggcacgtggctgtgttggggaggaatgagtactgcacaaacctgagatcctgctagaaaggaagaaggagggaaaggatataatctcgaagacttaatttcctcctggataagtggagatgataacactttcctaacatagttgtctaatgagatagctactgaaatccagcatcagaacaagagattaccataaatttgaagaagtgtgaaaccaggtaccacagcctggcccctgcttaggcttagttacttaaagctgtgcaatttaaagcagttttggaatctccccttttcatttacttgacaactgtcttttgagaacctatcatgtggcaggcgctgtgccaggaatgacgttcagcacatacctgtcatgtgcatgcaagtacttttagctgtgattacttggtgtatagtatgtttgattggttatgtgttgattactgaacagctactctgatggccagttttaggtgtcagcttgactggattgacrgatgcctggatggctggtgaagcattgtttctgggtgtgtctgtgagggtgtttccagaagagattgacgtgagagtcagaggactctcaatgtgcatggtgggcaccatctgcctggctggaagcccagctgggacaaataggcagatgaaagggaattcactctctctgctttctgtctcccttctgagcaggtcactttttctcctccggcctttggacatcccagtcyggtttctttggcttttggactccgggacttttaccagtggcctcctgggggctctcaggcctgaccggtggtgtgctgttggctgccttgcttctgaggctgccagatttacactgagctatgctactggctttgagccatgttagcagcttctctgattctctagcttgcagtcagcctgtcgtaggacttctctgcttctgtggtcctgtgagccaattcctcccagtcatccccctccatatataccgtatagtttctgtttctcgggagacacctgactgatacacctacgtttcactctgtattatccatcttgcatgcatcatctctgatcctcacaaaaccttttcagagtagattattttacarttgaggaaatgcctgtaacaatgtcaaatacatattattttcaggaagtactggttgggagaaaacccctcagaattagaaaatattcttgctgtttcgaaggagtccagtatgtcaaagtctacctgcctctttcattaataaatactgggargctgaggtgggcagatcacttgaggtcaggaatttgaaaccagcctggccaacatggtgaaaccccatctgtactaaaaatagtaataaaaaaatgtagctgggcgtggtggtgggtgcccgtaatcccagctactcgggaggctgaggcaggagaatggcttgaaccctggaggtggagtttgcagtgagccgagatcgcgccactgcactccagcctgggtgacagagtgagattctgtctcaaaaaaaccccccaaaacaaaacaacaacaacaacaacaacaaattggggataggtctgcttgtcttataagtttgtagccaaagtatctcatatgtttatatttttgaaaatccatttcgttcctggaatatgttaatttattgatattctagtcagtaaaagacttgcatggaaaacattgattagatgaaacactgaaacagctaaacctcacttccacttgtttaagacatcaagctgtttaaaggtcagctggatgctttaacttatgaaatgtgtaagcagaggagtgattttctgaagaaagtcgtttatattagaaataatgatttatttaactgtgttttggtcacaagcatgacatttcgaacacagtaaactttatagatatgaagattattgggaaagatttattttaaaaagagagggatatgaaaacacggggaaatttcaggacatctcaaacattgtgctaataacacctgtatttgagttagtcacatgtactgcaaatttttcaagaagaaaaattgtttcaccatttcctttattagctaaattcggaagtcaagttagtagctaggttcatacctagttctttgtttagagtgcttgtattctatttagtaagaagggacatggttttacctctttatcaagggctcactgaggtagtatattctgggtggtggtcaacacagatttcttttccatgtcagagggtcaagctggacctttcagcctggccctagggaaggctgtgttggcattttccatttttgtaaatgacatcatagtctttcaactgaatggctagtgactatgtcctatttttttttaagacagaaatatgtgaaatttaaggaacagctttctctacagctgatgatgtgggaggtttgtgaataaccgttggcaggtcctatgaagaggaggagctagtgttccatggggacgtgtgcacatgtttttatcctgggaatattgcatttgtgtgatatcttctctttcagaatgtatcaaaatagaagcttgggccaggcgcggtggctcacacctgtaatcccagcactttgggaggctgaggtgggcggatcacgaggtcaggagatcgagaccatactggctaacacggtgaaaccccatctctactaaaatacaaaaaattagctgggcgtggtggcaggcgcctgtagtcccagctcctcgggaggctgaggcaggagaatggcgtgaacctgggaggcggagcttgcagtgagccaatatcgcaccactgaactccagcctgggccacagattgagactccatctcaaaaaaaaaaaaaggaagcttggggccagtggacttgttggtgcatattaaatgggttagagagacacgttcttaatgttatggctcttcaaacatactccaaacctctcctatttgaccagccagaatcttatgttattagtgttgctaacccctttttccctatatttttgatagtacgctggaaagaaatgtctgtctgtcttgaggttttcagtctttatttaaggttttgacgatacctgcaacatagacaaaagctaggattttagattgggggaaatttcctactagtagtccagtagtaccggcattttctaaccccaaatttatgtttcttcttcatattactgttttaaatattctgtattggctgggcgcggtggcttatgcctgtaatctcagcactttgggaggctgatgtgggaggattacctgaggtcagaagttcaagaccagcctgaccaacatagagaaaccctgtctctactaaaaatacaaaattatcccggcatggtggcacatgcttgtaatcccagctacgcacgcaggaggctaatgcaggagaatcgcttgaacccaggaggcggaggttgcggtgagccaagatcatgccattgcactccagcctgggcaacaagagtgaaactccgtctcaaaacaaaacaaaacaacaacaaaacaaccgctgtattgttctgtgataggtgagcaggcacttgtgttactttgtaatactgtcttattccattttctgatgttatgacagaataccaaatggaaagaacatatatttatttatcatagttctcaaggctgagatgtccaggatcaaggtactggcatctggtwagggtcttcttgctgtgtcctcgcatggctaaaggtgggcaagagacatgaagcctcttttacaagagccttaattccattcatgagggaagaacactcatggctgatttcctcttaaaggcctcaccttttaataccatcacattgtaaaatacatgaattttggagaggatacatttaaaccatagcattaaattaaggcattaaatcaattttggttgcttatgacaaagatctctgacaacctaactttattcctgtagttggtatttttactgtaggcagatttggtcaattaaaatgtaatcttgtgagtcacatgacaaaattttctttcttcttctttttttaaggttatgtaatagagggagagaactcactagtcctgggccataaaaactctgggcaaaggatgtgtgacttctcttctgtcaactagaaattatatggccacaccacaggtttgtccgaccagtctatcgggcagtttacatatcagaaatttgaagagcaggtctgagtaattattgacatgaaaaacaaaaatagaaacacaaagcacttctaaaatatgtgtgtcaaaggagtgcacttccagaattttctccttctggtctgtaaggcaaaactttttcaggtgacagtgcccacaatagacaaatgtgagtcattttcctacaattttgaaattattgttagttcattattcttagggttctactgtagatgtgaatttagagaatggaatctaactcatcatggatgatttcctttttgcaaagcatcttgtgggacaagataatagtattaataacaagagaaatggtaatacagttgaacccttgagtaacgtatgtttgaactccttgggtctacttatacgtggaattttttcaatgaatatattggaaacctttttggggatttatgacaatttgaaaaaaaactcatagatgaactgcatagtctagaagtatcaagaaaaaataaggatggtatatcatgagtgcataaaatatatgtagatcttagtctatttatgtgttaatcaactgtttatgttataccaactgtttagttggcaaggtttccaggcaacagtaggttatttttagttaaggttttgaaaagtcaaaagttatatgcagatttttgactgtgcagggggtctatgccccaacccccatgtcgttcaaaggtcaactctattagtaatggtaatagctattagtaatagctaacatttatttagcttataatgtccaggtactgttctagagtctttacatatgttaataattatgacttacaggctgggcacagtggctcatacctataatctcagtactgtgggaggccgaggcaggaggattgcttgagaccaatagatcaagaccagcctgtgcaacatagtgagattccatctttataaaaacattttaaaaaaaagttaggtgtggtgatacacacctatagtcctagctactagaggggctaaagtgggaagatcacttgagcccaggagttggaggctgcagtgaaccatgattgtgccattgaactccagtctgggtgacagagcaagactttgtcatttacaaaaaaaattataagttactattttcatccccactttacaggtgaggaaactgaggcccaggaaggttacgaaatttgcccacagtttatagttggcagagagggatttgaacattactttcttatttcagatttttttgcttttaaccactatgctgtgtttcccaaggttctgatcatttcagaaggtttgttttctgttgcataactatgagagctcaattttggttgaattctttcaagtggcatcagtgttttgaagtctgagtaggccaggtgaacaacatccattttcttacctgggttctgaagaacttgggaaataaaagaggaaggcagatataagattaaaatatcaaatttattaccgacagagagcttgttcttgggaactgtccccaagaggaagaaagttgaggatgcccacctgtattcgtccgttttcgcgctgctcataaagagatgcccaagactgggtaatttataaagaaaaggaggtttaatggactcaaattccacatggcagagggcgaaaggcacgtcttacatggcggcagacaagagagaatgagggtgaagtgaaagggatttcgccttataaaaccttcagatcttgtgagacttactcgctaccatgagaacagtatgggggaaacctcccccatgattcagttatgtgggtccctcccacaacatgtgagaattatgggagctacaattcaagatgaaagttgggtggagacacagccagaccctatcaccacctatttctaggtttaccaatcagctaagttaagccatctcctgggggtaaagggagtgaatgggacagaaagagccatggagtgggtgggactagagggaattcttcttactggacaccagaagagtgttaaaagggatcccctgtaggcagagcacggtggctcatgcctgtaattccagcactttgggaggccaaggcaggctgatcatgagatcaggagtttgagaccagcctggccaatatggtgaaaccctgtctctactagaaatacaaaaattagctgggtgtggtggcacatgcctataatcctagctactcaggaggctgaggcagaagaatcgcttgaactggggaggtggaggttgcagtgagcagagattgtgccactgcactccagcctgggtgacagaatgagactccatctcaaaaaaaaaaaaaaattaaaggtgtcccctgtaacattagcattatgtgttaagtctggaatctagtgaaaagttcacatttctgttagaacagggaacggaagggttaatgatgttcaggaacggttttatggctcagtgggaaaattgcatgttgttagaaatatagttggattcctctcctgagttcatgcgaaattgctgcgtatttcgcctctcactgattgctggaatttaaaaatgcattcctctggaccaaggtagttgtgtttcctttccatgtctttgaagtgcttttctcccccttaacttgtcagtggcgtggcgtacatgtttttgttactgacagtgtggccaattattgtgttctagaaggcattgttgtctctgagaatgttacatgatatgagtagcaagtctgtttattcagaaaaacacctcagatctcaaaccaatttagagagctcagaaagcagtamttggagagacacttccgagagatagcttagtacatcatcagagtccttattcctgattctaaggccatttaagcatgggtcacactggactgctagttggcatagagaggaagtgattggtggtgaaatctgtggtacttaaaagcgctgacagtgtaggaggccagatttcaatttctagaggtgtcattttagaatggagtagggaagacatatgtgtcacatagtggtttttttggtttatttgtttgttttgagacagtctcactctgtcacccagggtggagtgtagtggcgtgctctcggctcactgcaacctccgcctcccgggttcaagcgattctccagccttagcctcccaagcagctggggttacaggtgtgcaccactacacctggctaatttttgtatttttagtagagatctggtttcaccatgttggccaggctggtctcaaactcttgggctaaagccatctgcctgctttgcaaagcctcccaaagtgctgggattatagacgttgagcccctgtgcccagcctgtcacatagtgtataatgacagttatgcatagagatcgaaaaatgttggtcagagggcacaaagctttagttagacgggaggaatgagttcctattatacagcatggtgactctagttaataattattatatacttaaaaattgctaagagagtaggttttatatgtccccaccacaaaaaaaaggttgattatgagaggttatgactatgctaattagcttgccttaatttcacaatgtgtacatagatggaagtatcatgttgcacagtttttatttgtgaagtatgtctttgtcgtgaaagcagccgtagtctatgctacagggatgggcgtggctgtgttttgataaaaatttmtttacaaaaataggaggaggggtagattcagtttgctgatgtgtcaaataaagtaagttttgttcaaaactgtttcatcataacatctatgagaaaaaaatgaaatggattcttggccagggctagtgtctgggtggagtttgcatgttcacctcatgtctgcatgggttttctctgggtactccagtttcctctcagcccaaagctgtgcacatggcattcactggcatgtccacctgtttgcagtgtgagtgtggatgtgggtgtgagcgtgccctgtgatgggacggcggcctgcccagggcgggttcttgcctgacaccctgagctgctgggatggaatccagccacttgcaaccctgcactggaataagtggataattatcttacttttttattaatctttcttaaataaatgtgtagctcacatttattttgatgttgagtagcagaagtgttttggtctttatttagaagcttggtggtgtttttggatcagaaatgtgctgtaagaacttaactcttgtttttgcctttttttttttatttttgatttccataggtttttggggaacatgtggtatttggttacatgaataagatctttagtggtgacttgtgagattttggtacacccatcacccgagcaacatacactgaacccaatttgtagtcttctatccctcaccctcttcccaccctttccccacaagtccccaaagtccattgtgtcattcttatccctttgcatcctcatagcttagctcccacttrtgggtgagaacatacgatgtttgcttttttattcctgagttacttcacttagaataatagtctccagttccatccaggttgctgcaaatgccattaattcattccttttaatggctgagatgtattccatmatatatatatctcacagtttctttatccattctttgattgatgggcttttgggctggttccacatttttgcaattttgaattgtgctgctattaacatgcatgtgcaagtatctttttcgtataatgccttcttttcctctgggaacttaactcttgtttctatcaatcagcctgtggtaaaactggtttccttgtaggtcctttcccttaaggtcgcagtttccaagaacctatgcacaayactaaagatttgctgtacatgtgataaacaacatagcatgctgattaagaacatgaactctgaggttagaccacctgagtttgaatctctgcagcttccttctgtatgaccttgagcaagcgatttaacctttctgtgccttgctttctcatctgtaacatggaataataaaaaccttcctcataagggaaaaaaaaagagtaagaacctgcactgttcaaaatgtaaattaagtgttatcagatgcccattgccaaattctcttccttttcatggtttttgaatgcttgtttgtgtgtagcttgacctagaagctttgggtgatgtgaaaaaaaataggaagaaaaatagtgacagctaacattgtgcacctatgatgcaccaagaactgtgggaagtatcccctatcattgcttcatttcactccaggaggtagggaccattttacagatgtggaagctgaggcctgtggtggagctcctttcccgtggtctcacactaaatggggagagactgcagacctagccctgtggaccagctgtagcatcgcatcttctccaggaaaggagagagggtgggcagtgctttgcttacctgatttcattctggttgaggggataaacctggaaaaatacttaaatgcctatattaactcatgaaaaaaagaaagtattctacaggagaaatgtagcactttgtggccttttatgcatggtggggatgggtggtttgctgttagtattatagtttttcaccttttgggtttcattatgtttgcaccaatgagacttgtcctttaatattacttgaatgaaggacgtcggttaaaggtctgtgcccaaaggctggtttcctgctgccccagcacagcttctggtgacccggaagtgatcctatgatggggaaagttggaaggctgtaaacatcccagagttcctgttggtacattgaattcattggttggtgacccggaagtgaccctataatggggaaagctggaaggctgtaaacatccccgagttcctgttgggacattgagttcattgccatcctgatgctccacacaccaggcctaaagtggctgcgggggtggggaaggtggcattggtgccagttagcatacttctcaggattcacatgctgacaggtgtttattttttcttgatcaaaacacaacagaataaaaaccagagggctttaaactgaagtatatcrtgcccttactgtaagctcaaggacactgcatctccatgggttctaaacataagatctcccaccaaccctgcgtccactctgactccagcacctgatgaccttgttggggttggagagatttccctctcagcatcatctgtgtgtgctcatatataacgttaggctaagaagatagcccccccyttttttatatagagctttgccatttgcttccacaatgcaatctagattatttctttggtgtcctcatatgtgttttccattttaaaggtggataaaatgtggaaatagtacgttaccctaagaaaaataactagaattaatcataaaagcaactgtcttgtatttatactggaaggacagaattaaaaacaaccaactaacaaaagaaaaccaaaattgttgctcagataggcaaagagaggggaaatgtaactgtaatgacagattcaatttctttaaaaataaatgttaccaatattatccctaatgctattttatttgcttagaagagaatgctgcattaagcttcacctttatatgccactattataggtctagatttgttatcaaatcacttcctggaaaacagacaaagcaatacctaacaatcacttgaaatgaataatcagatctctcaaaattatactacatttttttttcaaatcaagataattgtaaggaattgacattgaaagtagagacagcttttgtagtattctgtttttcaagaaactaggttatctttttaccaaatgcagacttagcccttcccctgatagttgtcttaatagaagtcagttgtatactgggaatgtttttatttttaaaatgatactcctggctgggtattgcggctcacgcctgtaatcctagcactttgggaggccttgacgtatgtatcacctgaggtcaggagttcaagaccagcctggccaacatggcaaaaacccgtctaaaaacccctctactaaaagtacaaaaactagrcaggcgtggtggcacatgcctgtaatcccagctactcaggaagctaagacaggagaattgtttgaatctaggaggtggggcttgcagtgagctgagatcgtgccactgcattccagcctgggtgatagagagagactcgtctcaaaaaaaaaaaaaaggatactcctcaaattatgcctacttgtaatttggagtatggtcgctttttcctgtgcacaagttaaatctttgataatcttaagaaaagcatgattttagcatggagtgaggattatgagatttgtttctgtagccgattgaattgttttgtttctaagtggttgtatatcaaggaatatcaaataactatatctgtcattttcgtgtgtctgtttttccccacttattttttaagccagttaaatgccttgctgaatgagagtgaggggaggaagtgggggtgaaatgaatgctttttagaacttcctcaacacatttagttcttttcattctttctttttttaaatagagatagtgtctttttttctttctttctttctttctttttttttttctgaatagagatagagtcttgccatgttgcccagactggtcttgaattcctgggcttaagcgatcctcctgcctctgcctcccaaatagctggaactacaggcgcacactactgcacccatcttttagctcttgtttgctagatgtatatggggctatgatggagagcccagcattagcagtagagggtagacatggcttattaaaataaatgtcaagccttgcttggattttgttttacccacatcagcaccccttgaggctaaaactttctgtaaatctctctgtaaaacagaacaggattatgaacatagaacatggtttatcatgttctctgatgaggagaattgcatgtggatttagaggaatccccagccaggcagtctgggactcagtggctggtagggggcttaagtttataacactgtggtcatggcctaagcaagtagcaagccttttccacttccctactcccaccgcatcttgttccacattgcttcttcaaaggaggcagcatggatatctcttctttgccatgaatgaaggtggtgatagacaaaccaccacttagcatctctgagacttctgtggacaattgctgtaatgtgtaggtggcaaataagatgaggtcttcccactactgacccagtattcttyagcgtttttctagtgaattaattttaggtagcaacttccttattctacttgagaaaatgtgaacagaggagtgatactgtaaaatacatacttggtgttcaatctctttttctggtacataactcctaaaatccttagaatctccaaagtgatgtcttttgtatgctaatgaactgattgatggcttgcagaacctaggtagcttcagaattacttctggtcacctaaaggacccaggcaggaaaagagggttgagattttcagccccacccccaacaccccggggagggggagagggtctgaaggttaagttgatcactcatttccaatggtttattcaatcatgccaacgtaaggaagcctccataaaaacccaaaaggacaaggttcagacagtttctgtatggctgaacatgggggagtggaagtttctaaagggtgacatacctgagtatcagatggtacctccttgtaccttccctcataccttaccctatgcatctctttatctgtatcctttgcaatatcttttacaataaaccagtaaatataagtaggtgtttctctgagtttcgtgagccactctagcaaattaatcaaacccaaggagagggtcatgctccagatcctcgcaacttgaagctagcctgttagaagttcccaaggccctacgtctggactggttaccagtgagaagtagggggcagtcttgggagactgagcccttaaccggggaatctgaggccatctgcaggtaaatagcattagaattgaataggaggacaaccagctggtgtctgctgcagaactgattgcttgcctggtgtgtggggagaaaccctcacatatttggtcacagaagtcttctgtgttaatgatttgtgtggtatcagagcagagggaaaatcaagtttgagtttttcctcactcaagaggacagaaagattttgaatgctggaatgataggaaattatgcttgaatgtgtttcaacatggaagtcatttttgttgactgcatcacccacgggatgttagcagtaagctatgcataaatgatatttttatcagctttgcacagaacgataggatatagaaggagaaaaccaggaagcttacagaaaaagagtgtgaagattgaagaaacaccaccttcacttaggcagggcacctgtgttaagagaaaataccctgagataattcctatgttccaacgaatgctgtaaattagtgtttggtaagtatctgtgtttccattcatttttatgcctaaaaaggtgtttatactgcaagaaacacattgctaaattggaatttaggctgtttttagaagatcatagattgctttttccttcttgcagtttctccttgcacaagctcagctacatcagttgaacaaaactttgtgttattttggggagaggagacatttatgatgtggatgatcattttaggtggatagctttttttttcttcttgatcttatccagcaattttrtattagttcttgatggaccctttttaggtgactttttatactctgtttttcttgagtgaattctgatgaatgtttactccatttttgtgcatgttacatggctagaacttagcatatgcatgtcagtcaagagtaatggctattagttttgctattcccagcttggtagtcttattgttattttgaaatggagtcttgctctgtcacccaggctggrgtgcagtggtgcgatctcagctcactgcaatctcttcctcctgggttcaagggattctcctgcctcagcctcctgagtagctgggattacaggcatgcgccaccacacccagctgcgatgacaggggcacaccaccatgcctggctaatttttgtatttttttttttatagagatggggttttgccatgttgcccaggctggtcttgaacttgttgtcttgagctacccatccaccttggcctcccaaagtgctgggattacaggtgtgagccactgcacccagctgacaatgtcttgaaattagtcaagggtcaaatttttgaggacctttaagatattgggtctactggtcagagcaagagacatatacatgaaatactgtttaaccaacctcagggaactcgcatggagtatgtgttttccttgattattagattattatgtcctgaagtaacttgaccaaagaataaatcctttattcttcagcaagaatcaagtctctcccatgccattgcaccttttctcctacagacacaaattcttagataacaaggtcatggaatcataagaagtggctggaaccttggaaaggaaccctcgaatcttcctctatcatcccccactactcctttatcaaccctttggctgtgtctagactgaattcataatatttcccagaatgtgcttttggctactagcaaattttggcatttcatatctttatgaaatcttttacatacaaagcctatgaaatatgcaagagtttatatctaaagtatctgttcggtgggagttggcgtgtcattgaatctcaggtgttaaaatacgtttttatatactccatgttggaatgatacaaagtttgttaactgagggaatgagttaaaatatgtaaattgaaatgttgcaaatatgctcataattgtaaaatttctttttgttatgattattaagcaggtggcagattgaaggataatattctggacattagaaaatatttgtagatagttgataaattttgcatagatatgtagaaattaaggtataatacttttttaaattgttctttcatttagcaacattttggggttactattttccaaggatttcagtaaatgtaggggattcaaagttgttgtatgtggcttctgtcatcaagaagcttacagttttgtgatttttttttttaatgcccaagaatctagttaatttttaaagtagctaatggatggtgtggaaaatgtgccctctattgttaatgatagaagtctttaaaagcactgatgtagtaaccccccctggggttcagggtccacttggtgtccctttgaagggtcatgattcagaagcccaggcctcttctccacacttctgactgattgttgaaggagtaagttttgctgtttgatgtcttctctccagttcttmtttattgacttttcctctgtgtatagtatttgcaaaagagtagaaaacattctaaagcactgtgatttaacaagaggtacttggctgattttagctgaaggctcttgtcaggctcttgaggtcggatctagcctttcccaagttgctctctcctgttcgctactgcacagctgttactgagttggcatctagcctctcgagagcagccctgaaagtgaaatctggagctagtgttcagctgatggagtcacatggggatttatataacttctgatcttggcattaccaatcagcttctttgtcttggttagttttatggtttctgtaaaccatgggaatgtttctcaaagtggttcccagatattagcctcagttaatctgaatttgtggcacagttccttctgtcgtcactggcaagcacagttggagttggtggagtgaactgctttttgtctggttttccaaacagttggaaaagtttgtgtttgacaattgcaattgcaatactgattgacacccccagcagatgtgaggaaaacaaagttaagctgacttatataacccaagtaacaagtggtcaaaggcagtgatagatgccttctcttcatcttttatggagatactgtcccctcatcctttaaggctaggaacttggtcattaaaatagtttttagagcaaggtgtagggtgcagatgtggcatcatttaaatggacagatattaagttttactgtgtcgtgcatatgtatgttggaggttagcattgaaaacaagccttcatgttcagtgcatactcatattggatgacaacattgttctaaattgtgtgataaggatttttctcaaccctctagtcatcctgtcatattctgaaggaatatggtgcctctatgagcacatacttcttttccacagtacgcaatcgtccatgtatttttcaaaacaacagtaacaatagcaaaataccaaaaaacctcacttacaaattgggaagtgttattactaatgacaaatcaatggctttcattatcccagatctaagtaggaaaggaaagggtgcacctgccctgtttcagacacttgctagttcctgcattggctcacctctcctttgctcgtagcactcattgtgagaaagtagatcagtcaatagtactgagcttttcttggtttgaactctttttatttgcagtgttatcattaattttttttcttaggaagtaccaggaaaagataagaaatttatgaaaaatgcagatggggataaaatctatgtccaaagagttagaatagaggccaagaaatgataccaatctagagtttcaggatgaatattgacatagtaaaagtcctagacatttacaaatttgtcctgatattttattttgtagatgaggaaatttaggtttaggaaaattaaatgattgatacaasgttgtgcagatagttattggtagagaaagtctaaagctcttttcaatattaaaaataaataacaaaaaacatggaagtgagcaggcagcaaactgctgcagtttgctttgggcagtcagcaagagaaaaagaacttagattgagtgtaagcaatttaagatagagttttccataatggaaactcttaataatgggatggcgtgctttgagatatcatgttgaggaattatctacaatataagatrtttttggtatggtcctttcctaaaaggtgggagggwaattgttggaggctctatccaaccattgacagagtatcctttgattagtagtgatacggttttgctctgtgtccccacccaaattttatttcaaactgtaatccctgtaatacccatatgtcaagggagggactggtaggtggattctcccatgctgttataatgatatgagtgagtgcccacaagatctgatagttttataagggtctcttccctctttgtgctctccctctctcctgccgccatgtaagacacacctgcttccccttccaccatgattgtaagtttcyggaggcctccccagccatgctgaactgtgagtcaattaaacctcttacctttataaattacccagtctcagatatttctttatagtggtgtgagaaaagactaatacaagtagtatcctttgttagtagtatcctttgattaatagtatctgttatttactacagtgttccttgaggatcttatagttcagagaaggaaattattgatgaatataaatgaataataaaattctaagcctccaactgactgaatggacctcgctctaggccagaggacccaaagaaacctgaaaaactagttcatgctatgaaaagaagtggaattggacatgttccgttacactctcctccctttggaattcaggcacaattggccagcatacacattaaaacagaaatctgaagactgacaaaacacactgtagcaataagataccaaattcagacctgactctagtatagcatcacatgacagataacaggccctgaaagaaattgaagcatcttaccccaaaatatatttctttgacatattttgaaatggctctgcaaagctacctcttgtggggaaaatctacattttgtagagaatcccttacccactcctagtcttttccgaattgactaaggtttggcatctttttaggactaataagagacatttaccatctgttatctctgaaacttgctacctggaggcttcatctgcataataaaaaccttggtcttttcctttcccctctcctcctctcccctcccctttcctttttcctttccttttccctttccctttcccctttcctttcccctttcctttcctttcctttcctttcctttcctttcctttccaacagggttttattctgtcacccatgctggagtggcgcatcatggcttattgcagcctcgacctccagatgatcctcccatctcagcctcctgagtagcaggaccacaggtgtggtccacaccagtagctaccacacctggctaatttttgtatttttartagtagagacagggatttcaccatgttgcccaggctggtcttgaactcttgggctcaagtgagtcttccttcctcagcctcccaaagtgctgggattacaggcgtgagccactgtgcccagcccttaactctttcaatcagaaaaatctttgagtccacctatgacctggaagtccccctcccccaacagcttcgagttgtccagcctttccagatcaaaccaaagtataccttacatgtattgattgaggtccttctgtaacttctgtccctctaaaatgtataaaatcaagctgtaacctgactaccttgaacacatgttctcaggacctcctggggctgtgtcatgggccttggttactcatatttggctcagagtaaacctctttaaatattttacagagcttgactctgctaacataataaagcactgataatcttaacatctcactttgtcctctggtcttggcctccttctccaccatgaagagccgtgatgaggactgtagcaccgtcaggcagactggtcgtactggagttctcttcttttgatctgtggctaaccaacacatccaggtcaataatagacctgygggtcaccttagatctgtaagagatttgccatggacctttgcagttagtggcttgactttgttttgaattgcatagtgaaatattctctaacatatttactagcatttgtaagtagatcatttgtggaaaaatgacgataaaaggtacgaacccaattagtatgagttaggggcatccaggtgaatgattgttctataccagtcatcagcatcatacaccagtcagactctgttctcactcctctttcatgaagacattgagtgtgctcaggattagaaacaggagattttcccataaaattacatatattttaaacaattaaggcaaaaagttatgatgcaaaagctagggtgaacttttcccatctctatatatgcatatttatatatgtgtatatatttgctattattattccttttgaaaatgcttctgaacttatgcaggtggagtgcccaggcttttgaagcagggttgtttgtctggggtaatacccgaggcttgttgcctcacaccaaggcaatcaaagacacggacatggagtgaggttaagagcagaggtttaacaggcaacagaaagtgaaaagcgctctctcctgcagagagaggggcttccaagtgggtcttctggttccatggtgaaatgcacggggttttatagagtagcttgaggaggcggtgtctgattttcacagagcctaaaagattggttggaccaggtgtgccatttgcatagcacatgaagaagctggcygcctcaccctaatcttttattatgtagatgggttttctacctggcctgcatctccttgcctccttctttactgcacacgtggcaacaaagaaaagggaggagggagcctccatgttgaatatacctggctatctatgtttgcagcttgatttttcaggctgctttgtgttagaaaagaaataatttgggggctgctttttattaaaagggaaatcttaccgaggactctcttacctcacagcctaaataatttctttttagctcctgtatcactttgattatcatacagcagtgtgcttgaacaaggctcttaattttttcagcagtttctggactaggtagtgtataaaccaagagcacatctcactttttcatcaactgtttactctatcacgttgcaaggactctgagggatagttaagatttaaatattcccagcagggagggaagaagtttggataaaagaatatctttccctctctctctttctctcaggattttatcattagaaaagatcattttgctcgatcattaaaactgccattagtgcttaagcacaagagacacattcgtttaccatatatagtctgttgttttcctggtgttttaattccctagagcaaaaaagtatttgaattccaggtattttcagaagttttggcattctgcagatgtgaggttgccgtcgtctaaggcagctagtagccctcttttgccagaagagttataattattagggatatttggagttcatttcttgtccagcttttcaacactacataattctctaatgacacaattctggagcactgaatatcccataatccctcaaaaaagtgaatccaaatataattctcattgtgacccttggtttatatagcccccaaacaccttttattaataaagaaatttactgaaactgttttatgcttaagtagaaaaacaaaggtgacacatttgaaatttatatactgttcatggtcctgttwctcactggcttagtggcctkgagtaccatactataaaccaaacttattttcacaatgataaaatgagcgtgttctactagatgtcatataaattcctctttgtctttgaaattatgactaaatatttttattttatatttaaatataataagtcaagtgttgtattgcccccctctataaaagccaaaaaaaaaaaaaaaaaaaaaaaacagtgggtcagacataccatgtagaggatgctcacattgtttgctaaattgggataaggawctttaagtttccttcctactccaagatttcatgtgaaaggtactttcttcccttaaattatcttatcattgttttcagttggttggttgcttaggatagaaaaacatttcattttatatataagtaaaaccatgaaaacagtaatgctacttttaacattatcatcatcttaagatgatatggcattttatatttttcaaagaacattcacaggtaacattttagatcaaatggaaataaggtcaaatgaataacatggtacatgtatatgccaaactgtaattgttagattcaaggatggtagcattttaggcagaagacaaatctctttaattagaaatgcaggctgctaagcacagccagtaatgaggagagaagagagaagtcacacaggacatagtttgaatgcagtgctcttctgtccagatcagttggtcatactgtaccaggctacggggttatactgattgtacatcagcatatctatgrtgtcatccatgtatgaagcatccttaggttraacatgttgaaacatgataaaacgtgtcttagaattaacgaaatgtaatatatctctagagctaattttggaagccaatgggcaacagtttggcatttgaatwactcttggtcaggttaaatgcttcatattaaatattgttggtcactatatttaaatatctctaaatggagaatgtgatatagtgatatgtggaactatatctgtcacagggtaaatctcaaaattggggttcagcccaggaggccaagtgggttcttggcttcacgcaggaaagaattcaagagaggataacagagtaaagagaaagcaagtttattaagaaagtaaaggaataaaatggtggctactccataggcagagcagctccaagggctactggttggctagttttatggttatttcttgatcatatgctaaacaaggggtggattrttcatgagttttccaggaagggagtgaggaatttccagaactgagggttccttccctttttagactatataggataacttccagacaytgtcatggcctttgtaaactgtcayggtgctggtgggagtgcctttagcatgctgatgcattgtaactacgtataatgagyagtgaggatgaacagaggtcacttttgtcaccatcttgattctggctggtttcatctggctttggctggcttccttaccacatcctattgtattagcagggtcttgtgacctgtgtcttgggaaactagtcctacctcaataaatagttgaaaaggtggatagtagatagaaaggcataattttcttcttgactattttaaggatttgaagtcttcagagaaacaaagaaaaagaggaaaagtcctattactgctagatacactatagtgaatgaaaaagacttttttccagtatgcctaaacagtattttgatcactgttttttttgtttgtttgtttgtttgccaggtttkgggcaataaaatcacatgtgaaaaatcctcagagatttttaaaaagtaggagagactttagaaatcatctagtataccttcttcacattactaaatagtaaacagattcagggaagtaaatgctgtatttagggggatatacctaagttattcacaaagctagccctagaacctcctagctcctagaccaggacaattttaggataactaaatgcaaggacagtagaaagcagaaagatgattttttaaaattcttctgaattttaagtcttgtgaagtagatacttttgagccataggatattatgtgacctaggagaaattagagaagatttttaccaactcagaaaggtttaatactcaggacgtgaatccttagcatagacattttcacgttactatgcactaagggcttgagaaaatatataacatgaatattcatgaaagtcacttcagcacaggtccctctgaaatttcctacagaaaatggccttctttcattgaaaaggttttaggcttacagctctgtgaattggaatttgaaagttgtcaatgctgtgttgatttactcgagttactgatgataggagccttttggtgtattggagctcttttggatgtacgtgcagaaacccaactgaaactgacgtaagccaaagtaaagaagtgatgtgttattgactcacataagtgaaaagtctggggtagggctcaagtatgactttttccagggttgcaaactctgccattataactggccccactgtttcttggcagtgtttccttcagtgttggcttcgtatgcaggcaggttttccccaggtgtttccaaaataactctccaactgctattttcccctgctgtcacaccaccacaccatcaacacaggagacttctgtgaccggggtcrggggaggggttccccatacaccaagcatgaaccctagctgagtgtcctcttccaattcagtttcacactatctacctggagatagtgtcagatcccacaggttgggggctcagtccccacaagmccccagtaaccctggacaccagtctctaatccaggctcccagaacttctaaccaactggctttgagttggggttcccatgaccccctgtttggatttaatttgctggatcagctcacggaactcaggaaaacacttatttacatttacgggcttattataaagactcctgcgaagggtacagatgaagagctgtgtagggtgaggtatgtgggaaggggtgcagagcttccatgccctccctgggcaccaccacccaggaacttccacatgttcagctatccagaagctcctcaaaccaggactcttgggtttttatggaagcttcttgatgttggcattcctttccccaggctatagcgtgggaccctatctggggagggtcttaaaaaccacagtcagaaaggttaggcaagattagagtcctgccttggggcaggtgaaaggagggaggagaagatcagagagattctgtttcttgaggcctgctcctggggcggaacacacccaacattataacaaaagacaataggagttatgagccaggaaccaatacatgttatggacaaaaaactatacatatatatttatcataacattataacacaatgtggcaagaaggtcaccagccrctccagtcacacattatgccagctgtgagataggcagagagagctcctccttcctcagtttcattactggtatttattctccttgcaccatcctgggtcatgtccctaggaagatgggaggtatcggtcactggtacagaggtgtgagaggtgcgtgatcacctttatccaaatcaattgaactgacagtctggagagtggatggctccctctgaagaggaatatcaaggtgtctcaccaacagggccagtgtccatagggctgtccaaacaacacatagcttcttccttttgcttagatgtcaccgtttaaggatgttcgtgcacaaggtagtatttagaaatttagaaaataaatcatctttccacattcagtgcatctttgcttccagtctgattttgatacgggagttcagaagaaagtacctgggcagatagtgagggtaggggcatcctcggtaagattttccttttaatgtaaagcagcccccaaatggcrtgttcagaatggcggctccatctgcccttctctctatcagtcacgtgtagagtaaggagcagagaagatggtgtccttagagtggaaagtctatttgcataataagattagggtggggtggccagccttctctgcaagctatgtaaaggtcactcctgatggaaccaatgtgttggccctacataaatcagacaccacctcctcaagctgaaatataaaatccagctcatccatcccagccggccttttcctctcggaatcccgtctctatcactagagagggagctsttttcctttctctttctttctctttcttttgcctattaaacctcctctcctaaactcctcctgtatgtctgtgtcctgaattttcttggcgcgagacaatgagccccgggtatttaccccagacaacgtacccgcttgaattttactagtccagtggaggctcccattgtcaaagccctttatagcaaagctcttaaagtgtgtttatttcmtaaagtccaaggattcattgtcttattttaaaamtaatgtttaatcactcactgtttttatgctttatcagcacttgttaaagataatttggcttgaggccaagagttccagaccagcctgagcaatatagtgagacgctgtctctaaaaaataaaaaaaaaatactaaaattagctgggtgtggtggtgcatgcctgtagtctcagctgcttgggagactgaggcaggaggatcccttgagcccaggagtttgagactgcagtraactatgatagtgtcactggactccagcctgtgtgacagagggaagctctgtctttggaaaaaaaaaaaaagagatagctaagatagcttgtatttgtactctgatcagcctctttggaagcccttgtagttctgtttgaatgcctctctttggagcttgggcatggcatggcttaccacattgagcaatggcatgagaccatttctatgtaggcttctaaagggaaacatgctcctgttaatgtggaaataaattcagctgtaagtttatgtttgtcagggcccaggaagagtaagaatacagggtgagaacgcgtagggaaatgctcatttccattaaagcatataaatagagggaggttagagctgtcaaaaacaaatcctccccacatttagactgttaatataaattaagaagttgtcaaccgtgtatcaaggtggaaggaaagactcaacaaagataatgttgggaaagggccatgttgattacagaggatttatagactaattttgatttaggaaatgtattatatcaacaattgctgaacattttctttaattctagaagcaaaagcaactttaatctgaagtcactttatgcctgcttgttttgatctgttttttctttttatttttttgagacagagtctcgttctgttgcccaggctggagtgtggtggcacaatctcggctcattgtaacctctgcctcccaggttgcagtgattctcctgtctcagcctcccaagtagctggcattacaggttcccaccactacacccaactaatttttgtatttttagyagaaatggggtttccccatgttgacctggctggtctcgaactcctgaccttgtgatctgcccgccttggcctcccaaagtgctgggattacaggcgtgagccaccrcacctggctgatctgttttctttccttttctttttatttttttgagacagagtcttgctctttcgcycgagctggagtgcggtggcacaatcttggctcactgtaacttccacctcctgggttccagcgattctcctgcctcagcctcccaagtagctgggattacaggtgcatgccaccaagcccggctaatttttgtatttttagtagagacagaatttccccatgtttaccaggctggtctcgaactcctgacctcaggtgatctgccagccttggcttcccaaagtgctgagattacaggcgtgagccaccgtgcctggactgttttctttcttttctcggttgttttgtcctgtctctgccaacagcattattgaattagctgggggttgccagtgcttcctttccctttcccatttcttttcatggggtcttgctatgttgcctcaaactcctgggctcaagcaatcctcctgcttcagcctcccgagtagctaggactacaggcatgcacaactgcacctggctttgtgttattcttttttagagaggtatattcttcactttgttggatgccaattttgtttatgaaacatttgaattcccaagtaaccttggtacttttacttattttaaaagtaattgaatcttcctctcctttcatatatttttggcctgattttttgcagcatttgctytcttattatatttgattggaattttgctcagaaataagatttgtttctgatgatttatttttggatgatttgattccatctataggattacatgacttaataactactagcatataaattcactcatgaaatagagaacctaaaacatttgattgtcaattttagtggaagatgcatacaaagtttcgtctcagttaccaccttatttcttgtggtcctacatattattttgcgagtggctattgctattaactgaaagataactttttgaatttttattttgtctagtagtagcactagtataaatattactgtcatctgcttctcattttaatttgaaagaaaacatcttttaatgattcctgccttataaaccctataatgattttctttcctaatttttctatgagactgcttgagaaggasggagaaggaaaagctctcgacactgtgaaatagcttactggaagagtaagcatttaagctcgtgcaaaaataattgtttctttaaaaactgccttttcgctacagctacacttttcttgtcatttccttttgctctccagttttaaattacacagactttcgtagagtgcccactctccctttctcacctattcattgtggaaagattcctgtcagggctaatctttaataagagaggcagttacrgtaactatagggcgaagaagggaacagtaaaagttgagcccactcagatgtcatggacctgaaaggtgctggtgggttggaagcttcattatgctcagctgctacaagagatttcctctttttagattgattaagaaaaggggctcagatgacaggttaataggctgcccctcaccagccattgtggctcatccaggagtgggcacaccatgggaagaacacacaaaagagaaacattttgcagaacaaagaccactccaggagtattgaggtaccaggaggaaggtggaatagaaccttgtggcaatgaaggaaagaaaaaaatcattgttttaagagggagatctgctgctggctctgctggaagaaagtagagtccaggatatcttaggtgagtcttaaaactgaaaagtaacactgtaattgacaatagggagagggtgaggaaagatccagagtttctgtccatgctggtacctcaactacaaaacaggaggcttaagggttttcgcagaatctgagtagaagtgatacaaaaatgatacattggccgggcacggtggcttatgcctataatcccagcactttgggaggccaaggtgggcagatcacgaggtcagaagtttgagcccagcctgggtaacatggtgaaaccctgtctctactaaaaatacaaaaatgagccgggtgtggtggtgcactcctgtaatcccagctactcaggaggctgaggcaggagaattgcttaaaccacggaggcagaggttgcagtgagccgagatcacaccactgcactccagccttgacaayagagcaagactccacccccccgcaaccccgccccccccccsccccccaaaaatgatgatgtatcatttgaaaaaaaaatccattggtttcaaaggagaaatactgctttgggttgtgcattagttgctatttgactaagtcatgttttgctaaaagtatcttcaacatgaactctggggttattttcttgttttttatttcccctcatcagtcatcacccagagattcccaggctggaaattccttctttctttattcatatgaaatttagtttttgcttataatatagacttcacactgtttccttcttagaagaggatgttttaatgtaactgggtataagctgtattgaggcatgtaaaacaatgaaggaaggaacccatttttatgatgaagagacaggaaaatagagttgtgacactaccttagtactgagaggttttttaaagatctagtttggatttttgaaagacatacacagatgactagacattgaatgaatgtacatttttttttttttttttttgagatggagttttgctcttgtttcccaggctagagtgcaatggcgtgatctcagctcaccacaacctctgcctcccaggttcaagcaattctccaacctcagcctcctgagtagctgggattacaggcatgcgccaccacrtccggctaatgttttttgtagttttagtagagacggggtttctccatgtcagtgaggctggtcttgaactcccaatctcaggtgattcacctgcctcggcctcccaaagtgctgggattataggcgtgagccattgcgcccggccgaacaaatgtactcttagacatttttttaatctttagattgagcatctttggatatcagataccagytgagtttaaataactagtttccattactagatgaaattttgatgagaacctttagaaggttagtaatttctttgtccaacccaaatgtagtttttatattactcatagtaaatgccattttacattttccttcaagatttgtcttgcttaacagtgctgtctgtcttccatgagtcatactgacccagtacaaggtcctcgtgggtgatcagatctcaccaaaattggtttctgatgctgctgaaactgcatatgaccttgttcatgacctctggtgctactccaagtagcttggatatggatattagtattagtaactatattatggtacttcatagtttacaaagggctttcatatattttacttactttgatctttatggtaattatttgatatagttaaggagcaagtgtagattttttattttttaataaatgagataattgaatctcattgaagtggattattccaaggttgaccatctagaaagtgagagatttgatatttttaactcaagtgttttgactcctagttcagagttctttccactctagcattggcctcaaaatatcaagccctaagaaattctgttagttgcttcctttatttttgtgctttggctagagttttattggttttatttttaaatttgcatctttttactcactcattcaatcatcaaacactcactgaacatctgttatattccagggatgatgatacacacaggtgcagcaagaataagacatgaggctcattcttgcagagtacagtctaagaaagagagagtcaaaagcaagcaatgtgatgagggttgtgaagcgtggtcccagtgaggaaattcatcagtctactcttckatttacagagtggtttacactttgatcctgtagaaatgcattttttaggcaacttagaacggtstttcttaatatgcctcaggtagtaatgggatggactaatctgtgtgaaggtaaactgaatggcagattgggaatagctctacaggactgtgttacatttaacagctggggagacgggcacactgctcccagcgtggctcttgccttccacgcactgccctggcatcctgatcttttttgtcttagacctgtgttaacacagacactatcatgatcagttatctgctggttccctctaagtggtctctaagtgctttgagtgcccttgttgccaacatttttagaatactcaactcagcatgtccaacttgttcacatgctagtagtgcattttatcttctcagccattcttcttcttccattttctatggtaataccatgcatttccttggtattttagagcttaaagatagtctctcatttaaagggatatcgtccaatgtttaagtcttgtcctcgtgtctaatctcaagtgtgtcctrgcagtcctccctttactaaggcagttccctgtctcrtattcctcaaagcccstcttcccttcccattctcagctgatttcactgagaaaacagaagcagttggaagagaacttatacatcctttcacccgccaaactcccagccactttacctttgctcctatctgaagccaccacctccacctgtgctttgatcccaggtggagatacacctatcccatctcttgcccaaatcactaacttcttatttgatcttttcaggattatttccatcagcatgtaaacatgtgatcatatcttcttaccgtccctcaagtgtatcaaaaacactgttgttggaactttctcctagctagcctatgattttctctctcacaaattcagattatgttagcagagggatcttccctgtatagcccatttaaaatatcaactcccattattgctctgtcctaccctactttattttctttataccaattccccaacagatgtgtgtgtgtgtgtgtgtgtgtgtgtgtgtgrtgcatatagayacattgtctctccctattttatttctacaaagacaggagttttgtctgtttcgatctttcctttccatagtgcccaaaatagtgcctgaaatgtcacagacagccccagatatttacttttttgactccatatcgtcttcagctactataccatttctttgctcacctttgtaaaacaagtcaagagttgtctgtacctgctgctctgctgcttctcttctcattcattcttaagtcccctccattctggatctcttccccacagctccactgaaatggcccttgaccagaccaccagtgaacaccacgttgccaaatgtaatggcaattctaaactgccttctcactcaacttccaggtagcattctacctggttgactattttttctctttgtaatctgtttagatcggttggcccctgactttctttctaccttagaggtcattctttataattagcctttgttgaattcctcccctctttccaacctcataatgttggtgtgcaccagggttcacttttagatcgtcctgtctttagttacctattcattcccttagtgatctcagctggtatcatgtctttatatatgttcttcacagggatgagtcctaaatatttatcttcagccatgacatttttcttgaattccagatttgcatatccaactgccaacttgatatctcacttggaagaacatcatcacaaacctaactcatctgaagttggcttcacattctcctcccctatcactaactgcctttcccacagtattccccatttcggtacatggtaccaccatttatccagttgttcagacctaaacccttctaattattctttttcctatcgttatcccamatcagcaaatcctgtcaattccatttttwaaaaaaatatatctggattctgaccttttcccggcacttccacaggtcacaccctaatagaagccaccatcgtcttttgcttggctacggtaacaacctctcatgcccctagcatggcttcctgagtggttcttttagagtgggaatgagtcatgtccttcctctgcttgcaactctctgtggctcccaaggtacttggaccaaactccaaagcccttctcagtcctccgtggccctctgggtctaccctgcctggtctctgcactcatttcctcctactcaactcagcccaccagcccatttgttcttcctggagccgactgagacatttcctactgcagagcttttgtgttggctgctctttcctgcctggaatattccacaggctcactcccagctttatgcagttcttggattagtgtcccctcatcagagaggtcatttacgaccatcctgtaatatatccaccttgatccttcagccctgtcgttagaattcctggcttttatcacgagctgacattacattttgtaactattcatttacttgtttatcaatctcctcccaagtgtaagctccatgggtgtaagaaattgttctgtctcattcacagtcttatgtgttgaatgaatgaatttaatttttacaaaaatagaaatgaggaagtaacaagtattcgtagtcttttatattctggtaattgtttcctgggtactttgttaaaattatattttgattaatcccttgtgacaatcctctaaggtggagatttcagagaggaaraacattgcaatcccagtgactagtaaaaggaaagctagagagctgggatgcaaaccctgggtgtgtctattgcaaaagcaaatctctttccacttaatccatattctttatttattataaattataaaataatggttgggcacagtggctcacgcctgtaatcctagcactttgggaggccaaggtgggtggatcctttgaggtcaggagttcgagaccagcctggccaacattatgaaactccatctctactaaaaatacaaaaatgagccgggcgtggtggtacacgcctgtaatcccagatactcgggaggctgaggcagcagaatcgcttgtacctggagagggagattgcagggagctgagatcgtgccactgcactgcagcctgggcaacagagcgagactccgtctcaaaaaaaaaaaaaaaaacaacaacaaaaagtgaaatagtaagtatacagtggatattacaaattattattatattacttattatttctgtctaatagatgagatcactgaggatgaagtgacaggtgagttacctggggtcatgccactagaccccaccactcatgctggaaaaaggacttcagaacctggttctgatttggcttcagtgggctctttttgtacaaccacaagatttctgcaatgcagatactttgtgtatctcactttatctgagcaacttttacgttttccatccattatattttaccccttgtaaactggcagaggctcacatttgtaagttaaacaccaagcttttcaaaacctagtcctaaaacttgtatcatgattttgcttcatgtgcaagctaacctttgatttctcttcatagtacctgtgtaaactgaatgaaaacagcagttgaactgaaatttgctgttttgcttgtacttactttctcctctgccaatgtacaacctaacttttatcaggaatagtttattgctcaggtatagtttgctggttcatccgttcattttcaggctggagaaaagccttcagctgaaatatctaccaattgcaagaaaagtgaggtaatttacggaaagtctacaaaaatagggagtcatggtgcctggtacaccagatgataatcaacatgttaattaaagaattatgtttataattagcctgaaagaagataatttaataggttggccaattacagagataaattggaggctgaaattgcaaacttatatttcactgtgtttttcaaaagcacatctatgaactgatagataaatgttatgtccatacacacagagctatgaaacccttctataaacatgaaattggggagatacatgtcaaaacatatcccagaaacaagattaaaattacttctgtgaataatgctataccatgccccatgtttttgctgaaaactcattggtgtttattctcctatgatggtatactaaatatctgtccagattactgttattttttttatttagtcttgagaatttgccctgtgtttgtgcaatacaagaaaaaatacacttgctgaaggtcattgtgttgtgcaatacaagaaagaaccatgtcttcaaaatcaccttatcttgaaataatagattttggatagagagatttaggtcttgaaaattgcttctaaaattacttctccatcttttcttgtgcagtatttggagcttatgcaataaaccagtcttttcagtatctctctttaaaatgtgatattttcagtgtccttacttaacatggaataatygtacacagtggttttcttttcagaattttaacatggtttgtacaatctgagtctggtataggtctttgagaatgtctaccacttgtttattgtggtctcattctttagagaggaggaggatggttttcagcattctaaaatatgcaagcaacggacaccaatctgttatgtgtactctatacatatatttatacttacacatgggtctcatctgctctaaatatttaagcgtggtatgaataaatacatttaatgtttcatagacacataatatctcacagtttgtagaacagacaatgctctctggtgtaattaccaggctgatcctaaggggccagcctgtctggcacttgctttcatctctgaatactttatgcttatggataaaccaggtgacaaggagatgccttggagtgctaaattctgcttgtctcaatgtttgattttaactctttatgtgctaatgggaacactcattttctttaacagccatttctttgggcctgttctactttaggtatgagaggctcaggaaaactttcttatcctcagcacacacattatgatgaagtttaaccagagtcttgataagtgagcaatcttcaatgccaactgggaaattcagatcattcacaactgggaacataggcatagatttgattcatgctattttttaagtggaaaagagaaacaggtgcatttttgttgatgttactgtttggtgaatgtatctgtcgatgttaatctcatctcacatgaaacagacactgaatttgaatgtctgaaatatgtccagtctttttagatctgatatttttactcatatgccaactttcttatgataattgtcaaattaaatgctaaattctgatagctgcttccattggtggattccacatagatgacatctatatccaagccattttaggctcttcacttctttttatctttttctaaaagttaaaacatttcaggaccttacttagtttaggggatttataacataggaacaaaaaaatttcctttgcctcctggtttctgggaatctgtctttctttctttgcttagtatttatcaagaagtatagtttgcgatcactacatattagatgacattcatgagggcagtttcaatttttttcacacattttgaaatcaaatttcactagacaatagatgggatctatcacgatactgaaatggattttccatgtgatcatatgggcacattgatcctgactatatcagttcttctgtgattggcactcgattgattgcaggattgtatctgcatccacaaattatttgtgtgatgttctagttgtgctgcttgctataccagtgtgtgtgtgtgtgtgtgtgtgtgtgtgtgtgtgtgagtttagcttttctttagtaatttcacagctctactattctatggcctgccaagggggacacaggagtgtggcagagggagaagtcagccaggtgatttggagtttattccctgacagtctttagaattgccttttgatgtggtttggctgtgtcrccacccaaatctcatcttgaattgtagctcccataattcccacatgttgtgggagggactcagtgggagataattgaatcataggggcagtttcccccatactgttatggtggtagtgaataaatctcatgaaatctgatgattttataaggggaaacccatgtcgcttgtctcacattttctcttgyctgccgccgtgtaagatgtgcctttcgccttctgccatgattgggaggcctccctagccacatggaactgtgagtccattaaacctctttttctttataaattactcagtctctggtatgtctttatcagcagcgtgagaatagactaatacagtaagttggtaccaggagtgtgagaacagactaatacacctgtgtatggtgattatagaaaggaaaccaaattttcatcagtagattaccatttcaaagctccctacaaagtcaycaccttcttgcctgyatctggggctggctgtgcccttgactccttcaccttccttggttctctgctgctcctcttaattattccgtttcctggattttagggtaacatggaaacttgtgaaagcggtaattgaagaggaagacactctgctggcttctgagccaataactttgttttatcaagtactttaatgaattccaaaggatatggcagatgttaatacattcattcttcctaaaatagcccaaaaaagtaggcttaactctagtatttttccatctctaaaatgcaaagtgagaamggtcgctttctcatcttctgtgctgatctccctcttccactctacttttttctcctttaccaaaaatttgagtgactttacttgaggctgcccttccttagtctaaattttaattacctattcatgatatagccaaccttctctttctcacctcaccattgcatcccactcctccattcaaaccaatttgcttggcattttctgtaartttgtttttcatgtggttttgttgtcattgacactattcagggtgcatacgataagtctagagtctattcactttagctgtagcctactatctaaagatatttgggaaatcacaggactgtactttgtcttttaatgcagtgatttgatatcattgtaggagacaatatagtcttgaggctaggagcatagattttggaattgtgtgggcccagatttgtctcattcgaccacctgcgcatccatgagcaaatggcttactcttacaatggctctttctgctcatctgtagggtaaccataataatagtaatagtaattaactcatagagctcttcatttcttagccattgaccgtcgcttctgtgccagatgctgtgctatatgayaggtataagttgataaataaaactaacatgaacctccctttgctatttcattgagataatgcatagtacctgggagtagatgcttaatgatacacctaggaaggaggtagttctagaatgtaatcaatggtagcttctttcccttttaaaggtatagaaagtatcattcattctttattctccaaatagaggactgaatatctactatgtgctgggtaccagggatgcggtatgaacgaggtcggcagagtctttcttcatgcagtgtgcgtgcttctgttccagaagacagtgagcaaggaaacagttgagtaaactaagcagttatagagtgtgatgcatgttatgaaggaactggagagataatggtgggaaggaaggtagggtgagaaggagaggagagggctaataaggtaagaccttaaaaatgggacagagcaggttttgcaaagatctggaggaagaacaagcaaagaccttgaggtagaaaagggctttgtggccaggcacagtagctcacgcctgtaatcccagcactttgggaggccaaggcgggcagatcacctgaggtcaagagttcgagaccagcctggccaacatggtgaaaccctgtctctactaaaaatacaaaaaaagattagccaggtgtggtggcaggtgcctgtaatcccagctactcgagaggctgaggcaggagaatcccttgaacccaggaggtcgaggttgcagtgagccgagatcgtgccattgcactccagcctgggtgacaaaagtaagactccatctaaaaaaaaaaaaaaaaagaaagaaaaagaaaaaaagaaaagggctttgcacatctgaggagcaaaatagcggtatgtgtggttggattgtagcaagcagagtggagaatgacgtgagaaggtgttatagatggaggaggaagtagatcatgcaatatgtctgatggactgtgagaagctgacttcctctatggccagagtgatgtcagggcaggtaacaggactacaggcagtcaggaggaggaagtcatcaggatgctgcctgggaatctggcattcattactgtttgcttgacagtgccacttatcaagataaggaactatgggggatggcaaaatttggggtaatagacctattaaaatgtgatcattattggtggctattcatgaaataaaggcatatctatatattcttttatgtacctcttggtttctgtgacatttaagaaaagtgttcaagactttctttgaagatggctcaagtttttatttttgctgcttcttagttggcaggaactaaaagtccaggtcactaaagattgctgatggcttgtgaggacagccctgagtgagactgaatcagttggttgacaacagactgtgacagaatgctaaggsgttaatttagagtttattggtgcagtatacctgctcagcactgatggatttcctgatttagtgtattaaagatgaaaaagtaaagttcctttctgatagaagtgtttatttctactaaactgggactagaaaagcattgatgaaagtttatatattcagagcaacattctgccttctgccttctgcttggccagctgccatctctgactgatggaaataaagtgagggctctgacatcatcttgatggtgtctggtatttgggtgtttctgtccagctccctttggctgacattaccaaggcacactgttaatactggcctcacaggccataatctcttatgtgtcattttgtatttaaacttttgcataagagtcatcagcacagaacaacagattacttctgtagctatattatttttgagatagaaaagatactactggaccaggcatggtagctcacacctgtaatcccagcactttgggaggccaaggcgggaggatcacctgaagtcaggagttcaacaccagtctggctaacatgatgaaactctctctctactacaaatacaaaaattagccaggcatggtgctgtgcgcctgtaatctcagctactcaggaggctgagacaggagaatcgcttgaacctaggaggcagaggttgcagtgagtgagtcacaccactgcactccagcctgggcaacagagtgagactccagcctgggcaacagagctctagaccatttaaaaaaaaaaaaaaaaaagagagactaccgtcaccttgtataaaaccacacacacagcataaatagttaagcctactaatgaaatatcctgtcatttcctctacttaatagaaggctacagataggcttatacagtaaacatgtgaaaggtacagttgayttctctgcttgaatttgcacatggggggaattcgttctcttcttttgcccttttcacagaaccktaaaatgtgaggactgaaggcaccttggaggatgcccagttcatccactggtggggaactgaagactagacagttacacggtagttcaaatgcaatcatatcactgcaattaaaactatgagaagactagattattctgtaatatcaccacatkaggaatatgaatcactgtcaaatagcagatgcacatcatatggatatgattgatgtgatcacatcacttcttttagagtctgtggatgactggtcactgtgtattggtttttagttcatgcatacaaggcaaagtgtgtagtgttgttaccttcttgttccccagtgatccaagatttacaaaaaatgaataagtggaaattggctaacagatgaaagtacatcaaagaaacaaaaagtgataacattgggaactggaattccaattgaacataaaggagttctaaaaggatgacctggctatggaaggatgacagtcctgccctttgactgcctgtaaatacgcacccagaggaacttagtgaaagtgagcttattgacgtgtgcaaggaaaatggttctgacccataggatgtaggtgttccagagtaaatgacaccaggtgaaaaacttcacattaaagaaccctcagagatatttcagcacgttgaaagcacaaaggagaaaattcccgaaggtgattcaaatgtaggagcatgacaatttgtccagggatagcaaagatgcttattccactgggacagttatattgtgggatgagtgaaggcaggtcacaagtgttttacaaaggaataaaacactttgatggggtgccgtgggtcacacctgtaatcccagcactttgggagaccaaggtgggcagatcgcttaagtccaggagttctagaccagcctgggcaacatggtgagaccctgtctctacaaaaataaaataaaataaataaaacacgttaattctcaatgtttccagtcttctaaattatagtgtactaagtacatttagttttattatttagaaaatgttgtctatacatttataaatcatagggagtttgtcatgtttggacaaaaattcttaaaggtcatggaacaatgataaacaatgtgaattttcccaaagcttgtctgaagacatttttatggtcctgtactagcatgcaaactgaggactgcctgtattttaaatgaataaatatagactgagtgaaagtccaaaaatattggcttcttttatttggaattatctcagcttattctgttaactacttatttgctttaacaaaaacaaaaaaatagcatagataacattttatttgtctgtatgacataaatgtcaaaagcaatgatgggataaatgagatcaacttgtaagcacttatcaccatgcctgcaacataactggaacttgataaatgcaacgcatatctagaatttgatcatttctctctacttccactgctaccattctgttttgagccaccatctccctccctgaatggttgcagtgaccccccttgggtaactgcttcttccttgcctttctacactctacatttagtacatgacccagtggctgcccatttcccccagtaaaatccaaaggtcttacactgacatcaaggctttccatggtctgggcccattatctctgacctcatctcccacccacttcccctagcctagtctgctctagctgtgaattttctgacgatgctaagtccatgctttcctgcctagagggctttcaccagctttccctctccctggattgctccccctccactggtgctcactccaccrggacggttatattgtgggacgagtgaaggcaggtcacaagtgttttacaaagaaataaaacactttggtggggtgccgtgggtcacacctgtaatcccagcactttgggaggccgaggtgggcagatcacttaagcccaggagttctagaccagcctgggcaacatggcgagaccctgtctccacatcgtcatttgatcaatttctcattcctccttaaagtctttgctcaaaagtcaccccctcaatgaggccctggcaattctgttcaaaacctcaacttcccccaggctagtagcatctccgatccccttatactattcttttttttctttccatagaacttttcaccttctaagattttcagatttttagtttattttttaaaatttgtcctcttctcttgctagaatgcaagcctaatgagttcggggatcttttgtttattaggcaatttagctcttataatatttcctagcatgtattgcatctgagtgaatatcttttaaatgatgaatgactatttgaaaggaactgttgatgttgtttgagaattgttctccattctgtactgttccagcagacttggcaacagtgattgtagaaatcatgtcttatttactcatcacaaaattgtcagaatccagtactccagttctggcctttcttccataaatattagatctctgttctaaagagtttttttttttttttttttttttttttatgatggagtttcactcttgtcgcccaggccagagtgcaatggcactctcttggctcactgcaacctccgcctcccaggttcaagtgattctcctgccttagcctcctgagtagctgggattacaggcacrcaccagcatgcccagctaattttttctatttttagtagagatggggtttcaccatgttggccaggctggtcccaaaatcctggcctcagytgatccacccgcctcggcctcccaaagtgctgagattataggcatgagccactgcacctggccaagagttttatagtcacaggaaatacagaaaggaattcaattcaacatatattgactgaacattttctatgtacagttgtctaaaatggataattagtaacttaggttttcactaaagcatttattttcattaagccactggtttccgtggagtttaagctgatgtgctggagagataaccacaggataagatacatatagtgagctttctgagttgatgctaattatggaaaaattctcaggacataacttagaggaccagttacacaaagcctaaacctggaaaaaaatctcggaagactggaggagtaagagtttagggaaaatacttggcatgatgtgagagattttttttttaatgactagagttattaagactatttattgagttttcaagagtataatatatgactgattcgtttagattatgtacacaaagagcattgttttacttaaaataggggaaaaagaagggactgcattgctttttttcagtgatgcattgggttttatattgaggctgtggatgcttatgatacattaaaatttgtcacagcaataatagacaggatcggtaattttcctccaatattgccctatttcctggctgcatgaaaccatgaaatcacttaatgggatcatacaataccagctttgattggaaattaaataagatcttaccttggcagttctaaaaagagactccatctgtcagcatggcagcatgtatttatgaataatcttaaggtggattgtgataagcaatcacttattgagttcataacatttgcaggcacagtgttagacaatagagatgtactggtgagcaaaccagaccttgttcctgctctcacacagatcctaatgctattggaacccatagaaatggacagaattgggtctaagtaactgcaaagaagtgatttctgtctgcaagtaacatcactgtcatggtttatgaattctgttccttgttattaaatatcaaccaggaaactgatgtgaaagtggcatggggagatactaaataaaatgcgtaggctcacccttgagtgcttcaagatgtttgtatgggaggaatggagtatcttttgtttgattcttatttgttgtaatggaaaggcagaagcccctctaaataccacccccttgctgggatcaaattggattagaggtcatctatgtatctatttaatagatattttttgattgagtgcttcctgtgagccagcattcttacaggctttggtgatcaccattagtaaaagtgacaaggtcctttcccttacagaacttgcattctagtgggggaggctcagaaaaatttaaaaaaagcaaatagcatataatatagtgtcaggtagtgataataaaggggaaaaaataagagaagggactcagggtgataggggctgctattttagatagggcgaccgtggaagtggttttctgtgtgtgtgacctcacaggtttgtgagcagcagtcaagctaactttgctcagaattactaaatgtacaaacacacatgcacatgcacacacacacacacacacacacacacaggtgcatacacataggctttcccataattcacccctcaacatgtccccattatatccccctcttccactgtcgccacccctgctatccctaagctttgggctttctctgtctcctgctttctacatctcctgattctttgaaggttttctattttctttctcttgttctgggattagccggtgtacagtctggccaagtgtgaggtccctaggcatccctgaatgccttatctactttctttgctaactaaggcttgtatatatctgcattgtagctacagttccttatttggccaatcctcagtatgatgatttggggaaggcaacatttcttcactattgagaaagatctcatgttgagctttgtttttgaactgcaatgtccaaagtgggcaattcaatgaaagggtagtgctgatttagtggtattaacttattacaaattttgggcattgtttgttcttatccattcattcaactactattgattgaggcccttttatatacctgacattatgctagatactrgggctataattctaggtaaaaacagactcagtttattttttattattattattatttttttttttttgagacggagtcttgctcttgtcacccaggatggagtgtagtggcgtgatctcggctcactgcaacctccatctcccgggttcaagcaattctcctgcctcagcgtcccaagtagctgggattacaggtacccaccaccatgcctggttaatttttgtatttttttttttagtagagatggggtttcaccatgttggccaggctggtctcaaactcctgacctcaggtgatccacctgcctcggcctcccaaagtgctgggatgtgagccattgtgcctggcccagactcagtttaataatcagacattaataattacacaaatgaatgcatgataacaattgaagaaactaaaagagaaaatacaatgttatgggagcacaaaacaaaagaattaatagcctggtgggtccaatctcaacacagccttgaaaggatgcctgggttgagatttgaaagatgggtaagtattaactagagaagagagaaaggggtttaatagtgcatgcaaaagtcctgtaggagaaaaggcatgaaggaaggttggttggagatattgggctggtgccagaccatgcagtgcagagccttgtaggctgaaggatttttttgattgtttgtttgttttttgagcgggatcttgctcagttgcccaagctggagcacagtagcacaatctcggatcactgcaacctctgcctcccgggttcaagagattctcctgcctcagcctcccaagtagctgggactacatgtgcacactaccacacccggctaatttttgtatttttagtagagatggggtttcaccatgttggccaggctggtctcgatctcctgacctcaagtgatccacccgcctgggcctcccaaagtgctgggattacaggtgtgagctaccgcgcctggcctgctcaaggattttttggcttttatctttagagcaattggaaaccattgaagggttttaagccagcatgccgtatagtacagattgatggtgtggcctcaagctaaagctccttggaagggagtgtgcagtgtggagaaccattcagtggattttgaagatgtcaaaatgagagataattgtagcttggactaaggtggtgagaaattgatggattggaaaagtgttgatggagtagaatccacaggacttggtaactccaaggtggatgtcacccttttgttaagtccttccatttatctgattgctcttgaggtttcttttaagtggttgattatttattatttcatccagaatttgtataaagaaagatcaataaatttgtttcttcatgtttgtttagtaaagggtgagtatttaagggtgctttcagtgcttctgggccaaggtgaaaaaaatgatggtcatcatgtgcatttcagcactcagaaacactattggcacaggcaaccaaaatgcaaaagcaagacatatgaattacaagtctgcacctcagcggctgaatagcaaagactaattcggaagaggccttatgacccaggaagacatactttaattaatatctttattgtcctgtcaggtaggttaaccctctggatcccatcagtatttggcartgttgrtctttattcttggaatagaaactagattgtgtgtgtgtgtgtgtgtgtgtgtacatgtatgtgtgagcatgtgtgcatgtacacaatatcctcatgtgcatttcatatatatgttacctaccagatgtattacatatggataatcataaatagaaaacattaagctatttatcaaaacctctcaaatgcctactctgcatgctgtcagaccacagtgattctggagaggaagtgtgctctgagatgaatgatggggttaattaaaggcaactggaaggtggcttgtgaattggtgtttggttcattaaatgttcagtatattttactttctgtccaaaaggaaccttttgattactggaaagtaaaatagaagcagctcctgggcaaactggcaaaagctttgatgagtatgtcagattaggttgtatcattcaaagttgaaccacgattgaaagctgtagctatagcctctctccttggtggtatagcagagctctcctgaactgaaccatgattgaaagctgtagctatagcctctctccttggtagtatagcagagctctcctgaactgaaccatgattgaaagctgtagctatagcctctctccttggtggtatagtggagctctcctgaacttaatgttgcttcattaccatgcactccatcatacaatgttaagggactggattgaagtgaaactttgcgtaagtgagttggtctcatacattggataggatagcttaatatagtatttaaatccattcctttcccttagatgattggtacatctcacatactgatgggcatctccacacgagctctaatttctgatttgtccaaagtgcacaggcttattttaatatttgactgttaaagattgtcttcaaactcctataggtttcctatatcatatatcaaaaagatactcatatctggctgggcgcagtggcccacgcctgtaatcctggcgctttgggaggccgaggtgggtggattgcctgagctcaggagttcgagactagcctgggcaacatagtgagaccctgtctctactaagaatacaaaaaatgagcagggcatggtagcgcttgcctatagtcccagctacttgagaagctgaagcaggagaatcacttgaacccaggaggtggaggtggcagtgagctgggatcgtgcaactgcactccagcctgggtagcagactgagactctgcctcaagaaaagaaaaaagagaagagaagagaagaaaagaaactcgtatatttcttaggatccatatattttctgggtccctttctgggccctagatcctcatctaacaagctctcaagtgtggctcatattgagagcttcttagaaatgcacaatcagccccactcaagactttcccaatcagaatctgcaccttagcaggatccatgggcgataggatgcaccttacagatagagaagcactttaacatacatggtaaaatcaattgagtctctagaagcagtgtgggatgggattacagactgaattatctgaatctaattcagatgaattaggtttagtgatcaatttctggaaatatgtctgataagccctctgtgagtaacaagttactttatgtctcattttcctcatctagatatgtgtgggtcctctttataccacaggggtagagtgaggattaaataagttaatgccaggatgggcattcactgtacttttggtaaagacggtgtgccttctcttcttccggggcttactgagtaagctctgttactcccacttgtcccatatatctgtggttttgtttttacctcatcttgctgtcttctcttattctcattcccaaactgtctttagttagttattaataatgtattaaattgtatttagatagcctctagcatccaaaagagtaagagtgtagttacttacccaagagtgtagtttgcatgttagagttagttccatagggtaggtgagacaaaatagtaaaagcctctggggatttgataaggcattgaacacaccagcacaatttttggttctttttttattacaccacaatatagctttgatcttgcagattatataagctccaaagtacttcatgattgtttttattatagccacactgcacatgaatttatattcagatgtacccatcctatgggaataatgctatttttttagcagattattttttaaagcaaacaaatgaatgttcactggaaatcagtgagcacctggagggtcagttaggaggtggttgttaaaaatattgggctttgcctgtggctggtgctataagctacgctattaaatattggtgctaccatataggaaataaaggcaaatacagccgggtgcggtggctcacacctgtaatcccagcactttgggaggccgaggcgggcggatcacgaggtcaggagattgagaccatcctgaccaacatggtgaaaccccatctctattaaaaatacaaaaattagctgggtgtggtggtgggtgcctgtaatcccagctactcgggaggctgagccaggagaatggcttgaacccaggaggcagaggttacagtgagccaagatcatgccactgcactccagcctggtgacagaggaagactcttgtctcaaaaaaaaaaaaaaaaaaaaaaaaaaggaaataaaggcaaataaaagcattaccaggattttaaatacaaattagagtggcacctttccaatttatatagcatattctttttttttttttttgtgagacagagtttcgctcttgttgcccaggctggagcgcaatggcacgatctcagctcactgcaacctccgcctcccaggttaaagcaattctcctgcctcagcctcctgagtagctgggattacaggcatgtgccaccacgcccagctaatttttgtatttttggtagagacagggtttctgcatgttggtcaggctggtctcgaactcccaacctcaggtgagccgcctgcctcggcctcccaaagtgctgggattataggtgtgagccaccgcgcccggccatatagcatattctttaggttagctaaaaataaaaaaaaaaacaacttgccgtctgcttttgagtctttattcccatcacctctgccctgccatactaccttggtgaagggcttctagaatatacttgtgtgtcctttttctctctaattagaatggttgatgattatattgctcttttactactctgttatgttttcttttgtttccttgaggttgagatgtcaaaacacgtaaatggtcagactttttaggcccttgccaygtagaacctgtgttttccattttcttactgtgcatttggtgccttttgtatgctagtcattatgtaaggtgctttatcggatttacttcgtcattttagaaattcagtactttgcctcagatcatataacctagtacatggtgagctgggatgggaatccagatcttgcttgtcctaaagtccgtgattcctgcagcactcccactgcctgtattgagtcattctaattttcgtctttccccatgtacagtttcttcagtaaccttgcttaatgaattgattggaaacctgttttggctttcagaggactgaaataaattgtctctccatacayttttaagcaacccaggatcctttctgatatgatcaagcaactaatgcttggttgaactaagatgacttttaccatcactttgaagtgagaaagttctgttattgacctgttttcctgtgtgagttttgaaatgacatgtgtgcctgctattagaatctgttccgttcttgatgatacttggtgtcctagaaatgtgtcagacaatttcttgttaattttgatgactaaaatagtgacgataatatgaaaatcctgtattttacttttatttgttcaggttgcctytggggatcagtcagtacagtcagaaaactactgattgccttgaatggccgtagctcccctcttttcccctactcagttgcctttttgcaaataaaaagtaygtgagggattgattccgtaggggtttcttttggttgtttttttgacagtagtttttacattcggcacagatttttaaaatgcactaaaataatgttcttcaagatatgatttggactgtgcagtcatgtcacgtctcacttatttttccctctctttctccccctttgcaggatgatgaagtggttctgcagtgcaccgcaaccatccacaaagaacaacagaagctatgcttggcagcagaaggatttggcaacagactttgtttcttggagtccacttccaattccaaggtgggatgaagtctttcaaggctattcaaatatgcaagttttactagtggcattgaagttatttatgagctctctactattttctgtggaatacatactatataaatgaaagggatataacaatgttttccatctccattttgctgatttttaattgagtctctcctgggtacaaagaactagggataagattattagcaagaacacagaaagtccttgccccatgaggtttatattctagtagaaaagcaaacaagtaaatcartgatataatttgaaaactgataagggctaggaagatttaatggattattaagtttgtaaaggaaccaatagtcttaggctcattgtatttttttataagatagactttcaattttccatattaacgaaaagtcaaaactctaaatcccagttcatgtttaaaatacgtaaacctgggtctagatgcagttcacatagatatatctggatttgactttcattggtagaaaatgggatatggcttttttttttcctcaaagtgttatctcttgcattgatcataaagggcaaaggacagaaagattgttggtagtaagtagtcagatactgtaaattatagatatactctttgaaatgagcccagcaatatcttaagctacagaattttaaaatcaaaggcagaactaactttttgagacaatcgctccgaggatatttattcttttaggctgatctttgcctaaaagagaatggttcataatatcagcatagattttcttgcagaaatataaacacttaattctgttgakatgttttgattaattattcctgattcctaattgtggatatttactgtatgttctgtatatgaatgaattttcatctgtgtctctatatttcagaaattagaagttgaggttttgcttttaggaactattcactttgagacagacctaccttgttattattaaaaattcagggagaaatgaagccttatcaaaaaggcatagtttttcatctctttgaatctccacatgcaaccagaaagagctatgaagagggtaaaactcacagccacagacaatacagtatctaagacaaactaagtggcaagttattcctacgtatggtgtcagtaaatgtataggaggaagtgcaagagaggtgacatgatttctattgtctctgaaagtcagtgacaaatccttgctggaaagcctggtgggccaatgtgaaaacagtaaccactccaggcacggtgtctcatgcctgtagtcccagcactttgggatccaaggcaggcggatcacttgaggtcaggagttcaagaccggtctggccaacatagtgaaaccctgtctctattaaaaatacaaaaattagctgggtgtggtaatgcacacctgtaatcccagctacttgggaggctgaggcacaagaatcccttraacccaggaagcgaagattgcagtgagccaagatcgcaccactgcactccagcctgggtgacaragcaagattctgtcaaaaagaaaagaaaaagaaagagaactaagaggaagcaaaggaaccatggcatagtgaggtgagacgtttctggagtaaccttggccctatggacttttatagctaacyatgtaaaactcccttacaggtcaaagtcctcctctgaggagaaattgcaggggcgatagaggcaaaggatagagaaggatcgaaccaaaaaaaaaatagaggggggaagcagaacccatagatttcataagaggccatgtttcaagtagtggggagaaccacagaacaaggagctctagagctgtaaagctgaaaaaaaggctacactctctcttctccctaagagtataagaaaaagcatttcaatttttgtctggacatttgatgtgcttgtgttgcctgtagacattataattttataatatatataattatgtataatttatatatattagtggagtaatctaatttatataattataattatgcttaatatataatttatatgtgtatatattgttttatatataaaaagagaataagaagcagaataatatctaaaggtaataaaggtcaactagttaaataaacataactatttaaaaatgaactaaaagaaattwaaaaaataagagacactatgaaagagcaacatacattcttaactcagaaacaagatgagtagagaacagagatttggaaaagggagctgaataacaggccagaattccaaattaaagaaaaactaattttagacctggagactgcatgagaagggacaccagagcacgtaaacccacagcttaacatctgtagagatatagaagatggaaaagtgaaaacctttgaaaatccaaaggaaatgattttatggaagacgattttcccatgaaccggggctggagggtgttttggggatgattcaagcacattacatttattgtgcactttatttctattattattacattgtaatatataataaattctagaactcaccataatgtacaatcagtgggagccctgagcttgttttcctgctactagatggctatatctgggggtgacagtgacagatcgtcaggcattagattctcataagagggtgtgcaacctagatcccttgcatgtgcagttcacaatagggtttgcactcctgtgagaatctaatgctgctgatgatctcacaggacgcagagctcaggtggccagtgagggggagcagctgtacatacagatgaagcttgcctgctgctcacttccggctctgtggcctggttcctaaggggccactgactggcactgatccatggcccaggggttggggacccctgccccaagaaaaccaaattgcagtacagactgtggcacgaggaatggtggtgagcattcaagacacatttccccaaggaactgagatggaatgatggttttaggggagagtgtcttatggaatggctctgtcctctgacaaggttaagtaagtatgactaccaaaaatgggagagtgggtatagtttataaaaattcaacttcctgattgctttatagatgtagtctaaaagtaaatataactttcaccagagataaataatatattagctatttgcaatattggtcatagaactaagaaatagtaatcaaaaagagaaggtcttaagaatattatttaaaaatatgagtgttagggaagcccaaacttcctaaacaaaagagatatataaaaatatatttatatattgtatattttatgaacatatgtatattataaatgatataataaacataacaaaacatacaagtattataaaatatatattatatatttatattatataacgcatatattaaatatatttatattataaattaatgtacattcatgtttattaagaaatacatatatattttatattatatataatatttataatatattataaatatacctttatattatatatatttaatgtagatatatgataatgtagatatatatgatatgtaggtattacatatgataactatatatttctatttaaatataaaaatgcatatttaatgtamatattatatatgatatgtatatcctatgtatatgtgtatatatgtatcacgtatatacatatgacacagctgtatgccacataccacatatatgacagtggtcccataagatcataatggagctgaaaaattcctattgcctagtgatgtctggatgatttcaatcttgtgtaggcctacaatgatgtgaatttgagtcttagtttttaacaaaaaagtttaaaaagtaaaaaaaaattaaaaaataggaaagaggtgtctagaacaaagatataaagaaaatattttcatacagctgtgtttgtattttaagctaagtgttattacaaaaataaaaaagctaacaaaattaaagtttataaagtaaaaagttacaataagctaaggttaatttatcattgaacaaagaaaattttaaaaataaatttagtgcagcctaagtgtacagcgtttataaagtttgcagtagggtagtgtcctaggccttcacattcacccaccactcactcactgactcaccagagtaacttccggtcgtgcaagctccatttattgtaaggtgtcctatataggtgtaccgttttttaccttttatatcacatttttactgtactttttctattttgagatatgtttatataaacagataccactgtgttacagttgcctccagtattcagtatagtcatgtgttgtacaggtttgtagcctaggagtaataggctataccgtacatacctaggtgtataggaggctgtaccatttaggtttgtattacatacactccatgatgtacacataatgataagatcacctgatgacacatttctagcatgtgtccccatcattaagtgatgcatgtctgtatatatatatcatccatgggtgatgcacacacacacatacacgcacacacacacacacacacatacacaccgcacacataaaatgttttaaataaaaggaaaattttcattttaaataaaaatgaaattatatatttatagtattttttaattaaaatatgcattttaacaatctaggagaattgaggccaaagtgtattgattatataaacaattataagtgagtttgacttacctattaaaataagaacttaaaattataagcatgactacaaagccaaatctaacactatgtatacaaaaacaaaggcattcagaaagggaaaaataaaaggatagacaaggatataccaagaaatgcaaacaaaaagaaagcagatgtctttatctcattatttgacaaggcataatttagactaaaaaactttgagacaaagaaggattttttttttatcatgccaaagggtacatttctcaatgaagacaaagtagtttcatggccccaataacagatacaacttttacaaagtagaaacctcagaagttgcaaagagaaacgtagaaacataccaataataagagacgtaacacacttcaacttgaaaaaaataagtacaatgcttagcataatcaataaggttgaccttatagagatatgtcaaaatctgaacctcaaaaatagaatatacctttctttaaagttcacataccatattaaagaatattgacaatattttaggccacaaagaaaacttcagtaagttccaaagaataggaataatacaaatataactataaagaaactagaagttaattttttaaaaagcaaaaacaaaatcagccccctaaaaaataaaaaccacacaaaagacttttctatctgaaaattaaaatgtacactattaattaaatcttgggtcaaaggcaaaataaaattgaagagtttcttgaacatcatgataatgaacatgtgatgttttagaatgcatgggatatagctaaagaagttatcagaataaaatctatagcattaaatgcatatattcgtattttattttatttttttttgagatggagtctcgctctgttgcccaggttggagcgtggtagcacgaactcggctaactgaaacgtccacctcctgcattcaagcaattctcctttctcagcctcccgagttgctgagattacaggcacccaccaccatgcctggctaatttttgtatttttagtagagacggggttttgccatgttggccaggctggtctagaacgcctgacctcaggtggtctgcctgctttggcctcccaaagtgctgagattacaagcgtgagccaccacgcctggcctcagtgcatatattattaaaaatgaaaatttaaatcaatgaattaaacaaccagatgaaaactgggagaagaacaacaaagcaaaataaagcaacaaaatggtattaataaagataagaaagaaattgctgagttaattctgaaaattggtcctttgaaaaaaatcatcaacatagacaaaccatgaattagcctaatcaaggataaagggagtacaaatatttgattattagaagttacatatgagttggaaggggataatgatcacaaaaggaaattaagtcataagggaccatttgtctaactacatacaagtgaactttaaaatcttcatgaaatgaataatttcaagaaaataaaaatttaccacattaagttcaaacagaccaattatcataaaataaatagtgtggtagaagtattccctgacaagacacgcgccaaggtcggatactccctacttaactatgttccttaaattattccaaagcataataaaagaaggaaaagtttcaaatttattttgtcaagtaaatgtaatttaaatttcaaaattaagaaaaaattttttgcaaaggtaatttatagatcgatttcagttttattgatacagaaattttctgagataaaatattttaaataaaccaatgttgcattaaaatctttatcatgaccagtgaaggttattccaggaatccaagaatagctcaatacgataaatcaattaatataattcttcatattaggaaagataaggagaaaaatcctttgaacttactcatagggaaaaggcactgaacaaaatttaaattctatttatgtttaaaaaataataaaatacctccttaacattattttataagcgcatgtgcacacacaygcttcagttcaaaatcagcactttctttaaggtagtacactagcagttaaagtcaggtgtaagttaaggatgtccagcatgccctctgcaatacatgcctgtgttggaggtatgagccaatgtgattagacactgaagatcagacatggagaggtaaaactatttctagatgtagatgatttgattatatacctaaaattcccaaaaattaatcagtggaaaagctgctataggagtggattgatgagagaaatccataatgtagcaggttataaaatcaatggccacataacctggcaacatagcgagaccctgtgtctctacaaaactaaaaaattaggcgaggtttggtctctaaagaccagaccctgtctctacaaaaatttaaaaattagctgggtctggtggcatgtgcctgtggtcccagctactcaggaggctgaggcaggaggattgcttgagcctaacagtttgaggctgcagtgagccgagatcgtaccactgcattgcagcctaggtgacagagtgagaccctgtctcaaaataagtaactaaataaacaaacaaaaaataatagccttaggccaactgttcacaaatataaagtcattaagccttaacactatgtttatttgctatttttgataatattactaatgtatttattatgtttttatcatgtatacatgtgctaataaattaatttcctatatgtgtgttacatcagtaaatttttgaggatcatagatttgaagtgctgtttctgtttttctttgtggatttttttgttattgttgttttgtttttttgagtcaggatctggctgttttgcccaggctagagtgaagttgcatgatcttggctcactgtagtatctgcctcctgggctcaagcagtcttcccacctcagccttccaggtatctacgactacaggcacacactactatgcccagctaatttttgtattttttttttttttttttttttttttgtagagatagggtttcactgtgttgcccaggctggtctcaaagtcctgggctcaagcgatcttccttcctcagcctcccaaagtgctgagattacagctgtcagccaccgtacctgcctgggaatttttttaaagctcaaattggataagagggttataggaatatattcatctatcatatagaaaagaatatgtgctcagtcccaggaaatagaaaatatattaccttatttatactgttttaattaatgctttttaaaatctgattaactctgggagatagtaggatagaataaaatgatttctgagtaggagataagtgaatataatttgtaytcctgagagctggtgttaaatttttgcaacccagttttactcatgggcagacctttttaaaaggaaacacccacagtctgtatgaatttgattctcgtgtggatagtatagacttaagcactgaacatggtctgagcaggtttgctttgctgcttaccagcgattatagtggaaaatcctactcctggatatagcagctctgtaataatagccactgtcaggacttattagggaattgctcttcgtttctccttttcatttataatcactttataatcagtaaaatatttgattaagtggaataactgccagttaaactaatgttcctttgataatatttgggttattctagggttttaagttgaattagatcaagaaacaattcataattggtgttcagtggttacagtcagtatatttaatatacgagcagattttaaataaatgctatatgtttttttcatagagcagaataactttaatccactgaaatggatcagactagtttgagtttcctcttcaaggactgaggatgtttaaacaatgatcataagaaaagcgggctaaataaaactgcctttacacttttctgaaggattgctatagtatttggcttgacagtttcactggggactaatttatttggcttttcatgttcatgacagggtgcagtttataataataagcaatggttaacacaaatcattttataagactctctatactgctgagtctcaccttgttcagatgatctaaaactcatgacaataagtacttaaaaaataattaatatctaattttatactaaattaaattctgatgattgcaccactgtactccagcctaggcaacagagtgagactctgtctcaatcaataaatcattaaatcaattaattaaatctcaaattctactggattattaagcagtgatagtttttaagtgtttgagaatgattattatagaaatttttaattgagcaaaaagttttgcaaaactgggaaagattttagcatcgttacacaaggttgaacctcatgcaacaccaggatttcataggagcacagttttatacagatgaggaccattgttttatgcagatgtgacaattgaatcaatagtcatgcagtgctgcccctacaaaagggacattcattaaaaaacagtaaaagccattcttatttaattatctcactgcttcaagcatagttttctggtattcatcatcgtggactctggatagaggcagtaagaggatctttgagatctgttgcatccaatatttcaattattctgtatttctgagactgatacacattcacagtatgtatgaaacagtattgttgatttttatcaggtttccaaaaaggaagctgggccttgtagatgtaacaatatcaagagctctttctgtttcttccaatttctatggcgtcactttaattaaaagtatttcttctcataatggaacatgatagagcaatactttatattcggtgacttctcattattcaccagcataaataatgcattaagatattaatgatgcataatagttgtgatattccagatgaactgatcttcttattcaagtgagaatttttgaataataaaaatgtcggtataagataaatgctagatgatgtaagaaagattcacttcatatatagtttatgaaccatcttaaacagcagatacttgtttcttgacgatttctctaaaaattaattgaaataataaaacaattataaggaaataaatattaacattattgctgtttcttctctctactttattcattttgactttcacagaattttgtttgtgcaaatgagaggcaaaagaaagaccactgttttgtaaagaatataaattatcaataactatatttttcaatattcttatgtttcagttatataatatttatttcccaatatttttagagaaaaataaagtagatggtaagtgtggcagaaaggaaatatcctaatattttgtgactatcttgtcaatgtagaataagtgattagatacttgaacagagttccgatagaacagaagagttgaaagaaaatatttaacagttttcttggcagattgttgaattggacctgaatggaactgcttgttaaattgtgattcataagttatgtggaaataattcttcttactggttttttttttttttgttttctgagatggagtctcactctgtctcccgggctggagtgcagtggtgcaatctcggctcactgcaacctccaccttctaggttcaagtgattctcctgcctcagcctcctgagtagctgggattacaggcacgcaccaccacacctggctaatttttgtatttttagtagaaatggggtttcaccatgttggccaagctggtctcgaactcctgaccttaggtgatccgcctgcctcagcctcccaaagtgctgggatttcaggcatgagccaccacgcctggcctctttttagtatttttaacatgcatttatgctggtatccagttaaggtagagtggtgacacaaagggcaaagatgacataattgaaattcccaaaatagaaggcattttatggaatacttgaattacatacctaattttatactaaattaaactccagtgaggaatacaacatcagtgtcttgccttatgatgccttacgccttatgatgtgaactaaagactcattctggaaatttttaaaagattttaaagaattctcattgtagtcataggtgagctcctaatttcccattatgtttctcataagatgtagaaaatgaagcaacatgaaaacttaggaaaacactgatgtctaagagatctccattaattataaggcagatgaaacttgttggaaaaaacctacctggagttcacctcttgcacacagtttcatctcaaacactgcaaaaagattggcagatattttaatccacctaacctgtcagcttcagccaaagggggctgtgcttacaaagtgcgtagccagtttttgttccttccttctgctctgctgcatcccgtcagtgcagactccccccagatggtgcaggcattggtaggcagtaagctggtgatgacccattctgttctggaagccttagttctcacaaatacaatgctgagggcttattgcaaacaggaacagcactggtggaagtacagaatagggattgtggttttgatgatggtgtatccattgtaataacagagaacagaactaagggtaggggaaggagaagctgttaattcagatggtcagagctgaattaagtgaatgtttgtgaaaaactgaaaactacacttggagtatatactgcagagggcccgctgccaccgttagaaccctggtaacagagtatatactacagagtgcctgctgccactgttagaaccctggttatagagtatatactgcagagtgcccgctgccactgttagaagcctggctataaagtatatactgcagaaagtatatactttctgaatctaagagtatgatttagccatcactggagtgaacacactgcagcaaatgaagctctaacacagaagttggcgcatttttttttttttctgtatagagccagatgggaaatattttagttttgtgggtcagatgttttctattcagcttggacattgcagtgtgaaagtggccgtggaccatatgtaaacagatgaacatggctgtgttccaaaaaacctgtacttacgggcactgaaaattcaatttcatattttcatgtgccataaaatatttttttctttttcttgcaattttttttcaactgttgaaaaatgtgcaagccattcttaactcttgggctgtgatttggtccatggccatgatgtgcttagcccagctctaacatatggaaagtattatattgctaaagggaaagctagacaaataaaatgggagcaactgtcagagatatgatagaggcaaagtttgctgccaataggttagatgcacttgccctcctaaagctgggaaggagaatacttatgtcaggagctactggtgaagttttatgaaagtatagggatggcatttgagtgggactccttgacagatggtacttaagttaatgaatgtttttgatgtttgaaaggatgagagaataaatgggtaaaatacgaatatagctcaatagagtgtgatatagaaggaagcatttcataaggagaatgagaacaaaggcatagagaagaagcatttgttggtggctgggaactcccaagtgttctgctgaggggtaaagtcaggtttcaaatgccatgtaaccagcacaactttatttgaaagatgaagggagcttctgaaagctttctaacagtggattgcattatttcacctgttgccacttgccaatttgcacacttagacatgcataaacaaccctggaggtataaacctccagttgggttttaataaaagatgacatgcctttggatatactctgttctcgctcttcctggaagacccttgcgcgttcttcacctgaaggaagtctyttcattgtttaggtatctgtcaaatgttttttcctttgtaaagtcttcctgtgtttacaatgcatctccctcctttatgacaaataattctgttttctttcttgcttgcytgtctacctggttgctttctatttccttctcttcctctctttctcattcacttgatcgctttttctctttttcttcctccctcccacgctcctctctttcaagcaaaattaattcctcctttgactgcgtaacttgctgctaactcatgtgtccctttacatktactttggcgtttctcaaattatgaaagcacctgcaggcagagacagcctctcagtcatcttgtatctcaggtacataatacagttttgaaggaagtagagcctcaataaatgtgcattgatttttgactggatttccttatttaggctaataatattgatgtatccattttggcagtttatcagttcatttgactttttatatcctactgtactctccaaagaatacacagccactgtcttcctgtttcaaggaatttaatgttttcaaggttgctggagtaaatattcatatttgttactataataatgcttaatcctatatagattgataatggtcttggtatagtacatttgtagtaatatttaatttactacttggtatcaatttctttttttccgtaagttactggagtacaggtggtatttggttacatgagtaagttctttagtggtgatttgtgagattttggggcacccatcacctgagcagtatacactgcaccatatttgttgtcttttatccctcatcctccttccactcttcccctgaagttcccaaagtcatatcattcttatgcctttgcatcctcatagcttagctcccacatatcagtgaggacatacgatgtttggttttccataactaagttacttcacttagaataatagtctccaatctggccaggcgtggtggctcacgcctgtaatcccagcactttgggaggccgaggcgggtggatcacctaaggtagggagttcgagaccagcctggccaacatggagaaaccccatctctactaaaaatacaaatcagccgggcgtggtcgcgggcrcctgtaatcccagctacttgggaggctgagtaatgagaattgcttgaactgggaggcggacgttgcagtgagtcgagattgcgccactgcactcctgcctgggcgacaacagtgagactccatctcaaaaaaaaaaaaaaatagtgtccagtctcatccaggtcactgcaaatgctgttaattcattcctttttatggctgcatagtaatccactatatatacatatatataatatataaaatatatataaaatatatataatatatgtattgtgtgtatatatatagtgtgtgtatatatatattccaccatatatatacacacacacccacacacagacccacacacacatacacaccacagtatgtagtatatatgtatagtgtgtgtatatatatatatattccaccatatatatatatatatgtacacacacacacacacacacacacccataaacacccccccacacacacagcacagtttctttatccacttgttgaagatgggcatttttttattattattattattttctgcagctattgtaaaaggggtcgagttcttgatttgattctctgcttggttgctgttggtgtatagaagagctactgatttgtgtacattgatcttgtatccagaaactttgcttaattctttttatcagttctaggagttttctggaggagtccttagggttttcaaggtaaacgatcatgtcatccgcaaacagtgaaagtctgacttcctctttactgatttggatgccctttatttcttcctcttgtctgattggtctggctaggacttccagtactatgttgaagaggagtggtgcaggtgggcatccctgtcttgttccagttctcagatggaatgctttcaacttttccccattcagtattatgttggctgagggtttgtcttagatggcttttattacattaaggtatgtcccttgtatgctgattttgctgagttttaatcataaagtgatgctagattttgtcgaatgctttttctgcatctattgagatgatcatgtgatttttgtttttaattctgtttatatggtatatcacatttattgacttgcatatattaaaccatccctgcatccctggtatgaaacccactttatcatggtagattatctttttgatatgttgttggattcagttagtattttgttgaggattttagcatctatgttcatcaaggatatcagtctgtagttttcttttttgggtatgtcctttcctggttttggtattagggtgatactggcttcatagaatgaattagggagggttccttctttctctatcttgtagaatagtatcaaaaatatgggtaccaattcttctttgaatgtctggtagaattcggcagtgaatctgtctggtcctggacatttttgttgttggtaatttttaaattaccatttcawtctcactgcttgttattggtctgttcagggtatctaactcctcctgakttaagctaggagggttgtatttttccaggaattcatctgtctcttctaggttttctagtttatgtgtgtaaagatgttcatagcagccttgaatgatcttttgtatttcagtggtgtcagttgtaatatttcccgttttgtttcttaatgaggttatttggagtttctctcttcttttcttcattgatcttgccaatggtctatcaattttagttatcttttcaaagaaccagctttttgttttatcttttgtatttcttttctttcaatttcatttagttctgctctgatcttkgttatttctttcttctgctgggtttgggtttggtttgtttttgtttctctagttccttgaggtgtgtccttagagtgtcagtttgtactctttcaatatttttgatrtagacatttagggctatgaacttccctcttagcaccacctttgcagtatttcagaggttttgatagcttgtgtcattattgttgtctggttcaaataattttttgattttcatcttggtttcgtttttgacccaatgctcattcaggagcaggttatttaatttccatgtatttgcatggttttgaaggttccttttggagttgatttccagttttatgccactgtggtctgagggattgcttgatataatttcagttttcttaaatttattgagccttgttttatgccctatcatatggtctatcttkgagaaagttccatgcgcttttaatagaatgcagttgttggatgaaatgctccgtatatatctgttaagtccatttcttccaatgtgtagtttaaatccattctttactttttgtctcctttaactgttgttgctttaaaatttgttttgtctgatataagaatagctacccgtacttgtttttggtgtacatttgcatgaaatgcctttttccacccctttactttaagtttatgtgagtccttatgtattgggtgagtttcctgaaggcagcagatggctggtgagttcttatccattctgtggttctatatcttttgagtggagcatttaggccatttacattcaatgttagtattgaaatgtgaggtacccttgcattcatccagccctttgttgcctgtgtacttcattttttaaatatgtttttgctttttaacttgtatttttgttttataggtcctgtgtgatttatgctttaaagaggttctgttttgatgtgtttccaggatttgtttcaagattctgagctccttttagcagttcttgtagtggtggcttggtgatggtgaattctctcagcatttgtttgtctgaaaaagactgtatctttccttcatatatgatgcttagttttgctggatacaaaattctaggctgtttgaggaggctgaagatayggccccagtcgcttctggcttgtagggtttcttctgagaaatctgcygttaatctgataggttttcctttataggctacctggtgcttctgtctcacagctcttaagattatttccttcatcttaactttggataacctgaggacaatgtgcttaggtgaagatctttttgagatgaatttcccaggtgatctttatgcttctgtatttggatgtctacgtctctagcaaggccagggaagttttcctcaattattccccaaatatgttttccaaggttttagatttctcctcttcctcaggaacactgattattcttaggtttggttgtttaacataatcccagacttcttggaggctttgttcatattttcttactcttttttctttgtctttgttggactggcttaattcgaagaccttgtcttcaaggtctgaatttctttcttctacttgttcaattctattgctgagactttccagagcatttcacatttctaaaagtgcatccaaggttttctgaatttttgattgttttttctttaagctatctaattccttgaatatttctcccttcacttcttgtatcattttttgtatttccttgcacggggctttgcctttctctggtccctccttgattagcttaataactaacctcctgaattcgttgtcaggtaaatcagggatttcttcttggtttggagccattggtggtgaactaatgtgatttttgtggagtggtgaagagccttgttttgtcatattaccaggtttggttttctggttccgtctcatttgggtaggctctgtcagagggagggtctagggctgaaggctgttgttcagattcttttgtcccacgaggtgttcccttgatgtagtactttcccccttttcttatggatgtggcttcctgtcagctgaatcacagtgattgttgtctgtctgctggatctagccacctggtgagtctacccagatccaggctggtactgggggttgtctgcacagagtccyatgatgtgaaccttctatgagtctctcagctgtggatacaagtgtctgtcctggtgcaggtggtgcgagtgtgcaatggactccataagggttctttgctttggtggctgaatgctctacttttgtgctagttggctgcctgccaggaaatggcactttccagagagcatcagctctggtagtattgggaggaactggcggtgggcagggccctagagctcccaagattatatgtcctttgtcttctgctaccagggtggataggggaggaccatcaggtaggggagggctaggcacgtttgagctcagactgtccttgggtgggtcctgctgcagctgctctcgggggtgggggtgagatacctaggttactggagttgtgtacctaggaggattatggctgcctctgctgagtcatgcaggttgtcagggaagtgggggaaagccagtagtcacaggcctcacccagctcccatgcaaacagaagggccagtcgtactcccmctgtgccccccaacaacagccctgagtctgtttccaggcggagggtgtgatgggtttgaacacttaccccagggtacctgccttccagctgcaaaataaaagggcttggttcctcccctgcctatggagtctggacactagatttgcaccctcccctgagttctggccaggaggcctctcaccccattcaaattgttrcaaaggccagctagagatttccttctgcctgtggagttttaccccgtgctcctctcccattggatccctgtggtgccaggcaggtatggggtgcttggggacccagcgagctcccagggcctttctgctgcttcctttaccccctgtatgttgctcagctctccaaattgactcagctccaggtaaagttgtaaacttttcacgcaaacagaccttcggcttctccagtgggggtgtatatttgggagaggagggccgccctttcctacttccatggttggggcactcacagttttaggggggtctcccgggtcctgcaggagcagtccgcttccttcagaggctctgtggatcctctcgggattgctggtttgttcttgcagctgatctgggtctaaaattaacaatgygagcccccacatactgctctgtctagagctgcaatctagtcctgcctcccatccaccatgatgatcctctactagtttgtattagtcctttctyatgctgctaayaaagacctgagactggataatttataaaggaaagatgtttaattgactcacagttccacagggctggggaggcctcaggaaacttagaatcatagcagaaggggacgcaaacacgtccttcttcacatgatggcwgcaaggagaagtgctgtgcaaagagggaaaaggaccttaacaaatcatcagatctcatgagaactcactcagtatcacaagaacagcagcatgggggtaaccatcaccatgattcaattacctcccactgggtccctcccatgacatgtgggaattatgggaactacaatttaagatgagatttgggtggggacacagccaaaccatatcatactttatataaaggatacatttttgtaagcatgcttatacataattaaaaaattcagatactttacagaaaaatcattaaaatcgataaataattattgataaatttggtacagaaggaaatgctaagattttttgtcagcataactttctgatactttggcataaaactattttagttgcacatgttttttccagtaggtaatacagaacttaaaattatatttcaatgcaaatggtggtcactttggaaaacagtttgtcagttccttataaaattcagcatgagtttacaatacaacatagtggcctactcrtggttatttacccaagagttatttgtccctgtttctacccagagtcttgtactcgtatgtttggggcagttttactcacaatagcctaaaactggaaatgaaatgaccaaaagtgtcatcaactgataaagggatactatgtggtaacaaaaagaatgaactattaatctgtgcaacaacatggatgcaacgcaaaatctttaaggaaagtgacagatgcagggcactaaagactgtataccaaatgattccatgtatatgaaatgatagaaagggaaagctagagtgactaaaagcagatgagtggttggcaagggctggaggaagtaggtgggaatttactgcagagacttgcaaatgtttttattccataaaatagatggaagtgtcctattttgtgattgtggtgatgattagatgattgtagaaaagtgttaaaactcatcaagttgtatacttataagtggtaaatttcattgcatgtaaattatgcctcaataaagctgattttaaagtccccaaaagcacaaactacaaagcaaaataaagatgtatttggctaaattaaaattaaagacttctgaatatcagcaaataccatagtatgtaaagcaaacaaataaaacagagcaacataaaaacagcactaccaccaacaacraaaatacaaacctcagattgggagaagatattttcaacatgtaaatataagtggataaaattttactatcaaaaattataaagatttcctagcaatcaataagaaagaaagaatatccaagtaggaaaatgttcaatatgtttgaagaaatatttcacggaaaagagaactcagatggcttccaaatattttaaaagatgttgaagattattagttataaggaatgcacaaattaaagctgcattcaaattcttgtgcatgaaattggcaaaagcttttgagtttgacaatggaaaatggtgacaaagatatgaaccaataaaaattctcatgcatttctgttagaagcgtaaattgatactgcctctttaaaaagcaaggtgattatacctactaatgtttaagaaggtcataattgggacccagcaaattcaatccaagaaatatacctggcctaggccaactcttgcacttgggctcatgaaaacatgcacatacgtattcatgtcaatgttattttttgtaatggcaaaaacaagcagaagatcactatacatctatcagaagagtgaaaatccaaaactcagacaacamccaatgctggtggggatgtggagcaacaggaactctcattcattcttgatgggaatgcaaatggaacagccactttggagaacagtttggcagttattttcatagctaaacrtacttttactgtacaatccagcaatcacagtccttggtatttacccaaatgagtaaaagcttatgtccccacaaacacctgcacatagatgtttatagaaccttgtttataaaaattgccaaaatgtgaaagcaaccaagatgtccatcagtaggtgaacaaataaactggtgcatccagacaatgggatattattcagtgataaaaagaaatgagctatcaatccgtgaaaagacatggaggaaccttaaatgcatgtcactaagtgaaagaagccaatctgaaaaaggctacataatacgacattctggaacagtcaaatctmtggagacagtaaagagatcagaggttgccagggataaggggcagggagggatgaataggtgagcacagggtatatttagtacagtgaaactattttgtaagatactgcagtggtggttatgtcattataaatttctcaaaacccatcaaatatccaacacaaagggttaaccccagtgtaaactatagtctttgggggatagtgatacctgaatgtaggtttgacatcaattgtaacagcggtgtcactttgatgaaagatactgatagtgggggaagccgtgcatgtgtagggggcagaggtatatgggaactctctgtgccttcctacttttgctgtgaacataaaattgctgtaaaaaaataaattctatttgaagcacaaaacagcctaccaaccaacaagagwtccctaaatgttcggcagtagagaaattgataaagtatagtggattcaagcaatgttatactgtatatacagtgaaactgtaaacacacatatcaacaagaatcaattacaggaatgtaaaattgtgcaaaaatgaaattgcaattggatataggcaaattggagatgaacagtataataccatttatatcatgttacaaattaaaatttgcaaaataggtacaaaatattagaatatataaatgtgtgtacaggaaaatcctaagaaagtacacattaatgataaacattaaattcattagtggctcctacttcagaacaggcagaatgaaatcaggcctgggtacctacttagctttgactgtgtgtgtgttagaatatcggtatttattttagaatgtttatatattttgtattgatgaagtactctgtcagaaaatagccatggaaaattatgctggatttgcagccagaaaattttaaacataagcagcaaacactcaagaagttaatctgggaagtttttgatgctgtgaataataattttttgtcttgtgtgatttacattttcaaggttacacgttaaaattctgcagaagaaattgctttcctagatgttgttgtaacccaaagtttgtgttgggggaaggtagttaagctggtgaataggaatgttggagaagagaagagctgagaatgtttgcacgagataactgtactgcaactgtggatatgaccgggctgcactttgcatttattgtctggccagtacttactaaagtctcttagttataagcctccatttgcataaaacttatgctcaaagtcagggttccagagttctgatgaaaaaaaaaaagtcttttttttctcttctcctctcagacaccactcaacacaataattctgataccagatatgtgggggcttatctccacacaccaagcaattctccagcaatactaagtgttctgtaatttaactcaattttgacatcatcatctacctggagatagcatcagattcttcaagttgatgccttggctgcataagactgccctctacttcaatttaatttttcttttttggttgagggatggagtctcactctgttgcccatgatggagtgcagtgacacagactcagctcacttcaacctctgcctcccaagttcaagcgattctcatgtctcagcctctcaagtagctgggactacaggcgcgtgccaccacacccggctaatttttgtatttttagtagagatagggttttgccatgttggccaggctrgtctcgaactcctggcctcaagtgatccgcccaccttggccttccaaagttctgagattacaggtgtgagccaccgcacccggcctgcccctacttcagattccagctgcaagtagtagattgtcatctttacttctgtctgactgatttaaatcaggggttcccatgatccccctcctcatgatagagcagctcacataactcaggaaaacagtttactaatgtttacctatttattataaaggatagtacaaagcatacagatgaacactcagatggaagagatgcctagggcaggaaatgtgggaagaggcacagagctcccatgtcctgtccagcgcattaccctccagatacctagttttagttcagcaacctagttttaattctgactcttatctttttgggtttttaaggaggctccattttgtaggcatggttgattccatcattggccaytggtaatcaagtcaaccttcagcccctctatcctccatggaggtcaagggtggaatgtgttgggggaaggcttaaagttctgaccccccagttgcattgttgcttcccctggcaaccagccaacatcctgaggctatccaagagcctaccaagagtcacctctttcgaacaaaaaaggatatttttacctaggaaattttaagggattttaggagctctgtgtcaggaactagggtcaaagaccaaatatcagaacagatattttccatattctccttgaacttctgtcgagaaggatattaggagctctctcaggaactggggaagtgagcaagtgtacatttcttattatatcacagtatcacaagagttaattcagtctcccatrttcatggagagaytgactgtgcttggcattccttttctaattttcctagacacagccactcagtattttaaaaatgcatttttccaggtagctactaccaatcagtrgtacctgaaataaaattgatttgctatcctgatctattcaggataggctaagttatgctttgataagaaaaaaaaaaacccaaatctcaatggctttcaatacagtggctttaattcatgtacatcattgtagttgtttatttggtgtctattgagaaaatggaaaatgactaaaaatgctagtatgaattcagaaacactattacatatttaagtaaaatattttatttgattaatcagatacattttaaaattatacttgcaattgcaaatatgtgtgtgtgtatgcacacaygcatatacattttcaaaatatataaattattcagtatatagataatgcttctggagtgtatggtggtttcattgattgtttcttataacccccaaccccctggcccacaggtattggggattgcaggaagggttgcttaactagatcacaaagtctttgtaaggggagttattgaaataatattaatgggtacagtttttttaggggaggggaataagggagtgatataaataaaatgrtgtttgagaaattgtacttataggccaggcatggtggcttacgcctataatcccagcagtttgggagactgagatggaaggattgcttgaggctaggagttcaataccagcctgggtaacatggcaaaaccccgtctctccaaaacgtagagaaaaattagccgggcgtggcagtgtgtgcctgtagtcctagtgattcaggaggcttatatgagaggatcacttaagcctaggaatttgagaatttgaacctgtaatgagttatgatggctccactgcacttcagcctgggtgaaagagaaagaccctgtctccaaaaaaagtaaaataaaaataacaaaagaagaaaccgtacttcagtgtttggaaaaaaaaaaatgagtcaggaaagtcagaaggaggaaggattactttttgcagtaattttgatcataatgcagtgaaaaatctgatctagattggtacaaaagggaaggggcccagaaaatttggagacaaagctgtggtagtcattgatgatatattgcacattgctggtaaaatacagattaaattccttaaatctggagtaacataaaatatgttactcaagacaacttaaaaagacattgaaatgttggctatctgcatttctcttaatcaccgaaaatacaacaattcagaatgtataattaactctatgtaggatttataggtaatatraagttctggagtattttaaacgttgtaataagatcttttaatatttttacsgctagaatctctatgaacattgtctaaaatgaatagatgtaattgggatcttttaatatatgtgatagctttctataaaaaggaaaaaatattgccataaaattcatacaggtttagtgtatatttaaaatatatttgttatattcacacagtaaacacgctatttagagtgttgatgacgtgctaagcaatgtccaaagtcatggggacagagcagagatcragacagagtgcaccatctcatggatatttcattctagtagataaagacaggaaataaaccatttagctaataattagtgatgcatgtcatggagataattaaaataagtaaggtgatgggtctgttggattggattggtttattgtagaaggcctctttgctggatagccagaaggamccagtcattggatgcttagagagagaagcattgaatctatgtagaagagatagtgcaaagaccctaaggtgagaatgagtgtggactgttcaaagacagaaagaggccagtgtgattgaagtccagcaggtgaagggggtaagtggtatgagatatgatgtggaagagatagttgggggctgattttcagggactttgaaagctagaacaagaagtttggattttattttaaattcaatggaaagctgttggatgtggtgtattataggaattgaatgatgtttctaaataattttactccatgaagaggggattggagaagacaagagaatgaagtaactcaatagggatggtagtaaagaaatactttgattcagaagtttcgtcagattggatttragaggtaagagagaaagaggaattaaagagttttggatttgaggacattgttgagatgaggaaggcagaagtcatagagaaaggcagacttattaagagtcctgttttgattgtgtttgttaggttggtggtatctgagtgaagatgtcaagtaagcagcttgatgttagcttggagtctaaggagacgtcagggctggtgacatagatgtgagagtcattgggttatattatggtatttaaaaccacaggttggtgtgagaatcacctgcaggaatatgtagtcacagaagacaaaggggctcaggtcaagcacttctggcatttagaggcagatcagaggagaatgacctgcaaagcagacacttttttgagtcttctaaaaagataaaaatctttcttggaatccttattgtctaaataaactgaaacaatgggctattcatttaatagtgcattagtacatattcgtttaatatgggcactaaagtgtaagttctatatacagttgtattttagtggtaactctattttgttgctgcaaaaattgaaatgcagatgatgaacacaaaaaataaaatcacaattttggaaatgacgtaacaaatgaatgtatctggaaaaaatcagggatgtaaaaggaacaaaacagttgccaaaaaagcaaacgataaaagtacatatataattattgtcatatttcttatggggaagcagaaggaaaaaataaaactaatagaaaactccatcacagaatgcgagggcaaagattgatttatgaagaaaaggagggaaagaacaagaccaagccttgagctgatccatgaatttatatatttataaggaaaggtgatctttatgctccactataacaaactgcaggaacagataagctgtccactcttcagtgtgtttaacacgagtaataacttctatgaaagttaaaatcatcgtctgccatttttgtaataccctacccacaggaaagaaaagtaaaggtgggtattagacttaaagacttcagtacacctttagaactcaggaacaatagctatttcaaacagtttaaaaacattttttgtgaatccacatcaattgggagtataatgtgatggtttgatgcagaataagcttgaacaatatttaggcactgaagtcttctcagtttctaaaaagtactctgcaactcacaytgagagtttcactgtaaaagagtattcctaatatattgggagcgttcacatataagttcagtgattgacttctttgaaaaggccatggtttgtgttgacataatttttttttgagacatggggtcttgctcttttccccaggcaagaatgcagtagtgcaattatagctcactgcagcctcaacttcccaagcacaggtgattctcccacctgagcctcccaagtagctgggactacaagcacgtgctaccatatctggctaattttttgtattttttttttttttgtagaggtgtggttttgccatgttgcctaggctggtcctgaacacctgagctcaagcaatcaggccacctcccctcccaaagtgctgggattacaggtgtgagctacagtgcccagccataatgtttaaaaatattacaatgatgctactgaggaatgggaatcatttgttccttcagaaacaagttacatcattctcttaaccaaccacgttattctttgtcatcgtcactcattcatcactcaaccatgggtgcacattctcattcatcagctctcccatcacctggatgcaggcattgtgcttggtgctggcataggaagattaagatgcagttcctgaactcaggagggcggagtttcatgcatggactctagtaatccaaggatrgcctgcaagactccattctttgatgttatatccaaaattatttatcagcatatagatttttaaaatcagattatcaatgagatgtgtgtccaggaagatgaaaagacaaagaatcattggtgtaggctttacagatggaatgtgtggctgaaatacacagtttttattgttttcaaattattctaaattctttaatcctctttacttagggtgtcaaaatccttaaccttggctytattagcttcatttggatttctgtgagcttccatcagcaccaagagaccagtaccactgtagcaacataacagagttatgttacttttttatatmaaataatttttaattttttctatatgacagaaaaatatatttttttaaagatttattagctggatgcagtggctcatgcctataatcccagcactttggggggctgatgctggagggtcatttgaagctgggagtttgagaccaatctgggcaagatggcaagaccccgtttctacaaaaaattagaaaattagccgagtatggtggtgcacacctgtagttccacatacttgggagtctgaagtgggaagatcccttgagcccaggaatttgaagtgagctatgatcatgctactgtgctccagcctgggcgacaaagtgagactcccctctctaaaaaataaacatttattattattttgcttttgtatcatatgcatgcctctgttaaattattcaacacatatctaaatgtgctcaatgttatttttcctgatcaaattatgaacagtgcaattcctagagtcttttttttttttttcatttcatttcatagttctacataggttttggcctaaatgagaaactgagagtaaatctccgcttaaatccttaaaatgctattgccttttcttttccctcttctttattctcatggtagaattaagagttatcattgaccagagtgttttcactctactgtggctcccagacagtgactttctgctagagagaaagagctggagatgaaactgaccctatttgaatacggaagaataaaattataaggttgagttattcagtgggttaataagagaaggaattatacaaaataaaattataaggtggggcctttgaacaggaaacaactatcaaagctctgcaatagagaaaattctcaatactgtaaagataattttgatgtgctggacttctgggccagaagaggtttcctgagacacccaagatgcttttcccacatccattagttcaaagttacaaaatagtaggggctggatctaagtatattatccctgagtggtgggttatactgccggctaataaaaagttttatactttgacatgtkctgctaagttttattgtgggttgtaaatgtttaatatcctcctaggggcttttaggagaatatgttttcacagcacatgtggtgctgttatactccgaaccaawctaatgggctttaattatgccaaggtctgtggatcccggagatgctgacaaattcrtaatgtgttttaaattgctaggatggaaagtacaaatcaaaagtttaatctggagtagtgtttagaaaataatttcctttgctaagatgccacctgtcattctcctttctcaagttgaagaatgtggttgagtcattcattcatgaatctcatgtgacattcctatccttaccatggagcagatgaaatgctgaagttgactttaggaaacccagatttgaggcccgagttttcactcactttttgtttgaatcggtacaagtcacctgatatgaaagacttcattttccatgggtctaatataggggagtgctgtaacatgggaagactgacttagtattattgagagaatcaaataagatgatacacggaccaccaggaaacatctgagagggctcttccttattgttttggttgagggatgtttaaatcgtaactagcaggcctgctagaagttctctgcttagttgggaatctagttgattctgttaatatttttcccttttgatcaacattgcaatcttctaagctactgcattcccttattctattaacatggctatcttgggactataccgtacttccttttgcaacccagttgacatgcaggtataygtaaatttggtatttgcctgctttcttagttctgaaaatgggagaggaccaaacactactctcgtcattcaaatactgagtaaagctctgctccagtgataaacttttcagtgatcctgtatacttgctgactttcatgagttgctgatgatctgcaagacaaaattagatcttcagtgctgagttaggcaaagcgcttcgctcctcatcttcctgatgacacccctacagtttgccatcagatgcagatagtgatgatgatagtagggcattaactggtgcttcaaagcataccggtgacctttccacattttttataaaataaatacgtccgagtttgctaggggattccaatcttcactcccataatgctgaggacagcataatatcaatgaagtctgttcagctttctgccagtcagaccaatgtggaaccaaatatgtattactgtcttacaataatcgaagtgaatttcatggaaaagcagagttcctggtacattgtaaggactcactagatgtttgtgaaatcgaattgataagacctttcattctccaagcagaaggaagttgttgtattataagtagttatagaaattatgaacacatggctttaagtatatgctgactttgcagtgcccagtcaagtgccaggtaatctttaaatactgataaattgaatccaatarttaattaacagactttaaaaaccacaatctcataatgaaaattctacttagagactgaaaaaaaactctatgctaatctctctttatgctcatccaagatcatccctgattgaatacataccattcaaatctgtaaaactcaagattgcaagtattagtattagaatatgtagtttattgtgttttgtgagggttataaatattgtttgtctttttttaagaaagataaaaaagttgtgattagcatactgtaggaacttcatttactatggattcataaagagtattaccagtcactgtaggaaagtgtttgtccttacaattgcaaaccttccaagcactgtagttgataagagttcaaacagtcacgtaaccccttttctaaatacagagcttcctgctacaagtttaaattttcttctttaagatatttctcctaaataaggtattattaagcagaaccagtttcttagtaatgaagttaataaaacaggccagtctgatgatgacttttgtgtctttctaagaacaaaagacaaaagcaatctaataatgactttagatctgtagtctatccagagttaaagtgcttgccttttcttttccctcctctttattcgcatggtagaattaagagttatcattgaccagagtgttttcactctactgtggctcccagacggtgactttctgctagagagaaaaagctagagatgaaactgaccctatttgtctatccagagttaaagtgcgtgtgataaaaccagtagcctcacctgttaaggcccattgatctaaagaaaaatctcaggtgcagtataattgtgtaattgttgctaatattgttatcaaattatttgacactgttctctttgaacaacgaactctggcccatactacttgaattcagacataatttaaatgaaatgtgaatgtgtaaatatattattgcaatatgtgttttcactgcactcataaaacttagagtgatcattaatgacatatttttaaaaataccaagcctcaaacttccactcaaaagcttttctgttattttactgattcatacatttattttctgtcaaacaagcaaacactgaattaaaaatgggaaacttttacatattttgcttccctttaccatcaccttaatggcttaacataagtctttaatgtgataggaaacatacgagtgcgactcacaattatggtaaaaaattcaaatagggatataccctttgaacttaagaactctaggaatttagacgaaagatacaatcattataataagagattgtgagagagtcattacaagccttgatatatttacaatgtccattcttataaccagttcctagaataggttagttgtattggtaaactggtgtccctgaattatacaggatattcctctcactacagagtgagctaagcatatccttcagaagttaccttcattttaggttggctcttacaggcttaggaaataacaggaacattgttaggctaagagaatagaatctaaatttatcagacagacatggaagccagaataccttcagctaaaatcccagctctatcatttatgtatttgtttgttttccattttttttctacttataaacaatactacagtgaatattcatatatgaaataaatatctctggacactgttcaacattgccttagaataaattcctaaaaatggaattctagggtaaagtcatgtactttttagggcttttgatatttactgtcatattgcccttcagaatagtttacaatcttctgagctgtgtttctacgcatccatttgcccattcttacatctgcactgggcatcaaaataagaaaaatcttgctaatctgaaaggcataagatctctgttttgaaagaattgtacttctttgattagtggtgaggctgacctttccctgttcataccctttgcccattcttcgagtatttgtcttttttggcatatagctgccatttatacacgtggtcacaaaccacatgatattgcatgtatataacaatttccagttttcctgataacatattgctttggttattaaagttctaaagggtatatgtgttaataatttatatctattcatatgaagatagctctgcggttatctttttttttttttttttttttttttgagacagagtcttgctctattgcccagactggagtgcagtggtgcaatgtcagctcactgcaacctctgcctctcgggttcaagtgattctcctgcctcagcctcccaagtagctgggattacrggtgcacgccaccactcctggctaatttttgtatttttagtagagacggggtttcaccatgttggccaggctggtcttgaactccttaccttaggtgatctgcctgccttggcctcccaaagtgctgggattacaggcatgagccactgygcccagctggttatcctttaaaatttaatattttaaaatagttatgtttatactacctgaaaaccttgtgaattcattatattaaatatacatatgtacctttttctcactttgtcctggcaatcatataaattgtgacagtctttgcaatcacattgagaggttttctctagttgtttaacatctgcctcagtgataactcaaatacatttggaggatgctttactttatataattatcttattgcttgagaatacagattcatgaggccaaatccaagaaatacattttatccaactggatagtcctagttatcagataattcagtaattccaaccaccacagccttgttttcctttttttgtgtaaattttctgtcgggtgtaagagatttgtgtctcagggaaatcttgacttagtagagaatgagtggtatggagagatacagatcactctactgtaattccatctcagcagttaatgggcccagctttgcaataggatgatttctgagtgtgatatgattcttttataagcagtaggtacaagttgactacatggatgagtcagactttaaaaaaatgtcatctcccctgctttgacagtgttcatttcttaccttggaaggcaatctagtgctgaggaaagcctgctggctagagatcaggagccctagacttgcctgtaagctcatcccatttttggcaagtcccttcagcttcttttgttttctgagttctgaagtgacaataataattctrtttcctcatccattataactgaacatcatataaaatatgcaaattacactgaaaatacagaaagagctacacaaatgtaaattgctcttaaagaggaaaatctctgattattctgaatctctgtacgtaaactcagtgcccagaagatgcatatatgagctgtcacttgggccgtctgtttcaaaggctacttattgatgttgttatgcgtcctcaagctattatgccatcttccatttctgggtgtggggagcatggaatcaagttttcaaaagaaaggtggtgaaggttttctcttggcatttatttatatatgtattaatcttacatatagatagaaaggagaatcatttcatccattcaagagccatgaactttatatgaatgtcatttcaacaataaagcaaaaactacagactgtctaaggaaaactccgttttattatttggtttgttacttaccaaaacatacaatttaagacctgaaaatatctagaatacatagagtattatggtcaatcaatacaaaagtgacaaccaaatagaaaaaatgacagatgcatttcacagaagaggaaatgcagatgatcatttataatatgaaaacatcagcctcattattaattgtagaaataaaaattaaaagcacaacgaggtatcatttcacagattggaatgtggagcaggaggaactttcactcactcctgacggtataagcactttggcaaactgtaattatttagtaaatttgaagatacgcgtatattgtaatttaggattgtctcttaggtatatattctagcaagacttttgctcacgtgcacaaggaaacatacataagagtatttgttgcagtattgatgggagaaagaattggaaatagcagcagactgcagaagaaattgagctayagtcatgcagcggatgactctgagcaataaaaatgaatgggccacaggagtccacatccacatggattaatctcaaaaatataatattgcatcaccaaaagaattacagaagaatatacactttataatacatattttatgtttctagttatataaagggcagaactcagcaaattttttatttttgagacagggtctcactctgtcacccaggctggagtgcagtggcacaatcactgcttactgcagcctggacctcccaggctcaagcgatcctcccatctcaacctcccaagtatctgaaactacaggcatgygccaccaagctgggctaatttttgtattttttgtagagatggggtttcaccatgttgcttgggctggtcttgaactcctgggctcaggtgatccaccagccttggcctcccagaatgctggcattacaggcatgagccactgtgcccagccaacaaatttaaataacatactgtgtaggtctacrtaaatttgtggtaaaattataaagaaaaacaggagaatgttgtggagagacacagaaagctccaaaattactcataatattgtattcttcaacctggttgatggactcatgggtgttaattttatttaaaatatgcatttctttacatacatattttggaatatatgatacaaaggtatttcaataaaactatgagggcctagaagatgttggtttggactcagtctgcaaactctgamcatagcctacagaaatgttggcaatacatgaaaaattatgtcttaactacaattttactaatgctgcattaataagcagaagagtttgtatatagataaggaaatgaytgacaaactgagaagagaaagaaaatacttactaggactagrttattaaataatcatataggtagctgataggattaataccatttaataattttctatctgtttaccatcctaaaaattaatccaaagaagtcttgtgttcagycacaaaatgtaaattttactgtggcctaaaggtaatctatgtgcctgttaaacatcaaatacatgagttcatgtatttttatccttggattggtcaatgacttagcaatcaatgacagatagtaatctggcactattttaaaatactcgtgtatgcagtctatggactattctatcatttaatctatttatgatagcaagtttcacttatgcacatccaaaaattttgaggacatttaaattgatttctttggatattaatgagaatggaaaataaccagtcaacattgttctctaggctgtactttatattattgacatttaaataattatttgaccttttgtgtgataaacatctttctcctgatatcagctttgacttttttcgtgtgggttttagttttcatgatttaagttgtctttgtggcattaaaaaaccacagaagtagatttgttaaggrtgtaaccaaaaagagctagaaggaactttagaaataattttacgtcgtctgctgktttcatcttgaagaatttggggcatgaaaggttagataacctaacaagaattagtccttttaatggtagaatcaagccttatttgggccttctgagtttcagttcatcgtttctactgtatcccctcttccttaatatgatgattcattgtaacacaaatatacaatttaattagtagaaagctgattttaactcttacgggtacgtacttatactactttcagtaacttgttcctaagaaaactgtaatacctcgatgagtcatatttagcttattttctccattatatgtcctctgtcacaagatsccatttcgtgggctgtatttcagcttgtattttcttttctacgtaaaagctctaggatgataatgtcattaccactttttacatgcacctctggtgtatcagagactctgctaaggcattgcacatacgttttttcacttgctctttacatcatgaggaagaatctaaactttagagagtgtaggtgatttactccagatcacatagctgctgagtagcagaaccaggattctaatccagttccttctaactacagcatgacaaattgtgcttagcatgaactaagcactttgctcagttgtgaattcacagatgttcttaaactgaaaaggaacaaggaatgctagtctagatttttatagtatgagatagtcacattattgtacattattgtaaaaagtagaatttttacaataattctgtaattscttttgtaatatgttcagtatgattttacttctacatatattcattggcttatctactttttgaaatttgtcatttatttatcaagctaacttgagttttgtttttgtttttcatatttgttagcattctgtgaaacttcagggctcctgaaatattcagtgctttgacccttagagtctgttccmttccttatgatatttatgtagatcctgaaaattatggctctcaggcctaaacccagtttattgtgactttacatatatgtaagttaatytgggctattaatagatgcctttcaagtatgagccttcggtttgctgtacttaatatttttttaaagtatacaataacaacattgtgcaataaagtttgcataatattatcagaggcattcgagccagagcgactccattttgagtgarggctaggaaaatgaggccgggacttgctgagactccatcttgactgagggctaggaaaatgaggccgggacttgctgagactccatcttgastgagggctaggaaaatgaggcyggaactygctgcgctgcattctcataaagtcaggcattcctaccctctagatgtttattatggttaagggaaaaaattaataatgtttaaacagacccagacttaggagtgtccagatatcctgatatctagagaacaatggcattcctaattttgctttaaagataataatatcgattcttgcaaactatagtaattaagaaaattaatcctttatcacaaaccattggagcagaacacatctccccatatatacaagcattgtacctagggtggacacgttcctcctcttactttcaggaacgtcctactctgtctatgaagtagctgccctttcaccactgtacgttcttaataaacttgcttttgctttgcactgcgcactcaccttgaattatttcttgcatgaaatctaagaatcctcccttggatctggatttgtgtctggaattggtgggttcttggtctcaatgacttcaagaatgaagccgcggacccttgcggtgagtgttacagttcttaaaggtggtgtgtccagagtttgttctttctgatgctcagatgtgttcggagtttcttccttctggtggattcctggtcttgctggcctcatgaataaagctgaggaccttagcggtgagtgttacagctcataaaagcagtgcagacccaaagagtgagcagcagcaagatttactgcaaggcgtgaaagaacaaagcttctacaccgtggaaagggacctgagcaggttgcctctgctggcttgggcagcctgcttttattcccttatctggccccacccacatcctgctgattggtccattttacagagagctgattggtctgtcttatagagagctgattggtccattttgacagggtgctgattggtgcgtttagaatccctgagttagacacaaaagttctccaagtccccactagattagctagacacagagcactgattggtgcatttacaaaccttgagctagacacagggtgctgattggtgtgtttacaaaccttgagctagacacagagtgctgattggtgtatttacaatcccttagctagacataaaagttctccaagtccccactagattagctagacacagagcactgattggtgcatttacaaaccttgagatagacacagggtgctgattggtgtgtttacaaaccttgagctagacacagagtgctgattggtgtatttacaatcccttagctagacataaaggttctccaagtccccactagattagctagacacagagcactgattggtgcatttacaaaccttgaactagacacagagtgctgattggtgtatttacaatcccttagctagacataaaggttctccaagtccccactagattagctagatacggagcactgataggtgcatttacaaaccttgagctagacacagggtgctgattggtgtgtatgcaatcctccagctagacataaaagttctccaattccccactagactcaggagcccagctggcttcacctactggatcccacacaagggccgcaggcggagctgccaccagtcccgcactgtgtgcccacactcctcagcccttgggcggtcgatgggaccaggcgccatggagcagggggcggcgcttgtcggggaggctcggacacgcaggagcccatggccggggggaggctcgggcatggcaggctgcaggtcccgwgccctgccctgcggggaggcagctgaggcccggcgagaatttgagcacagcaccggtgggctggcactgctgggggacctggtgcaccctcygcagctgctgccscaggtgctaagcccctcactgcccggggccggcagtgccagccagccactccgagtgcgggacccgccgagcccacgctcaccagcacaagcgccacgcgcagctcyggttcctgcccacacctctccctccacacctccctgcaagcagagggagccagctccagcctcggccagcacagagaagggctcccacagtgcagcrgcaggmtgaaasgctcctaaagcatggccagagtgggtgccgaggccgaggaggtgctgagagtgagcgagggctgccagcacgctgtcacctctcagattgggagcgcttttctgtaacaatatcattattgtgctatttaggagaatggatgactactgtaggtattatactaatggtatctactgcttttgtagattcaaagcaattcagtgggttgtgggaatataatgtgaaaggaaaataaaaacttgggtccccaattcactctgccaaaaagaaaaaattaaactacaagctgagtcatgcaagaagctgcctttccttttgtacctaagcagatagctacagataaaaggttaaatatctccacaggtagctactttatgttcacctgtcttaggtaaacagctgatttacctgtgaacatgtaattgactattatcctacttgatccttttcttttgcaacttgtggattaccataccctacctctttcccctccagcccactttacccctttaaatattgaagcccttgaattcaactttggagaaagrcacacaccacagactgtttctgtgattctgtgtcattttcttctgggtgtgtctttaaccttggcaaaataaacttctaaattgattgagtcctgtctcagatactttttggtttacaataatgtaatatctctttatatattatttttatccaaaataggtaagaaagaaacaaaatttcattaatatttactacacagtttgactctctttccctcagttggtctgaatgacatttggttacacatcaccataatttgttgtctaagtaacacaagatattttgttagtagaagtttcacarttagggtttccttgatttgagcatatcgtgacaaaatatcaatttagtaggtatctatcctatataaacttcccgatgaagttactagatggtgagtgtttaaaacaataacaggcagagtaggcactaattgagtgtcagcattatcattattgattatattattattaagtattctggttctatctgaattcactcaaaaaatagttggctttaagagtttctgcagagatacacaagttgaaaattatactggttatgtaaacacaaatggggaaaatctaaacataaaagctgatatttctccattttctaacacaaatactttgccagctacactatgagctcaaaaacattcaagtctatcaggaaggtatatatgaatttacattattgttaattacaaatcttatcttatggggtctattgtgccttcagatataaactgatgacagtgtgaagtcattacagtgagacatttaaaacctaaacatttagaacatgaagtttgagtatgatatgacatgcaatgacctgagaaaaaatcctttttttttttttttgatactggatctcactctgtgacccaggctggtgtgcagtggcaagatcttggctcagggcaacctctgcctcctgggctccagtgatccttccacttcagcctcctgagtagctgggactataggtgtgtgccaccacaaccagctaatttttttttttaagtagagttgggatttcaccatgttgcccagtctagtctggaactcctggggtgaagtaacccacctgcctctgcttcccaaagtgttgggattacaggcgcgaaccaccattgtcgggactgaaaaaatctttagaacygtcttttgtgtcttccttaatagtggaagataaaaagtcatagtcatttgggaaaacacttactcttatcatagaagtggctgaaataatactgagaaaccatattatcacatgctatattgcagttctatgtcagtaaatattcttaaaaaacatgtggacaacattgctgaatatgtgaaagaagtattaggaaaattactcggtactgggagatggactatagaattgcactgattctgtttcaagaatgaaaatcttgaagagctactttttatgaggctctgaaggaaacatagagacaatagattgtcaggagtgagcaaattctttggtaaaagcaaggatttgggggaggtggttatgaagggtgttcataaagagaaataggtaaatataaccactaatagagttggctgcttgactggaaataaaataacaatccccaggtaagttcacaaaactagctccttccgtggaattcattatttcataggcaagctgttgccgcagagatgttagaacctgaatataaaatctgaatagtattttataatgagatgtgcaatgactttactgtggactgtcttcttgtaatcttgtggccatgtacttcaaatgatgaattttacaaaaagttaagtgtcccgcacttgcagtaataatctggagctttttatagcgtactcccttggagatatttccagggcgaagatgacatttttaacaatgaaaaactacctgctttctggtaaccttaccttggagagaatattttgaaatgaatgtttggatatgttttctcattatacaaatatgtcactgaaaatgatgtaaacacatcatgtataaaatctgtgacatagggagactataaacttaaaagcagaatttcctaatcaaataaagagcttagatgagatttgaaatatttattagaaatatgaaagtgaaatgtcatgtggttagtttgtaagaacttagtgaccatagggaaaattggaatttactattgctacctgaattgcaacaaaatctttttgtaattggtggattaaaatgaaaaataagagtcattttccatttgtgtctatacatttttgtaatctttctttttcggcctttgaagaccattaaaacaaaacaccaagatagactgaacttgaagccagtcctttatattattgactcacaaagttttaatacaagatatttaatataagatatgaagcatattcagttgcatagcattcataactcaagcaaaatattatctgttctattaaaatataaaatgtagacattttttcttatttttaattttaatttttaaataagatatgtaagtattgaagtacagatatagttaaaataattttattaatatgctcctttttgcaaatgtgtgttcaaatatttgcttatggagtatgtcgtaggctgaattatcctcaaagatatccagtttcgaattcagggaacctatgaatgttgccttatatgacaaaagggacttggtgattaagttaaggattttggggagattttccttgattatctgggtgagctctaaatgtaatcacaagtgtgcttataagggggaagcagagtgagatttgactgcagaagaggagaaggagatgtaatggctgaagtaaaggttggagtgatgcactttaaagatggaggaagggaccacaagccaaggaatgtagaaagcctttagaagctgaaaacagtgaggaaacagattctccctggcgagcttccagaaagaatcaatcttgatcatatttttactttagcctaattacactaatttcagacttctaatgtctagaactgttagagaaaaaaattatgttgttttaagccactgttcatggtaacttgttacagcaatgttgggaaaataatactaggtatgtaggaaaagaaatttgaagaccattatctctactttagtttctaacttaatgaaaatgcttttgctaggggttactgaaagtaaccttagatgttttatagcatcctgttttttatttattgacttatttatttactcactcactcacttgctggctggctgtcattttgctgatttccatgagtttctggaccagatcctagtattcaacttccaataacattttcaggtgtttttttttttttttttgaaagattacatgaataacgtaatggcagaatcaaatttagaaactcagcaaaaaaaaaaaaaaagctttgtgtttcaacatgaatttctttttttttttttttttttgrgatggagtsttgctctgttgcccaggctggagtgcagtggcacaatctcagctcactgcaagctccacctccagggttcacaccattctcctgcctcagcctcccgagtagctgggactacrggcacccgcaaccacgcccagctaattttttgtatttttattagagacagggtttcaccatgttagccaggatggtctcaatctcctgacctcatgatccacctgcctcagcctcccaaagtgctgggattacaggcgtgagccaccatgcccggccaacatgaatttcaaaggcaaaaatgctttcacatatctcaattaggcagccttgaaaataaaacttaagaagaagctctcttttaaaatatatttatagctaaaggtttaaaataacatgggttaaaaagtggtactagccttccaggtgctcaggttgctaatctgaatttgtatatgctatgacaaagaaatggttcattttattgagcacatatcaattgaacatgagctatttaaggtggttagtattacaggtgcatcgtaaattgaagaaggttgagcagttaaatgcttgaagatgagaatgttcttttgaggagagatgaaggctttcctgaagtccgtgatatattatattgcttgctcctcacttgtctttgtgtcctagtgctctgtcttaaagatatttaatttggtttcttcaagaaatgagattggtttaacaaaaatgcacttcagcaggcaccagacatttaccagattcattcttgaaccactattgccataaattgtggcacaatgaaattaacataaactgggattagcttggagaaaagagaaggctgattattttaatgatggattatactattaatattaaatctctttatgagaatcaaaactaacagaaaccattaggttctattatggtatttgccaaaaaaataaaatttagaagtatgtaattttttcaccaaagaatttgactcctgtaaagatccagtggatctttccggttagtaacctacatgtgaatgaataagatgagtacatgtgtgttttctttctcctctttgtcctttgtcgaatttctaagccatcccttaactccaagcttctacctgtatgtgaacgaattgggtgtatatttcctacaaggctgcactctgaaataatgcagataaattctgtgcaagatagttttaacattttaatgtttgagtctgaagatactatgttttttttcaaaaccagcataaaccaaaatttttagaccatcatcaagtttttacattattttaacaatctactcttgaaaaatcatatctacattatttaaatatataagttattatttttaaataattcagtttaaaagtatttcttagggcttatttacaaatattttttggtggtccatttgcaatgagatgataagtgttgtcctttcacaaaaattaggtttttctgtaatatactttgaacaggaaacacatgcaacaatgaagaatatttaacaaaatccatagtgaataggtcctgtggaggatcacaaagccccagtagcttataaagtcaggtggaaaatatgttgtccataaatatgtgtaatacaaggcagtttgagtcatcaagaagtgtttcatggatgagtccatatctgagcttggagctgagggatggtagaaattggacaaaggacaaatgggagaaatgaaaatgtgtttgtgaaaagcagagttatctagtgtagtttaatagtaaccattatgtccaaactttataccaaaaatttaagataccagatagggagtttggacttaaatttttaaacagtgggattttttttcttctattaaatctctgacaggtctaacgtgatcttgagggaagtctaatttggtggtaataagtagaagggactggagatgaagagatgggggcagggggatcaggttagagagatgacatctaggaaattagagaagacaatcaggtgtgacgattaggaacattaccaagtaaaataaaaacaactaattttagaaattacattgagaaactgaatttaaagttcccttttatgtcagagtttaaagagtttttgcttgatttccagtatcagatatgggtattacagcttcttctttaggacattgatgctttaattaaaaatatatatgaatatattaatgacaccttacagcatttcttggctttcagatacttttatacttccatttgcagtagtttcttaaattgtcattctacatctgttattgttacgatacagaaaactcaatcctttatagcacttttgaaatagattcttccccttctactaaaattgtttccttaaatatctctggtgatatcttagtttcagacccaaaggctctgacttcctcaccctatttgacccacatactgtgatgtgtttgctctcgacagatgtattatcttcctgctcaaatttgtttctcctcctgtgttccttacgtcagctgatggcagcaccatctgtgcgttgtttcaggtttaaaactatggatcaatctccagttcctcctttaccctcagtgtccagttagttttcaaatccatttttcccttcccttgaatactctacatcacatttcattttttccctrgtttaggttcttcttagctgtattttattttttaaagmtgttcattttacttgcttctttcctgggactattattataagagacagaggtctgatcatcttgttcctattttttatggacctggtatagtctgtgtggacttcctggatgaccaacaaccacaaaccaattcactgtgccagagagaaactgcagccccagcttagagtgaagggggttcgtgtgggtcacagaaggactggtaggcattttctaaatttagatcatttccatgactattggaaagaaccctacctccccaccyccacaaaaggctgatgattgtgcttcaaagtaaatggaagtggaccgaggagtatttatttatttcctgagctgaaatcagtgttgtccatctcatttaaaatgcaaaacttccaattcaaagaaacagtgtatatataggcaaaaagcaaagaatgttttgcattgtttgactagctagtcaaagcaaaaccgaataactctacctcagaagtgtcttcacttaatggtaagatctgttcaaaggcacgtcaacatggtcaaaattagttatatagttcttctgagttttagccaaggactttaaccatcctgatggggaaatgatacaaaagtttaaacatagttgcagatattcaatgtcttgattatttaaagaagacataatttattttcttactgatgctattatgagtgttcttgtttttctaattccatgtttcagatgttcttattagtatataggatagctgatttttatgtattgatctatatgttgcatccctgctacactcatttattagggccagtagttttttggtgggttacttggtgtttccaatgtatgcaatcatgacatttggaaatacggtttaacttcttttccaatctggatgcctttcatttttttctctctctctctccttcccttccttcctttcttttatgacctaatttcactttcaataataacagttcttgtctaaaaatcttttttgtgtgactggatgtagctgtttcacctcttacggttaatgttttcatcatgtgcattttttgtgttcttttacattcaacctatttgtagtttttaatctatgatgtgtctattatagagagcatacagttagatcatattttttatcctgacaacctctacattttgatagaatgtttagaacatacatattttgtgtgatataattggatttgcatttgccatgttgttttttcatatgcctgctgtattttttgtacctgtattcctccattcttgctttcttttgtgcagaatagtgtgccattttgaaacctctgttgatttctttactatgtattttttgagttatgctcttaattcttatgtactcggggattgcaatatgtgttattttaattcatctaamatcgtaacttcacagtctacttcagaataatactcatttaattccagtaaaagatagaaaacctgctccaacatagcttcatttcctttcccttccttcatactctttttttgtgacatatacacccatacatcatacatatatgttccaaacccaataagatactattataactatttaactgtttctttatacattcttatctcttttaaagacgttaagaaataaaatttttacagtcttttatgttaatccacacattttcaatttctgacattttttatttatttctttggaattgaaggaagctccttcagaactttcttttgtatttaactgtgctaggaacaaattctcagtctttgtttatctgcaaatgtctattttgccttcatcttttgaaagatgggatatgagattcttgattgaaaggttttttttcttttggttctttgtcatctcactgccttctgtcttctcttttgtcagatgaaaagtcagccattaatcatatatccatttgatgggatgtgtattatttttctcttactgctttaaatacttctatttttgtctgactgtcatgcaaacaatttgactgcagtgtgtctgggtgtggatctctttgtatttatcctayttcaggtttattgtgctacttagatgtgtaaactaatatttttcatcaaattggaagtttggggccattcattatttgtttaaatgcatttttctgaccgcttctttctctcctattcttctgagactcccattacacgtatattgatgtacttgacgttattccactggtttctgaggctctgtgcatttttttgtcaatgatttttttttctgtgtacttcagattgaataatttctgataatctatcactgattcttcttcaatctgcaattgaacctctttagtatatttattattttagttattgtattcaaatacagattttccatttgatttatttttgtaatttttgcatcctttttgataatttctattggttgattcattgtttccatactttaatttttaaagcatgctttcctttagttctttaaacatatttataatagccgccttgaagcctttacctgctaaatgcctttgtcaaggcactcagagagtttctcaagactatgttttccccacagaatgggttacactttcctgggcttttactgtctgtgtcataattttttgttaaaactggacattttagataatataacaaccctgaattcttttatgtctctattgaaggttattgttgctgggtttttttattttttctttgtttagtaaattgtctgagctgagtctgtgacatgtctctccttgatgggtggccaataacgtcattgcttaatgttttaaaaaaattattcttatttttattttaagactagctttctagagactttgctattccttcatagcttagagttcaggtaatgatggtacagagattgtgctcagacactttgaggagtaagtttttagtcctctaccagccaacctgtccgtggataaggaaatgtataagaagttcaggtcattttcaagtctaccaagatttacttcctgctggttcctaggtgtctttcttgtgcatgtgcaacttcagtcaaaaatatactgagttagagctggtasaggatcaccaggtgtgtgctagcagatctgttggacctccctgggatgtgtcactttcatagatggtgcagtgtgcatggcatctgctccaaatcaagtgagttccctttgacaaggtggcacagctactggtcttcacagctagcccatgtcatgacatggtagaacctccacattagtcgagctgtggggagatgggagtagcccaggaaagaacaccacagatttactgttcttacccaaattgtggcagtttttaagcataaaagtttcttatatttttgtatgcctttggttaatttccacagctctgaaagtgttatttttgtcaattttatccagctggctttttaaggagaagatttgccaaccttctcacttggtcatggggggaggtgcatataatttatttaaaaaatgcagcgtataaatatttttatctatcctgaattgatccttcaacataaaaaagtgttatgttatggctgtatcttatcaggtgctcagcttctagagttatctttcaaaaatattctttgatttctttgtattacctataaactccttcagagccaaattatgtgttaagtgagatggactttttggttactgtattttttgtgttccattagcttcaactataggtttatcatctgtaaagattaataggactctgaagtacctccagatcacctgctgttaagtcagagtcacatctcacaaatacagctctagtttcagttccatataacattccttggcctcatatccaaaggtatataccctgacctagttgtttaattacaccatatctaattctatcatcaagattcttcaaccagaaaatattgtatctcctatggaagtggtgactcayctgcagtcagcaaaggaaagccctctgtatttaaatatatctacagcacatccatccagacaggatcacagtattattgccttccagcacttttgctcctgctagtacattcccagaggagctcatgtgaggctaccagcttctaaaatggcccttaagccaaagtcgtggagtatggggtattcatgactccattctctctgtgtgtgtgtgtgatttttttagagcaggctcactgtcacatttaggttttttttttttttaaatcaatcacaaatgttaccacaaatggacagggcaataaaaagaaaacaactgggaggcaggctgatatgaccttgtggaaggcagtctggtatgagttttaggctaagcagataggtcttttaatagtttctggcttagggcatgtcactcagttttctgattcactggttactcatttctaaagtggggataataatacttatttcatgatgagaattaggacctagcacaaagaggacccttaaaaagtgatatagctattattacttgtataattgtctctacatttttttatattcttgaaactgcatagaaatttcatgctagtacaattcctggcaagaattccaaggtgttgaatgtctcagtctgagtctgcttggagtttctagattttattatacttcattgttttttaaataacagatttcttaacttggagcccaacttcccagaacatgattccgatatacttctgtgactagaatttatgtgttttaaacacaacttaggaaagtgggccaaggatgttggtagaggatcactaggttcgatgtcattgagtgataacagaccagtacacagaaatagtgggctttggagcagagaaagagtttaataattgaatggcaaccaaatgaggaggtgggagggaacctcaaatcctcttcccagagggatactggactaggatttttaaggggattttggtacatagagggctgaggagcttagggctgctgattagttagggcagtggggatgaagtcataaattgtattcttatgttgaataagttctttagaggggatcttcagactggctggtgtcagtggaatacaggatctgaaaatatctcaacatgagaaacatgaggcttcttaatgttaaggatgttatctacagaaataaggaccttgtaacaggggctatgtgatttttaagcagtaagtacctataaggaagtggactatagggcaggctggttaatgcttagctatgcttctactcaaagtgtatgcttttattgaaaaacctagcaatttaattttattaattttataagaacagtttcaatgttactgagttgatttcagcttgatttgttcaaactgatactgagtaattaatttagctcttgccatttcaaattaatttagatgaaattaatccagctcattttcagagaatgagacacctgcaaacagtgagatggttggtatttgtatggttatgcctgaacgaatctgcactatattacataattaattgaatttgaagacatcatcttatcacctacacaactttaattgtggaagccatacttactgtcttcgcttttctcttctccttttgacttttgtgaaactctagacaagtcggaatctgttggttgccctcatctatgtgtttgtgtgaattatttttccttcttcaaggagggcatgagacaaggaactatggctgttgtggcaaaggtcatattccagacaattaagttgacctggttactgtaaaagatattttttgtcccagatactatatcaggcaagaaacctatkaatggattctacaaaatatccctgtcacagaactccctagagacaacactgttgctcatcagaaatgttcactgaaggctctatcaagtgtgttcaatctgtggtctactgagatcctgcagacggcaaagctgagatattactgcaaataacaagtatttgtgactaacaaatacttagctcatacactatttttgtcttagttattgctgatccttgttatcatgaataggctaacatgtaggatatttcctacatacgtaataaacacacacacktgtgtgtgtgtgtgtgtgtgtgtgtggtgttaattttttttwwaaaaaaaaaaccttttttgaggaaagagtgaaaatgtgctccaaagtaattcgtggctagaggaactgcaacagtgtttcaaatatttccatttatatgtttgttctgtggtgtgttattcgtccatttattcatacatttattcaaacatctctaaactctgaatttagtagtaagactccataactcttcaaatagtagatttctcaacctagagctccacttttcaaaacataattctgacatacttgttcgggatacttgttttccagagagttggtatgtggagcttttattgagattgtgattttttttatcatgaataaaaagatagaaaccagtctgcctgaagtgagtttgaattagcaatgttgagaggcaggaacctacatcagaggaaccattagtttgcatatatgactttcaagatacatagtatcttgaggctcaattcatagcagaagtctcttttctgctttgtctttgagtggtttgcttgcaaagttccaggtaattgtatgcacatcamcaatggctccctctcaagatatatgtgagctgatgtgatgtaagccaacattagaattagagaggtatgatggaatggttcatcmaatgagtgtaccttctagttttgcactgacacgtctgagtcatttgaattttaaaataattgtaaaaatcagatgaattggcctatctacttaatattaaaggatgttgtattatgaaagatgcatgtcaaggagcaaaatgaacaccgagcaaaccatatgggaygctacgaattcactagggattttcataattagctgctaagttggcacagctgtggstctttgtagccgcaatgtactgctaattaccactcatttaaacgtgctgctatatcctctctcacctggacctttctattggcaagaatgccaagggaatgacttgagtgtttctgaagattcaaaggatttaagaccggggaaaacccagagacatcagcttcatttgttaggatcacatttagccttgtctttcaaaaagctgacctgaacgaatgagttgacacaggaaaaatctttccttcttggaggcaataatgttaacctctggcgcaaagtgggatgaagggaaaaagaacatgacaagaaaaactacccagaactatgaacagaggtgtgaagctctggaaataatatttccaaactaggaacatggtgtaatgttatgattggggttttgaagcaatgtaaagaggaaaaagtgaactaagatttttcttagatcttgcctgttacttcctttctacagtatttcctacgagtcaatgggatacaacaccatggttttttttgtcactggagaatatataaacattttaaaggatattattccccatctggtaagtgacattttgcctggttcatgtctctagttggtaaattaaaacaacaaccaccactttatctttcggaggacatagaatttgatatctccatcatttggggagaagtcgacmctcaacagttacagtgccttcctgaaggccacacagcagatgggcgcctaagcaaaaacaaacctgcctcaacttcagaccatctgctctgttttaaagtatactgttttcacatctcttggtggaagaacagcttttctcttaatttatatctctctgattctgagctctcaatctgatttagggttttcttaaattaggcagataaaattataacttattggcattgtccaggttatcatgcattgattttcttctttcgatctctttgaagtcggataagtatttttccacttcataggcagggaagctcagcccgactcccctgaggtatcttggctagttacccatgagatctgaattccatgttcctggtacggggatttactgctgtcaaactgtcaacattaactacatcattcatttgcaaaatacattttgagatacctgtgttatgtcaaaggtcacttggagcccaattgaaaggcagtgtgaaaagcataattaacttgtttgcttttgtgctggaaacctagtgttaacaaaacagcccaaccaaaagcagatttgtcattagggctctaactgcctgtatccctatagtgtatgtgcatctgtttgattttccagaaatagatgaaatcatagtttgaggttagttcatcaaacatcgaacattttctttgtgtaagtcattgtattagggctgctgctggtggtggcggtggtcatgaggtagagtgggatccaagctgagtgacagtgttgcgtggcagaacacgttgattaatcttcagcaggaatatggtgtatctagattctgtggcagtcatgccaatgaagtagaaatatctttgctggcagacagtgatctccaggatatawcagtaaatttaaaaatggtaatttatatagcgtgaacccattaatggaaaaagctaatctatatatttctacatgccatgaatgtttctactgctatgaatacatagcatatgtatacatgtaaatgcatagaaaaaggactgcaaataggccaggcgtggtggcctgtaatcccagcactttgggaggccgaggcaggcggatcatgaggtcaggagatcgagaccatcctggctaacacgatgaaaccccatctctactaaaaatacaaaaatttagccgggcgtggtggcgggtgcctgtagtcccagctactcaggaggctgaggcaggagaatggcgtgaacgtgggtggaggagcttgcagtgagccgagattgtaccactgcattccagcctgggtaacagggccagactctgtctcaaaaacaaaaacaaaacaaaacaaaaaatatattaaaaaaagaaaaaggactggaaatatgcacactataaagggaaagtgagtataattaaatttggaaagagaattttcagttttccagtgttgtttgacgtccctacaaggagatgtttttatgtgtgattttatgtgtgatttaaaaatatgaaatagtgtgcataggtggggaccttcacgccgagggagaaaaaaatataagcaaaggcatcaggatgtgaaatggagtagtttattagtatgcagtttttacacataataatgagaaggatggtggcttaatgtggcttatatagtcctaaattattggttgttattcagttaaggtaatgacatgtttcagtaggtttttaagtgagttaggcagatacaactctggaagccaagtagttgatggatactttggttggaaacctaattgatttttacatagcctctccagagccagcaaagccagatgctgctttgtggttattcttgagatttttttccccctctaagactatacagtgtttgccaggcaggggaggatggtgaccagtttgtatttaaaaaaaaaaagaaacaagaaaaggcacacagccatgctgctggcttaaagtctgttacctttcccaaagtatatatattctgataaaatcggtgttgtctccatatgaaaagtattattaccctcctgcaagcttgctttaggcactattctgggtagaatagacagacacagatgtttagacagactgaatctctttctctgatttaattttgcattacaggtaaacgccatatgtaatgtgtaagaggcgggtaggtaaacatgctcaactgcagtttttggttttgtgttccgatgtgatctgagtatttcgaagcacttataatgcagagcgtactatatgaaagttctcatgatttgggagcacactcatagtaagggcaaggaacgttctttcacattgaagttctaaaaattaactgtctcagtaataagacttaagcaaaaacaaagtaagactaaggaaaagatgataattttcaaatgcttgcaaatgggagcctctactccccatgtttgtaaaatgttttaccttatcttccattcctggcattaggagtcattttggttcggggccatttattgaagctgatctttaatgaatgaatgagaccctttattttccagtgatgctgctttatttttgggaagtgggaacaaaggcctgacatgctaccatgggtataactgtacaaatttcaatgttatttgaagaaatagacatctaaatgaagaaatacttttagttgttgactttaaaaggtacaaattatgctgatgattctgtttaaaataactagatcatttttctttagagcaaaacagacaacactacaaatctctgatgtgtattaagttttcctgaaaggtaaacactatttttttttttaactgtctcagcttttctattacatttgtgtgtgtagggggagctgggtacaaagagaaagcatggtgaagatgactcagaacaaaatgggtggcgtttgtaagacacagggaattgcctttgaagattgttggcgtgtttatttatgctaactcccacgatctgaaaaaatagctgtagcaggctcattactctgtggaaaaataaaattcatttgacaggattaattcatttraaacccatgtggttttcaaggatctttaaaataacatgagatattacagcaatccttactttaacattttgatctaagcaaaggcatgaaacaatttaaatacacccagaatatgaagttttaaatgttaccggaaagtgtcttttcttgacaatactggaacattttggatgttatgaacaggtgcaaaattatagatttgtgttttcaaacactatttgtgcgaagtagaatccatgcaagaaccgattttaagaaacaagtggtgcttcatcatttccagaaatggagaggaattacaatatgcaaaactaatgataatagctcacttattttaagttctttttatattcttgacactgtgataagctctctacatatattatttcatttattcataacaaccctatgagaagggtataattattatccaattttttttagggaaggaaaccaaagattataaaagttaacagctaataagtaatgaggccagtatttttgcttaggtggtctgtgtatagaatccatgctcttaactattaggatatgctgattctaaagcaattaataaatgttggtctgaaatcagtctaatggcacgctggaaacagctcttagacactgccaagggttgattgttagatattttggatttttgtaagccaatttgtaaactttgatactttgaaatcagcagtgattggagtatttacaccacagaaatgggcaaatgctacaaatcaaggcattttttttcaagtcagttcaccagcacaccatttgataacatagcgccctttcagcagtgccaaagtataagccctcacattttaaatggatataaatgaaataaacacttacattaacagttttttttacattagcatttgtcttgatctcaagaggacagactataattagtatggttagaactttaaaaatgaaatttaagagtatgtattcctaaattccagagtagaagagagtccttttcctagcctttgaacttttatatgaggattttagaaagaaagcccttgtctggccaactgcagactttaaatgcagttagctgtgccagatttgagaggactctttgctggctgaaattgtctgagcaggaatggaaagtgattgggttgggtaaacaggagcccatgataggaggatggcagaagccagagaaggaaattttatttwaaaaaaaaaaacaaaacagaacaaaacatgggaaccagtggggtttgtgtggtctgagtaagctttgtggccttattgtgggcatcatttatccataaaataattttagctttaatttgagaactctagtacttgatttttccttgtaaccataaagcatcattttatgctgtgatgaaaaatcattccaatggtagaggttcaatttaataaaaacttaaaacagtgtaaattgtaatgtggatgcattgcatcagcttatcaaatttatcctcccagtgttctttttatgaagaaagcgtaacttgcttacatgttgtgtttaatgtatttgtaatgttcttctgatatgaagatcctccattgaacatttgcttgtacctggttggactgcatactggatcctgcttgtctaagcgaaagcatacatgattaataacttacggttctaactcaccaatcagttctttttcattatttattatgatttattggaaaacatttccataaactgaaagaaaagaaagaaatgcattcacaatttaatcatccaaactgaattttcttcctttttttcaattttatttttattttttgagaacagggtcttgctctgtcactcaggttttcatacagtggtgtgaccatggcttactgcagcctcaaactcttgggcccaagcattcctcctgcctcagccctctgaatagttgggactacagccatgtgcctttttttatatttaaaaaaaattaaggcctggcgcggtggctcatgtctgtaatcccagcactttgggaggccgaggtggggcggatcacgaggtcaagagatcgagatcatcctggctaacatggtgaaacccccatctgtattaaaaatacaaaaattagctgggcttggtggtgcatgcctgtagtcccagctacttgggaggctgagacagaagaattgcttgactccaggaggtgtaggttgcagtgagccgagatcgcaccatcgcactccaccctgggaaacacagtgagactccgtctcaaaaaaaaaaaaagaaattaaaacatatatatgttaatatatgggaaggacaagtactgctctcctacgtgcatatattgtgtagtggtaagtctgggcttctagtgcacccatcacctgaatcgtgaacagccagtcaattcttatcctggttccttcacctcctgagttgtgattttgagaatctgtggtgtattgattgagatagcggtttaagagaaagagaaaaaaagaaaacagatggaggatgaaaaaataaagcaatacagatatacacagaacaggaccaagttagaggcaaaatatagcatccaacttgaataaaacaaagtaatcgctactttgtggataaggagaaacctgtgtttgggaatattttatactaattcagttttatatttgcttatctttaatattaatytgagacaactattatttttctgttctttaatttttttatcagcaaactgaatggtaagttagaaatgaatgtatgagagtcagagaaatctggattttaatccttagcgtgaaaattttataactctgtgactttggaaaaggaatctaacttctctgtttatcctgttcacacgagtgatagtaataatccttactatagatgaccacaggaattatagatacagctcccagggcaatgcgtatcagagtaagctgtgtctccttacattttcagagctgttattgttgctcaataaatggcagctgttgttatctgtgtttttgttgttgttgttgtttttgagacggagtctcgctctgtcgccaggtctggagggcagtggtgtgatcttggctaactgcaacctctgcctcctgggttcaaactattctccagcctcagcctcctgagtagctgggattacaggcttgtgccgctgcgtctggctamtttttgtatttttagtagagatggggtttcactatgttggccaggctgaactcaaactcctgacctcaggtgatccgcccacctcggcctcccagagtgctgggattacaggcgtgagccaccgcacccggccactatctctggttttttaaaatgtattaaacatgaggagtaatgacagtgtttcttgatgactggggaacttgcagtagaaagttgacaaatactgtttctatgaaagaaactggagcctcctaaggtaagctgggtctggatgcttgatgaagatgatgctgctgactgctcttcctctttctgtgcagaatgtgcccccagacctctccatctgcacctttgtgctggagcagtccctctctgtccgggcrctgcaggagatgctggctaacaccgtggagaaatcagaaggggcaagtacccaatttatgtagacttgtagtattttaatgagctcagctactataggaacaatttctttcacaggtgtcagagattttctttttgctaaaataagtccatgcctttcagttggaatgtccttaggtttgactttctgctttatctagcatatttgtggtgtcttgaaaactaaaaaaatatatccaagcttgatgtgatctgtgtcactaggcctcgtgcttatgtctgttgtttaaaaccgacctttctttgagcgtttctgtgtttcattacattttcagagctgttattgttattattttaactcatagctttatgcatggctatttgtcattaacctttatttcattttcaaatgtctgtcactatgtgactatgttctgagctttttcatggaaagtaaaatttcatggcactgttatatattttaagtaaccaaattttggtgatatggctttaggctattgtaattttgcaaacagctaatccttctcctctgaaaattgaaatttttcttttcttttttttgagatggagtctggctctgtcacccaggctggagtgcagtggcgcgatctcagctcactgcaagctctgcctcccgggttcatgccattctcctgcctcagcctcctgagtagctgggactacaggctcctgccaccaccacacctggctattttttttttttttttctatttttagtagagacggggtttcaccatgttrgccaggatggtcttgacctcctgacctcgtgatctgcccaccttggcctcccaaagtgctgggattacaggcgtgagccaccgcgcccagccctgaaattgttatgtggtttcctaatgcaagtatttttctttcaaagcctatttggttattttattttcaatgagacttcctgtgactgatatctgggctgttacccagtcttaaccaatttattaaagtttagaattaagcaggaggattaatggtcaaattttttgtttccaggttttttaatttttattttttggtatggtaattactgcagtgtatggtttaataaagtgtagtatttccagagagaaaactgaaaattttattttgccattattgatctatatgttgctgttgttattaatcattactctggtctggataaataaagagattaaaaaatggtaatatataaatgattatccatagaaaggagtgatcagttataacgttattttcatcagccttgtagtttttaaaattttagtgtcatgcagcttatgactttagttgatttgtgcattaattctaaattaaatttcagcagtgtactattaagtagggaagagaaactttagtgacttttgatattagactagaagcttattttacaaaagcttagtattttagtttttcaggttcattttttgtttacaacaaagtttgaaattattaaaatatatawagtttcttttaaaaatttctattctttcatgtaaaccttctcagttatgcttaagttatgaaagagtaaaacaattctcaatttagtttcatttctacctgaaataacccctcctgatttttaaacatccctgagtcatatcaactttgatatgcaaatcagcttttataaagaaagatcatttttatttggcattagcatttaaaaaatgcatcttgccatttcatctgtctttatagataacaacttagaactaaattgccataaatttaatttttttattgttaagttgcgttttttaaatttaacaactttgagaagatcttttatcttcttcaaatcatgaggttgggctgggcaaattctaaagtttcttgaaatataggaagtaatttgaaatactgttttaggatttatggtttttttgagatggggtcttgctatatggcccaggctggtcttgagctcctgagctcaaacaatcctcctgcctcagtctctggaatatctaggattacagatgcatgccacagtgtacccagcttctaggatttatgttttcaagacatttattagttagaatttctggatctcctcaagtatttttatttagctgaatttagttttgaattgttcactctctagaatgtctccatcacagataaagtagtaatttgtgtgatgtgttgaacactattttataaagcgcagtatagttaccataagacatgaattaggaagtataatttgaggaaaaactgctacaaggaataaacacattgcatgaagctgaaacctatttctggttattagtaacttttagaaagaaaccaatgtcaaatagctcaacggggtaccgtatattagggaaaaatgaaagtttctctcatactgctgagtatttttgattatacccagaaatgatattcattcctagcttgccacaggtgatgccagttaatgagcacagccccagccacagcgttggaggaggagttctggaggcctctattgtatttatggatttggaggtagcccgagcaacggggggtgtcctggaggacccctggggtggtcagggttagggagcactgtggggacttgcggcagcaactgtttaccaagaaggatagatattttccacttaaccattttattcataaggatgtgcaccagctagatatcatgtctgatgatatgtgactcatggatgctgctggcacttgtaggaaccaagtcttctgaactccaaatatcatcttttctagtgccttataatgtcccctttacactcattatggaactctaatggggaatttttttatcaatcaaattactatctccaggttaataaatcatgtgtagtttgcttaaatgaagagccacttttcctaggatgaagtgtgtcaggaaggtaatgtgaattttcaagaaatcatttctttcctttcagatgaacagtgagtcaaaaagaacctcgtgttgccctgattcccaactctttcataatcarctttctttacgaagccctgttcttttttatttaataattcttctttaatttcttacgtaattcagtaaattaaacaatacttatactatttcatgtccaaaatgttatatgcacatagcaatacaaacacacttgatgataaggaaaatttttccatttagaaccatgcctttgttttttgtggttaaggaccattttgctagtattcttgggtcatgaataaatacatggttttcataaaatggttaaggaaacttagcagaaaactcccaatgtcatttgtgasaaagtaaatcatgaacattacgataacagaagaagatgtgtaagatgaaatgggagaaaatattacctaatgtatgaagttttggttccctaaaaagttgcttattgtgactattagtaaaataactcatatttttgtggcaccaaaatcattctgaaggatttcatctaagtggattttctaaaatgtctgtttaattaaawtatatatatatatatatawgttaaaagagagacctagatccagtatttatataattacattgactatcatttagcttttattcttattaaaatcatgtcaatagtaaataggccaagacctgtctatctcagtagctgcccacagaagctttcagatcttgaggatggagacagtacacaggcaacgagaaggagaaggtgtctgttgagcagcaaccatctctttggccccgttttctctgggcgtctgcctatgcacattctggcttctgctgttctttctatttcccccactgggttttctgtggttctggataacttgtcgcttgcagatctacctctgtattgctcttcttgctcttcagatctattttgcgtatggatgatatagcatagggttaaaaacaggggtttattgtcttagagaactgcttgagaataccagttctgccatagttagctctgtggctttgggaaagataactttatcatcaaggcttagtaattattaaatgatggtgcatgttattattgttttatttattcttttttgtatacttttaaactccctgggttggactgctattaattcctgactgccttttctctgggcttgatggctttcttccttctctgggacatagccagtccagttcccacttcctcccctcgaccccagtattctcatcaatcctggcacatgtagtttgccgatttaatgatgccgcagcagtgttagaatagrgagttgatgatagcatttgcttgtttccatgtgttttgtagttaataaagtttcataatttaagtaatattgtgcttttggctattccttttatcttaattcacaaaattatgatagacacttttctctcacacaactttatttgtaatgccaaagttaatttaaggatttcatctcctatgagcacagatatcaagtgagaggtgacgtagtatagtagaaagggctttggttttggagtccaggaaatttactgaaagttctttttcaaataatatttataataattatcatctgttgaaaaggcgttgctttggtttaatgccatgagtccaatatatggcttgtatattctgttgaggacagcgtattttaaaatacacgttgagtgtcctttctgtctttcgggtgaattatttctggggggattgtaggaccctgtccttttcaactttagcttatggccacttgactgggtccctttattattagaatattgtagattgaactagagaaaaaattaaaattaatcattctttgctccttacatcgtgctctttgatggagtaatagattaacatttataattcaggtgattatgatttggatcattcattcatttgctatataatcctcatgatcgtgggtattggtagtttaccgctatgtaagttatggatgatactttaaaaatctataaaattcacaatgtaatgttataaatattgtgatgagcaaataatattgaaatgaatattaaataaatccaattctaatcatttggtgctttttcaacatttataaggtaacttatatcttataaaggttctatgtatagaaatttaagtgtttttttgtcatcaatgagtttacaactgcagggatagaaaaacaattatagtataatttcatgtatgttatagaagtatatataattatcatgttggcatgaagaaggaattgtgtacgtggaacttgttgttcctttacattttcttggcactttttagaatcatttccaaaactattagaagtaatattaaaactattaatagaaaaatcatttcaaaattttttccaaggaacaatttgagctcattaggcaattccttaaaattttaatagaaaataatacttgtcaggaagacaatccaaaacatgtccagagatattcttaaaatgatttttatgtttcagtttagtaaaatggcttattgttttataagaaactgtaatgatgtttcctctttctaaattatgtactgtcttcaaagtacaaaatattacaatgacttaattattaacagaggtatagatcagactcagacatgtccagcttttatgaaaaatggagctgtagaatgtggagtagtaaaaaacttgtgttggctgggcacggtggctcacgcctgtaatcccagcactttgggaggccgaggtgggtggatcacttgaggtcaggagtttgagaccagcctggccaatgtggagaaaccccgtctcttatgaaaaatacaaaaattagctgggtgtggtggcgcacacctgtaatcccagctactcgggaggctgaagcaagagaatcgcttgaacccaggagatggaggttgtagagagcagagattgcaccactgttctccagcctgggcaacaaagtgagactccatctctaaataaatwaatwaattaattaattaattaaataaaacacttgtgtcattctttttataaaacccctatctctttaagacatgtactctaagaacattcaaaaatgcatggggctgggcacggtggctcacacctgtcatcccagcaatttgggaggctgaggcatgtggatcacttgaggtcaggaattcgagaccagcctagccaacatgttgaaaccccatctctactaaaaccacaaaaaattagccagacgtggtgacacgtgcctgtaatcccagctacttgggaggctgaggcacgagaatcacttgaacccgggaggcggattttgcagtgagcccagatcgtgccactgcactccagcctgggcaacagagcgagtatccatctcaaaaaaaaaaaaaaaaaaatgcagtgggaagcaactggctaaatttactggtaaataaattaaaaaaatacatttgtgaagcactgaagccccataaattactttttaaaagtacatttatcaaacactgaagctccaatttcacacaagtaattgcatctaagatcattttatataaatgcaagagcaaaagatgaagaagatctgtgtattatctcatagtggttaaagctcatagattatagtacaaactccctgagttcatttcctggtaacataagtgacttaacctttctgtgcctcaattttctcatttataatgtggggaaaataatagcatctccctttgttgtgggaatcaaataatataagtaaagtgtgtagaacaatcgtggcatgcaagaagcactatgagtatgctgtcatcattgtgatggtctctgcattgagtatgcctgagtaagctcctatcagatctgatccttctgaagaaaataactataatctctggacaaaatacaaaaacaaaactacacccacaataataaaaccttcaattacctgaagcccctagctatagttgctctatggccgcctttacaagttaccgctaagttggtggcttaaaacaacatacatttattattttctagcgttagaggtcacaagtctaaaatcaatctccattggctaaaatcagggtgttggcagcactgcattgcttccagggactctagggaaaaatctgtttccttgccttttctagcctgcattcttggcttgtgacccatcctccaccctcaaagccagcagtgacctaccatgtcacatcgtcacaggtgccagggattaggatgtggatggttccggtgtgccattatgtgggctaccctatcatggatgtgctgagctcgagtaagatgttattgacaagatcaaatggaagtcagaacaatctagttgaaaaatgactgaaaagtctactttttgatttgacaggagcctgattttcttgcaaaccgatcaataggaatttcagtctgtcttatgtacataccaatttatagattcacatacattttgtatttaacgggcttcattctctgaaggttttctgagtttccagtagttaatcacatgatttagaatttaaatttaagtatattttcatattgcatgcatagtagacactaattacttttaacaataacattaatcaaaaataactaaaaaaatgaggatatatataaatgcaatttgttgagttcctatcgtattccagacaggcatcttcctaagccatgaatacaaaatagtgagtgtggtattatttttctttgttaatagcagcctgttcagtctttggctatagtctcttctgtgtcaggtaacagtatttgaagtatggtcacagttccaacagtagatcttcatatttcttttacatcctcattcttctggtattatggtatctgctcagaggcactacatcgtaaagccttttttgttcaagctttagggcagatagatcaaggatcaaaatgaaaagagttaatgttgtgtccacgctagttgagttttatattaatgatttctttccattaaagcacattggggtaatgtggaggaaaaggagttgatgaattttgtagttcatatgatataaattgtgttctgtatattattaaaagtaaatttctcaaatggcagggctaatgactcactggaaaaaaatgaggtttaacacttgatgttcatccattttcaaatatgctctgtatgagtctccattaagtctctgtataagtcttctgtattttaattctgtaaaatacagaattaaactccattaaaatacagaattagtatgtaaaactgtgaccatactttaaatagtgtaaatgtagagatacctgccactgaagagactatagccaaagaatgaacaggctcctattaacaaagaaaaataataccacactcatcatgttttatttgtgtttcaggaagatgcctgcttggaatatgataagaactcaacaaattgagcatttatatatatcttcatttgtttatttagttatttttaattaatgctattgttaaaagtaattagtgtctattatgcatgcaatatgcaaatatacttaaatttaaattctaaatcattgaaatgttttatttttataacagtaatatatgagtataaaataaaaatgccctcttcatagtcctcattcccccctaagataaccacagctaaaagattagtatatagccatctataactttatacataaaaatattattatataaatggaatcatatactgtcttgtcatcttttaccacctaattatatatggtttttaaaaaatcaggacacaaaatgtccagaggaagagaagattcagatttagttgatccaagctctaggtgagatttctgtagttctctttgccctgttctgtgtttgcttggttcacaggctagcttccctcatgattacaggataccttgtaggaatttcagggatgatatccaaaggcaacatcatctataggcacaaaaaggagctgactttctttatttctaaaagcaaggcactttccccaggaattccctggcagaatttccctcatacccattgtcacacacccatagctaatttatttactcgcaagagaaaatggggccagcacaactggctccgaccatggggatggcaatagggaaggatactttgaagaactaggttcttttattgggagaaggaagagaactgcatgtgaaaatgaaggtcagataatttctaacattgtctgctacatcatatagcagatacatagttagcatctgtatgctttcactggaaatgtttatatttgggaccctccatgttcttgagccaaactaggaccaacaagtaaaatctttgcctatgaaaacaaatccaactctgtgctcaggtgtctccatgaccaagaaatagaaagcgcatgtccattctccacctgtctcattcgtacagtgttcattcaacaaaaatagattgagttgcttttgtgcattctggagctagggggacaggtatgaataacaatgcctccttgctcttgagaatcttagcaatctaataataaagagagaagataaatataatgtggtatgaatctgctttcatagtaaatagttcaatcagagagcagagaagagatctaattacctacccaacactctccccttgtacgtcctcataactgtgaaatgctgaatggattagtgtgtgtttatattgtagacaatacgatgctactagctatttatatctgaaacttctattctcaaatatctagtctaacttaaccttattttaagaggctgtgttctgttacctacctattgaagaacatccttggtaaagcataaatagtacttcaataattagattataatgccaataaattcacaaatttactaattaatgtaatatttagccagcatcttgtccaaagcctctgtatataaatatttacctacctgtcatctgcaaaattgatgcagtgatgtaatggtgaatgtgattataatctcttgaagggttcatagctaaaaatattcactgagcaacaattatccatctgtcacttaggtgaatgtggaaatttgtctgtggttgaaagatgcatctttcagttttactgcctttctgtttctagaaagacaactttctactcagaagccaaggatattccatatttctaagtatttgaatgacgtggtttccagactctgtcatcaaactcaataaagacgtcaatttaagcaggatgtaatttaatcacagtggcgtagttaggcactgttttagattatgaatcttaaatgtatagattattttatttgattagtctcattcaatttggacatcttcctcagctatttgtgtgtgtttataatagaaaaaattttcatttgtaaacatatgatagcaaataaatgacatggcatatttctgattcaatcttaataaactattctgcaatttatgagtgacttaaagatatgtggaacctattgagtcagccattctcaaacwtttttcttttttgagatagagtctcattctgtcacccaggctggagtgcaatggtgcartatcctccccaaaaaacaaacacaaaagcaaaaacaacaattaacactccytcctgcatttttttggtgtgttttcttcaaagcactgaacaccttctgaagactatgtattcgcggtctgtttattgccttcctatccccattagagtgtaaatctcaggaatgcaggtctttgggtctgtggtattcgcttgctataccactaacatccaagacaatgcatgttatgtactaggtagtaaggaaatatttgctgactggagggactgcaagatggaatttatagaccaaaatcaaggggctgaaaagtaccaaaaattctgtttctgctactgtagtaacagttttgaacatatgatagagcttttttgtctgttaaatacagctgtttttgaattgcctctctattgtgggagaaaaggaatgtttttgaaaggaaaagtcagaaaataaccttttgggttcggtaatcctccatcctcatttgcctgacacagtccaggttaatacctgtggtcacagcataatcactattagttccccctttcgttgtccaaagtgtcccagtctggatgagaaattacatggttatccctagtcatggtgtctttgtgaatcagataaaacttatagaatctatttacagaaggcaatacaaataatatgcacgcatacaaaatcttgtatttcatctctgatttgaagacttaaaagaagtcttcctttttgttgagttaaataacttccttttttttttttgagttaattcttgctctgttatccatgctggagtgcagtggtatgatcatagctctctgcagcctccaatgctgggtctcaagggatcttcctgcctcctgagtagccaggaccacaggcacaagccaccatgcctggctaattaattttttttttttttttttttggtaaagataggttcttggtatattgcccaggctgtccttgaactcctgaccttaagtgatcctcccaccttaacctcccaaaatgttgggattacaggtgtgagccacctcaccccactcatacaacctctttagtgattgttgcagtcacacattctgagaagatacacttttttgcaagtaatccctgaagtgtgagagaagggcaaagaccagcaggatctacataacttgaggattacagagaccagatggaacattctgagagtgagcatgaggtcagtactcgtagtacaaactgattactttcatgtggcttctgagatcaggccacatgtgacccatgacttcctggtgaagcattaagtcttaagaccacgtggaactgtagaagggtcctttgctggaaccagaaaccttagaactgtccttagaccactgaaaaaagtacaaagagcagcgcagcaagaacacacagaatgggcctaatattgccgcgcactgatttccatagccctggaaaatgtgagccatatgtgagacaagaagaacatattgaaagccttgcagtatctgacaaaagagaaaagtaggccaggcgctgtggcccacgcctgtaatgcaagcactttgggagtctgaggtgggaggatcacttgagcccaggagtttgagaccagcttgggcaacgtggtgacactgtctctacaaaagataaaaaaaattagctggacatggtggctaatagccatagccagcatacctatagacccagctacttcagaggctgaggtggtgggattgcttgagcttgggagatcgaggctgcggtgagctgtgtttgtgccactacactccaacctgggtgacagagcgagatgctgtctcaaaaaaaaaaagcatcccaaatctcacacaacaatgaatgagattggacaatgcaaagataaagctaaatgaaagttaaataacacgagagatcacagaagaaacagcagctaaaccagcaaaattaaatacttcataagctggtgttaattgcatttgttcactctattgatatatgatgagtaaccacgttctagattctgtgtagagtaaatagtgagagcgagctgaattgctacagaggcctcttccagaataggacataaatggagcgtgtgcattgtagtgtataaacactcaataagtgattttttttttcagatgaagaaatagaaacaatgtaccaaggtcagcgattaaaaatagtgattatctttacacagtcatggactggaagttttgtttctaatagtttccagaatagaagtatttgtgtgaatgacaattatatgacatgtaaggaaattaattatatcatttattgattcttgaggtacaggctctaaagctccagcatggatttgatgtggatggtactaatgatacagatatttaagttttgttgatttgtatgtagtttccccataagaggttttttgttttttttttttttttgagacagagtttacttctcattgctcaggctggagtgctatggcatggtcttggctcactgcaacctctgcctcctggtttaaagcgattctcctgcctcagcctcccaagtagctgggattgcaggcacccaccaccacgcctggctaatttttgtgtatttttagtacagatggggtttctccatgttggccaggctggtctcgaactccttacctcaggtaatccgccggccttggcctcccaaagtgctgggattacaggcgtgagccaccacgcctggcccccataaggggtttttagttcctcgggaaactattcaagcattggttaggaagaaatatgtgcagctgggtgaatccagctaatgatcggattattctcatggcgttttgccgggggctgccttgatgatgtcttcttggatctaggtctttaacttgtctgtaactattgcacgctgtccctccagcagaccgttcctaatttaactgctatcctgtgacctcagttcttacaaaggaatctaaaactgtaacctttctttatttctggctccaattagttctttatactattcgttctctatccaaactgaactcactccctgaatatgctacacttaattcaggtatatattctccacattcttactacactaattcctcaacctagaattctgagcctttcaaaagtttaccacccctcgcttctctgcaaatgtccaaggagttgtcttccttaaacactttcatgaagctcccagccagaagtaatatttctactcgtagagttccttatcactgggtgttcacattttcttatttttgtctctcattttatatagtgattatttggtatgtattttatacattttatttacattagaatatggttttgttcaatgtccattctttaaccaacaccacattgtcttgattactagtagctttatagtaagtcttttttatttatttatttattttttgagacagagtctcgctctgtcactgggctggagtgcagtggcaccatcttggttcactgcaaccaacctctgcctcccggattcaagcagttctcctgcctcagcctcctgagtagctgggactacaggtgcgcaccaccacacccagctaatttttgtatttttagtagagacggggtttcaccttgttggccaggatggaatccatctcccgacctcgtgatccgcccacttcggactcccaaagtgctgggattacatgtgtgagccactgcgcccagcctgtagtaagttttgaagttacataatgtctgtctctgactttgttcttctccaatgttgtgattattgtgggtcttttgccttcccatataaattttaaaatcagtttgtaaaaatctacaaaataacttgctgagattttgattgggatgcactgacttgttagaatgtgtaaaaatttttctgtattcctctgtgtacctgccagtttttcatagtatatagatctaaaatgtaagactttattatatgaaatttattattcataatagatctaagcccaggaggtcaaggctgaagtgagtgctactatattccagcctgggtgaaagagagagactctgccaaaaaataaaaaataaaaaataaaaaataaaaaaaaatatatatatgtactatgtacatatcctgaggatttgaacaaattcagaaaacactgaaacagtattacatgagctggaatttatttaagagtagtaatcaacttgatttttttctattaattttagctaagcaaaagttccatcattattcatgactgatgatttctttccttatatttattgtgatgactttttaatcatacatttaaactaatacacattcctagaggtggtactctaagctgaatattttctaacaaagtctatctattattatgtctaatamcacatttatcactgtattttagaaatgtttaatattaagattagtccccctcattcttttcccctgacccccaaattgttcttattcttcttgactatttatctcccaaatgaaattacttgtggtatttaatttaacttagtaattctgataagtagcctccatggaagagacttactgtattatttacttagcacccatccatccacttgaatttgttaacattaaggtttatgcaacagccactttaacgtattctgtacttagagaaaggagatattgataattttgagttagtgcatatccaggctgggtgcggtggctcatacctataatcccagtactttgggaggctgaggtgggcagatcacttgagcccaggagttcgagaccagcctgggcaacatggcgagactctgtctctacaaaaaaataaaataattagccaggtgtggtgcaacgtgcctgtagtcccagctacctggaaggctgagaggtgggaagattgcttgagcccgggaggtcaaagctaaagtgagtgctactactgccactatactccggcctgggcaaagtgagagggtctacctcaaaaaaaaaaaaaaaaagtgcatatcctgaggatttgaacaaattcagaaaacattgaaatagtattacatgaactgttcctattctaaagtaagattaatttaggaagtagtagctcttagttctttattacctagtttaaattttaaaagaaagcatttatacttaagaataaaatttctaaaccctttccttgtattgagttgtatgtgtgttagtgtatgagattgctgagtttattgtactgagtcggcttcattgtatgacagatctaaaaaaactgggagagttctgcctaatactgcaaaaccagagtaaagttaggaaattgggctaatgtttaattaagtcaatcactggccttacttttgtgcttcatttgctcaattacacttatggtaaatttctttctcgaactgatggagaaaagactttgtgatctcatgccgttaaagtacataatcccatatgatattacagtatggagagatgcttttctttttatttataattctcccacattaatgtcatgtctgtctgttctaatttagtgctttgtatttttcattttaaaagtacctggtctgctcctgtgaacatttaggtagatacctcagtttgaggtcctgtgagtctgtgattctattatttgtaaacatgtatgaaaatggaaaagaggttgggcatggtggctcacacctataatcctagcactttgggaggcaggaggattgcttgaagctgagagtttgagagcagcytgggcaacaaagagagacccctgtctctacaaaaaatttaaaaaactagctggacgtggtggtgygcacctgtagtcccagctactcaggaggctgaggtgggaggatcactagaacctgggagttccaggctgcactgagctatgattgtaccaccctgggcaccaaagtgagaccccgtcycaaaaacaaacaaacagaaaaaacagagagggaaaaataaagaaaaatacatatgtataataataggttctcaatatatattagtttctttccctttctactttcgggatgaattcactgcttgttgaaatgtaattgactgatctaaatgctgatgttttaatgaaaagtatataatgtggatttcatttaattctgtcctaaatgacagtttgacgacatacttaacaaatccctaggcaccaaggatttggggttttgttgggaagaaaacatctaggccagaaacgatgtacttttacyttgttttgaatcttttattgtttggatcagacctcgtttaaaaatgtagaggaaaaatttaatagttccatttctacctggaaatactacctagaaatagtattagtctattagtagactaatactccagctgtgggaaaaacaaaaaacaagcaaaacacccaaacctcccccaaaccagaagttttaraaggattaaatttaaaggatttaatcagaatatattaaatttaaaaggaaatatgattgaggcattagaaacttctgaggtagcgaggacttgaagagacctaaatcccagcagtaagagaagtgcactgaggtaggtctaacattttttataccacttttccctttggggcatttgctgagtattcatttgggcagagattaaggcagaggagcctgcaaagtttatgtaatctctggcctgacaacgtaggcagaatttgaggatacaagatcttgaaggaaaaagagaaataaggcttacactctgaagaggctttccccttgaggtatttctctgttggtggtgacgtttttattattattattacgagacagggtctcattgtccaggctggattcgaactcctgggctcaagcaatcctctctcaagtagcttggataactggcatgcaccactattccagatcatttttctgttattagcctttgggaaacaagctcagaagcttagcagaaagcagatcaaaagctcagcagtatagtaagatgtgactatcgattctatgaaacaatactaataatgtctcatgaggcctaatcttgtgctggggggccaaaaattgtatttcagtggttgctaaggaggaggggttttgataatcattccaggctctcagttggaatccttggaagttatgattactaggagagagggtgaactaaagtcttgctaagtctgaaaacctgccttcaatctactcagctcacattgaattggtgttatctgcccatcatctagctgccagccgtaggtacatcttttctggaggaagaaacagaattagcttgtatacaaattttaacacagtatctgatgtgcagtcaaacgtgttattaggcatgtaaggagtcaggatcaagagaaaaaagatctgacagtagaaatagacccataagtgatccagatattggaattatcagtcacagaccttaaaacaattggggaatctacaatgaaaaaaatcaaatggaaattcgaacactgaaaaccacagtaagtaaagtaagaactcagaagattagtttaacagcagctgggacatagttgaagaaaggattcatgaactgaaaaatagattagttgaaaatatccagactggcctatgtggagaaaagaacattaagaataaagggaaaaaatcataaaagatgcattaactgtagtaataaaatctaacatgcgagtaactggattcccaaactgtgatggatttggagctacaatagtgagattcaagattactgtcaatcctaaggaatattaatacttataaaaccacactgggttaccatagtaaaaatgctgaaaactagaaaaataaaaaatcttaaaagtaactggaggagggaacaaaatttaaaagctgtaataagactgatacctgatgacacattagaaaaagttgaatcagaagacaaaggcatgatatctttaatgttgtgaggaaaaataatcactaactctgtattatagccagataaaagtatacttcaaaagtgagagtgaagtaaagacatttccagacgcatacaaattgagataatttagatacaggagatggggttcttcaggcagaaaggaaatgataccagactgaaaagagtaaatgcaggasggaaagaagactaagtaaatatatggccaaatgtaaattaatgctaactatacaaaataatcgtattaatgccttgtggggtttaaaatatatgtgcaattaaaatgcataacgataataactcaaaaggtggaagagtataaaattgtcaaccatgttcaaagatcctttttctggaacaaggtgaagttactaatttatacttataatgaaagagttaatcacaatggaagattattaaatgtcatggatgcccatgcaacctctagggtactaaccaaaagaataagaaagaataaccaacaactttccagagggaaaaatgcaatatcaagatatttgattaatgtaaaggaaggaagaaaggagggaaaagaagtaacatatgggctgaatctgttcttaaattagattatggtgatggttcatagctgtgtaactataccaaaaagcattgaaattgtgtaccttaaataaatgaactttatgatatgtaaattatatttccataaagctakataaagagaacatgagaccaatataatacaaataatatgaaaatatgataaatataactaataaatataaactcatattttaagaataaaactaaatgttaattgactaaatacttcaatcaaaattcatggattgtcagattttattaactgcaattgtatgctgctcaccagagatatactttaagactgtcttacagaaagagtaaaagctataggatggtaaagttgtatgtgtggtaaagttgaatctaaagaaagctggtataactatgttaatatctgagaaaagggctgggcgctgtggctcatgcctgtaatcccagtactttgggaggtgagtggatcccttgaggtcaggagttcaagactagcctgaccaacgtggggaaactctgtctctgctaaaaatacaaaaaattagccaagcatggtggtgtgtgcctgcaatcccagctactcgggaggctgaggcaggagaatagcttcaatccaggaggcagaggttgcagtgagctgagatcgcaccactgtactccagcctgggtgacaaaagtaagactctgtctcaaaaaaaaaaaaaaaaaaaaaaaaaaatatatatatatatatatatatatatatatatatctctgacctctgagaaagaatttagggcagaaagtattgcgagaaatcaagatggacatttccctatgttaaaaaaagtcagtttataagaaaaataaaataattctgaatttacatgaatctaatgatatagctttcaagcttataaaaacaaaaattgacaaaattatcaggagatctcaatcaacaatcaatgtataagaccatccttctcacagtattacaataatcaggcaaataaatgaatgaggatatagaaatctgaacagtatgattaattaacatatgtattgacatttatagaacacagcaccatatgctgagaaagtacacatttgtttcaagtgcagatggagcatttaccaaaattgattatggaggaagtataagcaaatttcaaaggtttgaaataagagtgtattcctttctcatcacataattcagtaagaaataagtaacaaaaggaattgcaaatccataagcctatgaatcaacgagttaatcaaaatggcaaattataagatattttaaattggataatagtggaaaacatggatacagttaaaactgtggatacagttaaaactgattagaggaagttattcggccctaaatacataagaagaactgaataatcagttatctaaatatctcaagaagacaaaaagaaaatattaaacctggaaaatgtagaaagaagaaattatgaagtagaatttatgtagaaagcagaatttatgaagtagaaagaaatataaatcattcaagccaatagctggatttttgaaatgactaattgatgagcccttggaaagactgaatacgaaaaagagagaatataaaattaacaatattagaaatgaaaataggaaatcactgcagaacctccaaacaatgaaaagataataagagaatactgtgactagctttgttccaaagaaattaaaacattctagaaacaatatagtgttagcgaaatacagtttaccaaccctaacactagaagtgggaaatatcaactgtcttatatttattaaatgaaatgaatttataattaaagccttctcacaaagaagtccaggcccagatggcctcactggttaattccaccaaacatataaggaaacaataataccaatcttaaactctttcataatacttcccaactgattttatgaggccaacataaccctgatcctaaactatgacaaagaccatgcaaaaaaaaaaaaaaaaaaaaaaaggtatagactaatatttatcagggactgtaggtgtagaaatcctccacaaaatattaaaatattgggaaatccatcccattgacatatcaactcaatagcctattacaaccaagttgggattcaaaaccaattattgtcacttaccttattaagataaaaaaatatttattttaacagatactataaaacatttttaaatattaaacacctattcattgtaatattagtaagtcggcatgtaagaaaagttacttaaactgatagaaattatctatcaaatgcaaaactggtgaaatattgaattctttcaaggcagtgttgaataaagttggggaaagtggatacttttggaattaaaaatgagcttggcaaagtcacagctcactataaaaattcagttatatcagttatatttttatattctagtaaaaagcaattacaaaataaaaataagtgatttcacttatattagtataatgaaacaacacatacctaggaataactctaatamaagrtgtgtaaacctttacacagaaaattgagaaacattttgagaaaaataaagatgaccttaaaaaaaggataaatataccatgttcatatattgggaggctcaatattacaaagatgacagttctcttccaattgatcaggtagatcaatgcaatctcaatcaaaatcccagcaggttttcttttagtgtgcatgaaagttggaaaagccagttctaaatgaagaagagcaagattatcaaatacaactttgaagaaaagaacaaggttagagtctttgactcctggatatcaagacttattttaatgttacaataagaccgttgggtattaggacaaagacagaaaaatagagcaggatagagttcataagtagatctgtacatttgtgtcttgatgcattagtaagtgacaatgcagtgctaatggggaaaagatttattttttaataaatggtcatttggataggtatacaagggtgggtgaggagacaactcttaactccctccctaccatcttacataaaaaatcaataccaggtatgtcgcaactttcatgggaaaggcaaaataatgaactttctagaaaatttagtagctttagtagcttcgtgtcattttattttgttgttgaagatttgcgtgtgatacatttatatgtcatttgttttctagtatgtaaaatgcagataataagattacatgtaaaatgtatggctcaaagcctgccacatggtaactgctttaacttaacagaattatccatcttaaacagtaaaataaagttaatcaatttgaaagaagcaagcaaactttttttaaaaaagtttatggaatagttcatgtttatgtgccctaaatttgtaattaaaatatgaatgcacgagatgggtggatcacttgaggtcaggagttcgagatcagcctggccaacatggtgaaacaccatctctactaaaaatacaaaaattagccgggtgtggtggcgggcacctgtaatcccagctatccaggaaactgagacaggagaatcgcttgaacccaggaggcggaggttacagtgagccgagatttcaccactgcattccagcctgggtgacagagtgagactccgtctcaagaaaaaaaaaaaaaaaaaaaagaatgcaaaaatagagatgtcatttgaattatctgactttcatatagtgatataatttaaaaataattacttttatattagattcttatgtcctctctgctaaatcaagttggtgtttaaataactgttgtttcttttaagggaaattttgtttttattttgaaattttgaaatgaaattgctctttttattagtgttaatatgatagatatttaatgtaatttcctgcagatattaaaatagtcattttctttaataaaatccacatatatttttaaaattccacatacttgattcaagtttttggaaaaaatgttcctttgtcttatatgttttatgggtttgtaattgcgtaaattctaaaattggttaagtttactgtgaattttatatttccttgtcttgattagctccatttgaatcattctccttttcaccgtttgcaggaatttaaatgattcttgtcaacaagaacaagagacgtgtcatgaaatcgttctgcattgcttatgcataattacaactttattgtatgttagtcagtcttttaaccctgtggaccatttgtcttgtcttgtgtgtctagctgataattcactcccagcaatgctgttgctaagcttttctttgggtatttggatattctgtttgttacattattgctcctaattcttgcgccttgaagaactgtgtcttttgtaatatagaacattaaagagctcctgttactatcattagtaactatgactcttgattataaattctttcttctgaaaaaatcccataactttatctttgcactgatgggagtgtgtgtgtgtgtgtgtgtatgcatgtgtgaatgtctgacatgcagaagtgaacctgataatggcaaaatacaatgtctttgataatcgttgatagcactaaaaatatgcactaaatatgcactaaaatagcaccaaaaatatggcatattctattttcctgataaatattaaaaggaagtcatttaatttttttagatttttttggggaagagaataaatataaaaattcgcccttttagaggtagaaaagtgcacaattgcactgtgctggacatgccttttttgcttctgtttgccccaggatctaaaggaatggattcatcactccgataagttaatgtttaaaaggagatcttcagctttatctaacaagaaaatatcttgaaaaatgtatagtgaaaatcaggcctttctgttcagtcaagtgtttttcttaaataacaacagtgtgtttgtaaaatgcaaaggaggaagtaagtttagaacagatttttctgaaaactaagtaaattacaaaagaaggcaaaatgctctgttacaagtaacctattggatttcattagggcttcataaaattctgcctgtttatttaggctcatattttaaatatcactttataacatttttgaaataatcactctgtatgttgctttttatgcatattgcttcccaaaagcttgcttgccagagcattggagattcctagctaatagcccaagatttctgcctaagtagcattagcttcttacctaattaatgagttttctaaggaaaaaaaattacaaataaactttcatacatgaagggtgtgaagcaagccacaattcccacaggacaccaattatacattctatagatgggaggtgagttaaggaaacttacctttgagattgagtatgtctctcaatgttgaaattttttattctgatttatttgcaaggaatcctagggcgttgtagagacagtctttgttgacatatggcttttttgtttgttctgtttacagtgtgggtatgattatagtcacttaagttttaaagagccacataatgattaagagactaacattcacttataaatacaactttaaaaaataatttgattcccacataacttcagaactatttgttaaggcatgcctttatattgtgaaattgtatgaaatgctagaaagattagagtaagagaaattttactttaagtgtcatgagagaaactgtagttagacactatgtctctaaattgatctttttaattaaatcagtttttataattagaggagagtagtagttcttaaatcagaaggcctattacgtttgagaattagagaaatgttcatgtttgcttttaaataaattggattatcattattttatgtacctggtgcatttccagcctaatgtctttttgagttctgattgctaaattaactgaattctttttgtttggtgagattaaatgttgttaatgaaaaacttgaatacaattttttawgctttagaattggaagtagattgtggtkcaaggaccaaattgatatcaattcatttaaatgacagtaattgaaacattgctaggtatttgtttgtttgttatttattttggctttttctttccacagcaagttgatgtggaaaaatgggtatgtgtttccatgtatttgcaaagaaattgtgatctaaaagtgcatgcttgctctcgcctctaatctttcattttgcttcctagtgtggcttgtactattagtgttcaaactaactgcttcgttgtaatgaacacatgttttacaggtctctaatgagaaccttatgtttctggttttgcttcatctgaaatggggcatattaaagtactttccatccctagaaccacatagtttttatataatttattttgtaattattatgtgcttctggccaacagaaaggtgtttattattcatactgtctgtatatcttctgcaaaaaaaaacaaaaaacaaaaaccttgactgtttaatctcaaaattccactgcttagtccttatatttctgcatgtactgtagaagaagacaattatatatatagtcatagaaagtcatagaacctttttttttttttggtatagatggagtctcactatgttgcccaggctggtcttgaactcctggactcaagtgatccttctgcctcagcctcccaaagtgctgggattacacacaggagccactatgcccagccttatataatctgaagcagtgaaggtgaatgaccatgtagaaaaacgcagttacaggattctggaggctaattcttagagcccacattgtcacaagttgtgcaaaaagttacattgcttcttttggtctcggtttccttatctgttaggaaaaaataaaggagagaggaaatacaccaaggtaccttccaatacttaacacaccaggattctgaatggaaattaaagtctcctcaagactgatattcctactccactttctcccaagagtgcaaaacagtgaggcttttcattrttgaaatgtttttgtatttgctctgtgacttatatgaagaatcctttaagattgacttaactgatggctttattttatcttcattatttttctggttttaggatccaactttcttgatgcaatattttgagaattttgccatcttttcagtgccctttcagtagtgttttccaacaatttcatgttctcttgtctttttttttaaattttttttagccctttaaagacaaggaaacttgttttttaatttaccatttctgatgacctttgaaaactatgacttgtatgttatattgctgagaataatttgaagtcttcatttctctttataaccgaactactactacttttgaccaactatttgtttttgaaatttcctaccttcctctttggctatagttaaaatgctgatccaagattcacatttttcttgtcttggtaagggaagcctgcttccttctcagaacacgtatgacacctctttgtcctgcacttccctaatatcagcatcctacaacatagccctctgtcttttcccatccttgcatcccttcacttccattacactatttctgtgccatatctggattggtattgaccaaccactcaagctgcttttacttactttgtaaatagcacttgccagtaaataaaatcaccttttcaccattgtctaaaagtcttcccttcagttcctctgtggatttggttacttttgatctgcctgtgtaatttttttctttcttattcctataataatttatttttatttgtattaagtttatttgtaaatcattgcagtagagattgccttctagttctaaggaaatatctctgatattttctgagctaaaaaccttgaggcttagtttgccaagtgactggctttataatcttatgtagcctctttattggccgtaatctctttgtctgtaggactagaatctgctttactccttttttcttaagtattactatcatgtcagtgctaaaacatattgatgccaaaatacatgttcatttggaagtcatataataaaaagattctgctgggttttagaacackgatgatcactatgtgtaaatgttgcagcaaattttagattggagctctttttttctttgaagacctatccagttcatgtcttatgctttggccattagaagtttgaaattctactgttacaggtagactttgaaggccaacagaaagtaatttaaccctctacccacctaacccaggactattgagactcctctgtggggctggtacttctctgccccttgagttaaattagaaccggtcccttgacctttctcgtattccaagagtgaaataccccacagacatttcaagtcatacagatctcatttcagtaattaaaatgcccaaatctgtataataggtgaacttgaagctaattcaagttaacttgtcaggaatcgagctggagggacggatatctgggaagctgtttcttgcttgccccgccgggttcctcacgccctacttggtacctggagagtctgccactctcaggtgctgtgggaaggagacagaagagaaagcttggcaggaaaggtctgctttgatcatagtgtcatgcactgggcttgccaggtttctaatgctgactttctctgtgggcgcttggcattggtctttcggggagcttctatccccagaaaactctgacctgagcttctcttgctgcagacaaatgcgtgtccactagctggtcagtggcaattccttactcttcctgggagttcttggtggcctctgagacaatcccaagctggatctgtctagtatggcccccatttgcttgttggcagtgtggtcacttcccagttgcagccctgtaggactacacccagccttttgcctctcaatctccaggcatagtaagacaccagtctacagtgtcccagctcccagggatatcaggtatccctgaagcyacccttgctaggcttgaagtgagggcaagcttgggaggcaggcaggattccaggcccacctgcacttctctccaagaaaccatttctttgctgcctggcctctaataatacactgggggtgggcagtcagctaagggcagccagtggatttgcagccaccctctttgacatccctgcttaggtggcataacaatatgttttgggacgtgatagtacaggtgctcctccagttagggtgaggttatatcctgaaaagcccttcagaagttgaaaatatcgtaagccaaaaatgcatgtaatacacctaacctacagaacattatagcttagcttagcctcccttaaacgggctsagaacacttacattagcttacagtggggcaacatcatctaacacaaagcctattttatactaaagtgttgaatatctcatgtaatttattgaatactatactgaaagtaaaaaatacaatgattgtatgggtaatcaaaatacagttcctgctgaatgcaaatcactttcacattgtcgtacagttgaaaaatcataaatagaaccattgttaagtcagggaccttcttgtaaatccccttcggagactggtcattgttttgttttgggacagtgacctgttttaacttctgttatacttgcttgtctagggtgcgtttaccaccaccagattaagacctttgggagccttacaaacttaaatatatatgaaaattaaaatggcttctgtataaatcttctgataacattattctggatagtttcatcaaaggtccatcaatcactttctctttctttctcctttctccctcccctctccatccccttttccctaattcccttcctgccttcatctccttccttctctccatcatcactgtctctttgagcagctgtgcatctgtttaatcacaagcccactgagttatcaaatgctgctctttacactttaaaagagaataaaactcctgagtactggataagaaagtaactaatggtcatttccatctactccactcctagcccttttctaacctataccattggtttccaatgtggaggcctaggaatcaggtcatgagtggggtgaagaaagcaaaaggatgaaatagactgtgagattgttgtctatgaagcattgtctatagactgagtgatgtcttacacatgtattttctcttaaaaaatatgatgatgctgttgtaattgttaaaatccataatcatttcaaatgtttctacctggagagttgtttaaaaatgcattttaacacacgactgctattatgtgagaacctgcgaaatgctttcaagctatcaaggttcattcatgtttgaaatggtttttaaaaatatatggagtcttctgtattctgacatgggcaattttttatgtgtaggtgatgatctgaatagagggcaggctttrtatgtcttcargacatcagtatccatttgccctctgtagaaatcaatgtgttgcttttgatttagagaaattctctatcgagacaagctgggaaatgaagaaagccctrgatacctcttctatttcatgttttaggcatttatgcagctctttgctttataaacctgtcacagagataaagtgtgagaacttatagtagcttatcggaatcatttatttttctttacccttctaaagaagaactacataattgtatgtacatatatatgtcaaatttattatactcgaaagagaagacattccatttaactactgtctgtacagagctgtttataggttgaaaaagaacttgctacaaatctgccgaaaaatagaatgaattctttttaaacatatctgcatctcacataactagattccagtgatggtcattaatatgagtgacacaagggcatttcaatagaatgtattattatgtgtataattgctcattcatggactggtggacaagcctctttcagatgatttctgtacctgtaatcaatatgtctgtcttttcagagcatcttggacatttttagcaggggaatcctggaaagtgaagcatttccataggatttatatagatattttttaagacagggtcttgctctgtcacccaagctggagcgtggctcaagtgatagtcccacctcagcctcctgagtagctgggactacaggcatgtgccaccatgcctggctaactttttaattttttgtagagacagtgtctcactatggtgcccaagctagtcttgcactcctgggctcaagcagatactcctgccctggcctcccaaagtgctgggattacaggcatgagccactgcacccagacacatattttcatcataagagcgatagttgaagcttttcaacctcatatgctattaggtagtatatattgatatttggaactcagaattgttgttaatttttttattctaaaaattattgggactatcattaattaactatagctacctagaaatcctagtctttggtggtgaaatcactttgttttctcaacataatgaagtttacctgatatttcctcacaaaggagaggttaccggttggagacttatggagaatcctagcatcttgatacgtggagaggaaaagatggcgaaaaggcttaaatttgatgtatattttgtgtacagagtagggtattttgcctccttaatggaaacttcacgctagaatgacttctgaggctattctgaaattgttgcatttgataatcctttttaatggcaagcctccaaatgtatggtgctttgtcactaaatccttatctatataatttttgaggagacatttcaataacagtttcttttaaaagttctaaggtaggtttttagaagcgttcctttttaaaaatcagtttttagctcatgaaactgaaataccagttttaaaaagtcaaggttgaactgaaaggcatcattataatagaggagctttgctacattacctgaattattgtttccttctttgcaccaagaacagattaaatatgcattctcttgatatccagtatttgttagcaattttcagagtaaagtattgctatttgatttgtttttctattcataatcatttgcatttgctaagagagtgccttaggtcttttagatctactacactgagtggctcatgcttacagacgaaagatgattctgcttctttttgtcatccatttgacacccagggccgtctatgtgttaaaatgtagcaatagcaatttctcttcctggcttccatgttaatgtrgcatgtgcccccaggttttgcttgtatttggagctccatctgatgtgtcaattccggattaatctaaacctgggacactgagttactgacatctgcagttttagcctaaagaactaaaatttccacctttgtgtttctatgcaaattaatcatcatccaaaaaattctaagacagcacgttggaatccatgctgcgtgcctgtcctataattgcccatatagtcatcccttactctattttgtgtaatgaaattttagctcttgtctattgaacttctcattagtgaaataaatcaaatagttaatttatttgctaaacttattgtaagcacaaaaacgacattctccacacccaaagaggctgctttcttcaatatttatctttatgtgtttcttttttctactttccatcatatcaatttttaaagggtttttgttgttattctttttctgtttgttgcttttatcatacagaagcagtgcttacattgaattaaactaatatactcatcttttttgttttaatgcgctttgctttcttcttttcccttaaacgatccctttgaatgtctcctgatgctataattttggtaatatctagcacttaaaccaatttgaacaagaaatggtttgtacagaaagttattgtcaataatgccactaataccacaaatctttcatgttcttgattatcttttgaaagtgatgtttgtgtcttacatctgctcttctttctcattctgcagaaggatatttcagcatttgctatttttcagtattcattctattttgtcgtgtatgcagattgctctcctctgtgtattattcttcctacagtcagacatgacttagcaatgccgaatagcagacctcggtcacttggctgaccactcttttttttgttaatacctactacatttttaaagtggttcaacttagatacctgacaaaatcaggctgagaaaattgtctgaaggaaaatctcccaaacctagcttaattaaaaaaaaaaaaatctcatgaagaaagtatctcttcacaaaccatgtgctgtaccaaaatgttaggtttttgtgtttctttgaattaaggcttaataatgattttgcctaattctttagtgatatctctaccattagtgagtcacatgtgattggtcagtttaacatggaaagtaagtttcctgatattatgtatgattaatatcagttataaaaaggtaactaaacagcctgtattttctaagccaaggatgaaagcttctttacaatttttccttgaaattgtaatattgaaaatgaaaaaattagtctcaacagaatttccctttaataatatacatattactatgtaaatatgtttcagggaaaaattgtaatatttacaaatatatatattggaaaacttttccttgctgtttttcttacaactagtgtctctatggtatcttttctccataggacttagacatcaacctgacaacaaattcagccctaagtttggaaatatatcattgttttctttttcatactctttcatctgtgtaactctcctaggaataagtagtcaaagaaactttagaggtgtaaagaaaaatgaagttatttgtaaatttgcatatgcacacacatacgtacacattatgttttgtagaagaaaaaagagctattatataatttatgaaaggagactgtgtcattttaagagaaaaagaaatgtttttgtgatttttctgtgaaattcacctttcacaatattcagtgtctaagaaattgcttactgttattttgcatgaaacgagagccgctcattgcagcatattagtttacgatctaccttacctgttttaatctactgtttttattaaaatgagttgggttgctgtttgtttttatcactgcatttttatgcaaaagatgcaagttggttttttaaaaagcatttgcagaggatcaatttttaagatgataccttttttggtgcttaaataggttgtcaatggaatcactgaaagtagagcagcatgttttcacagaaaaaggaagaaactaacgtcaaaacatttttaaagagttttgcttgctacggcttttctctagcatgtagttgatactaagttttgttgcgataacatggtgaatgtttttttttatgtttattgtttacatagctccatttaggataacggagtctttataaataagagatatttttaaggaagtctttgagatcgtgtctatttaatgtttcctctcttttccttatgcccctacagaaattcatgatgaaggtaagacatcttaatatatatgctatgtatatatatagcagatatattactatatatggattatatatgtatgtatctgcatattagtatagctgtattatatatatgacagatatatatattactatatatcagctatatatatgtggtactttgtatgttttctgtatggttatacacatttrttttacttttgaatccatgtaacttttcttcacatgcttttaaaaggtttttaaaaatcaagctttggagcttttaaatttagataaatcacgtttagatttaacaactcaacaaacaacatttgacatttttgggtcatattgtaacwttatatttaattagctaacattaagaatttctcttattaaaacaattttagtagctctccatttagaatattcactctggggattatgttgactttgcatttatgcccttttgcatgaatacaatgggaaattcttccactgggaaattaggggaggcaccaagaaactacttctacttactccaggagaagtgaaaataattcagccagccccttattcatttctcaactaaattggaaaagtgaaaatattgtaaaagtagacaaatgaaaagagtaaagcatgtggacatgtcatcgaaggaatatgtaagggacagacaggaagagtagactatggttattttaggatatataatagaaaatttttgtttcatttttgtatgcccactacctttctcctataacatttatggggtttaatttttttatcttaaaagccaagaaacaatgggtaggtagaaaaattgattgatattccattaataaaggcttaaaagaatttatgattttgaaagaaagagactgtgagaaatattaaatcaaaattccagatatagatggaaaagattgctttgaagaaaaggaagcgcgttcttgtcagtctgttgaattttgtggttaaatccatcatgtttaataaaactgaaccaggtgcattgtgggacaccctaacctggacctgttcactaccagtgcgaattcggcgttttggatgggatgacagaacagagtatttctttgaagccatctatcaaccaggacgtggaacatcttccagaatttcaaataactctagctcttatttttcagtagaaaatattatgatcacattttgaagagaggacgttaatccctaaattagacgtatcatgaaacaagagtttgggttggaaaaatatttaaaacaacagcaaaataggaatatttcctctctttgcaaatactgataacttatgatttggggtttgagaaaatttagtttttcctgctaaatctgcatttgctgtattcattttatcatctcattcttaattcaactgtacaatattgtatggacttccccttgggaagggtgaatgaaatggtcgcctgaaacagacatctgaaggtctcttgtgagaacaaatgcatataaaaaccagtgcaaatagaaagatgatgtagaattagttaaaagcaggtggtatgcctaaaataatttaattaggcccccagttcttttaacttcgaggccagaaggccaatagttattttcacacttgcaatggatgatctggaaaggttagaattggattaaggggagggcatatgcatgcaattacagtaatttaagtcacgtaaacagaaaaacatgctgaattttatctcgctttcacctttcaatcatcatgctttgctttgggtttcatacggaaaaggcattaacttcttagaaccagatggatgctttcttgttgtgggagcctatttctgctggttggtgctaaacagtgatgcattaggactgtcctaagcctgatctgttccctgaggagactttccatgaagacaccatcccaagtaagccagtccatgtcaaatggatgtcttgacaatgttaaactggcctttgcaggcacctttatcttcaactgaggccaggattctcatggattgttacagtccttcggtgaccctgttgtgtgattcactacttattttattttttaagagacagggttttgctctgttgcccaggctggagtacagtggcatgaacatagctcactgcaacctggaactcctgggctccagtgatcttctgggctcagcctcctaggtagttgggattacaagcatgaggcactttgccttgctctgggccaactgtatttaaaaaacacagagccaaaaaacaaaaaaagcaaaccagaaagaacaaaatatagagccagtaattttaatgtgtgtgtaaacctctttagtcacacacacacacacacacacacacacacacacactgtatatatatatatatgaaatgtgtaggccaagctttacggtaaaaggagcactttctggttaacttcaagaccttgtccttcacttttaaaacattttgttttgactagtgtggctgtcaagtgttattaaagttcacgtggattttatagctttggaacataaatctggtatgaaaaggtgagcttctatcaaagtaattcaaaccagacaaagtaaataaaattgttcttggccacaataaatcaaatgcattatagaaaaaaaagtgctctctaaagacagcctcattctctgaaggagtatagtttttcaaagtagatttttcccttttcttctcagttatgtgaaaaaagtgactgttttgttttgtttttgtttttttgtttgtttttgttttcgagayagaatctcgctctgttgcccaggctggagtgcagcggtgtgacctcggctcactgcaacctctgcctcccgggttcaagccattcttctgtctcagcctcctgaaagtagctgggattacaggcgcccgccaccatgcccagctaatttttgtatttttgtattttagtttcacagtgttggccaggctggtcttgaactcctgacctcacwcgatccaccygtcttggtctcccaaagttctgggattacaagmgtgagccactgcgtcyggccccccaaaaaaagtggtttttcagcagtttttcttattttaataccttttaatatctgtttttagaatagttctgagttttttcaaacaaaacataaagttattttgagaaactatatggaacaacaagaatgtgatatttgtttartaaaaaggttgtaataatattggatattaaagyayctttctgtacttcttaaggcayaggtcagtatcatcactcttattctgaaaatttttaaagacctccttttcctgcaaaaagaattacaaacttctcgtcataatattttgtaccttccatggtctttccctgatctaattttataattcctgtgaagtttttctgtgcaacccaacactaaaattccatgattgcttcctccttcttacacaccttgtgattatataccatgacccctttatacatactccttactcagcctgaagtgagcttccccatatccagtttttcatttgacagttgtttactgagtacttaccatggcctgacctcacgctcatagctggaggtgaaatgataatcaggacagcgtcattgtccttcaggagttttcagtctgatcaaggggaggagggttcttgtgtagagtgtaaggccaatgtacatgtgtatacctagggctgcaggaggatggggagagtgagtagctttgaggaaactggatgaggcttcatagagaaggtagtctttaatcagagttttaaaaagtagagggagaaaaaaatctgagtataaatggggctgtgcaattcaaacctgtgtcgttaaagagtcacatgtacataaaatatgtaaaagtttcattccattcttataaaaactttattaaattataacatcaatacatatttattctatacagtttggaagttacagaagaaaaatccttcaattacactaatagaaaaaaactactggaggctttcctattaaaaaggctttataaggcagggaagactagagagagggaatgttgtattccgagatggggcagcatgaaagcagtatggcatattcagggaagggaaagtgggtatgtttggagcacaggatgattgaagatgaggctagagatgagtgagacaaatgtctctctgtgcttctcaaagtagtctctggaccaacggcatcagcatcacctggaaaattattgaaatgaaacttctctgtgtctaccccagacctactgaatcaaaatcccagtggtaagggccaggaatctgtgtttttacaagctctccaatttaagaagcactcttctatttcatggaaagggattgattggactcttccctataagcaattgggaggaatgagaagtttttaagcctggaggcattatgatcaattttgtgttctaggaatactcattcgttgaatcaacgtttatttatttatttatttatttatttatttatttatttattaagatagagtcctgctctgttgcccaggctggagtgcaatggtgcaatctcagctcactgcaacctccacctcccgggttcaagcagttatcctgcctcagcctcccgagtagctgggattacaggcaggcatcaccacgcccagctaatctttgtagttttactagagatggggttttgccatgttggccaggttggtctcgaactcctgacctcaggtaatcgcccgcctcggcctcccaaagtgctgggattacaggcatgagccaccacgcctggcctgaatcaacatttatttagtgcctcttgtatgttccgcatgcaggtaggcacctggaatacaatggtgactaaggtaccatggttcccacccagtggaaaccataatataatgggaaagagattattattaagtacattatgagtaaataactataattatgataattatttactgataccaagtttatttttcaagaactagataaaatgctaatcccataatagaggttacattaactttactccaatgtatacattatttcaacagcactttgcttgtctgcaagagctcttaatacattctttcctactaacgttcctttgagagcaagagagtattttatcaacttggttaagttactcttttgtgtttttctctcttgttctccttttttctcttctctctaaagactgctcaaggtggtggtcatcgaacactcctctacggacatgccatattgctgcgccattcctatagtggcatggtgagtaggcatttgatttcatctccctgtggtcatgctgatccatttgggggtacatggtctgcaaatgctggtagcatcatttctgcaatggtattaatgagcttggatgtttgtgttctttcatatctttgtacccttgttagtttctcatgtaaaagatgaaagtcagctcagatgacttttaaggtcctttaattctatcattatatgattaccatcttcagtatcttacttttgatagagtagttttaggaggagagaggtgtaagagtcaaataagagatattttcttttctgattttgttttgaagagttcatttattagagaaataaggtatctttattgaaagatcagatttaagaaaatctacctgtgagctccaatattaattgtactcaccaacttctttttcttcttcaccaggtttctcttttaccacatctgctcctcctttcacccagttattcactaggcttctcttgggcacagttttcttattctttgcctcatgtatatatgcacatatatatgtgtatatatgtaaatgttttaaatatatattttataaatactttaatgtattcttagctattacatatacagctgacccttgaacaacacaggagttaggggtgccaatctccttcacagtaggaagtcacatataacttttgattccctcaaaagataactattaatatccccctgttgaccagaagccttaccaataccagtcaacacatattttttgtatgtattatatactgtattataataaagtaagctagagaaaaaatattaagaatatcgaaagaaaaaaatattttctacacataaagtggaaatggatcatcataaagattttcattctcattgtcttcgtgtcaaataggctaaggaggaggaagaggaggaactggttttgctgtctcaggaatggtagagggggaagaacatcttagtaagtgggcccgtgcagttgaaacctgtgttgttcaagggtcaactgtatataaaatatgtwaaaaatatgcaaaagtttcattccatttttttttttttttttgagacggagtctggttctgttgcccaggctggagtgcagtggcgcgatctcggctcactgcaagctccgcctcccaggttcacgccattctcctgcctcagcctcctgagtagctgggactacaggtgcccgccaccacacccagctaattttttgtatttttaatagagacagggtttcaccgtgttagccaggatggtctcgatctcctgacctggtgatccgcctgcctcggccttccggagtgctgggattacaggcatgagccaccgcgcccggcctcattccattcttataagagctttattaaattataaaagcaatacatattctatacgatttggaagttgcagaagaaaaattctgatcacactaataggaaaaaactgttggaggcttttaaaaaaagttttaatctcttctgtccttaaggctttttttttttaaacataattgagatgttactacgttaccaaatttatatcattttgttttttgagatagggtcttgctgtcacccaggctgaggtgcagtggtatgatcatggctaactatagccttgaactccgggactcaagtgattctcttgcttcaacctcctgtgtagctaggactacaggtgtgtgctaccacgcctggctaatttttaaatttattgtagagatgggagtctcaccatctttcctaagctggtcttgagctcccaggctgaaacgatcctctcgccttggcctcccaaagtcctgggattacaggcatgagccaccatgcccggcatgattttcttttccttttcttgtaacataagcattttccatgttgtttatattgtcaacataattttagtggcaacatgatagttcaatatctagaatattatacaatatctgtaataatatacttgatcattccttttaaaaagtagatgattcctgtattatgtaaattgttctaaagcagaagactacgtatcaataacactatccaactggattaagaaaatgtggcacatatacgccatggaatactatgcagccatgaaaaaggatgagtttatgtcctttgtagggacatggatgaagctggaaaccatcattctcagcaaactatcgcaaggacaaaaaaccaaacactgcatgttctcactcataggtgggaattgaacagtgagaacacttggacacaggaaggggaacatcacacaccggggcctgtcgtggggtggggagagatgggagggatagcattaggagatatacctaatgtgaatgacaagttaatgggtgcagcacaccaacatggcacatggcacatgtatacgtatgtaacaaacctgcacattgggcacatgtaccctagaacttaaagtataataaaaaataaaaataaaaaataccactatccaacaagggcacacaaattttcaatctcaatcatggatatttatgtgataatttgattttaattgtctatttaatgaaattcaaaagtataggatgagaagtataggaaatacatggacgtgattttaatgatgatttaataatatcatttcttttaatgtgttacatcacatgaataggtcagataagaaaacttgtgatcatgttagcaagtgctggaaaaggtttttaataaaattcaatgctcattcttaatgaaaactaaacattgattaattcctcagtgataaagattatcagtgtcagatcaatagtgaatattgtaattgtgaaatgctgaagccattttttaaatcaaattaactaaaataagaatatgttttatctaccattgctaactaacattgttctggaaattttggctgacatgtcaagatataaaacaacataaaacagtttcataaagtggttggatgtaagaaaaatatgtaaaaacaatttgtatagagcaatcacatattaaaatttaatgaaaacaattccacattctacagcaatcaaaacacatgaactgcatgagctaataaatgtgagggtttcttttaagacaactactctctatacataatagttgggttaagagcctcaacttggttgttagatttggattcagtctgtttgccacatgctggacagcctgggatattttgcataatcaagcctgtaattacacctgaaatttttatacattcattaaataaatattatttggcatctactatgtgctaggtactgttttaggtcctggatatagtagtgaataagaccaagttcttgctctctttaattaacacttagtagaataatcatagtatctacctcagagttactagaaacattaaggagaaagcatatgttaatagttataggtacagtgcctaatactgtacttgttattgaaaaaattacaaaagactttaataggaatcacttcatgtttgtctgggaagtctgattattgcaaagttgttacctttttaaaaaataaaggcagatgttaagcacaatttatatttaaagtctrtaaacataggggattatcgtgggctacctgtcttgaggtcagactgacatttctgctgtggctaaaaacaagtttagggaccctgggagcctcttggctataaccttgggagccattkctttgtagttaagagtcagaatcagaatctgcaggtcaatttgatttcacatccccatggcactgaattccacctaacataccagcatatctgccaccgattggttcatctgccttctcacactcacagacacacacctagctggatgggccctgtaccataataagacatttctagcctttgcattatttttccagtgattctaaagggggcttgctggcagtgcacttgcttcgtgatggtagtgtacttcgagttcctaccacattcgtctttgtatctctgttcttacaacacattcatctttgtgtctctgttcttacaacactttgtggcatgggggttggggagcagtaggcttgaaaaatgatcctaaactttatgtccaagaatatacagttaggaacacgtaagggtgggaagaataaggagatgatggtgttgcaagagtgattactcctgtggaaatgcacgtgtatgtagacacacaataaacctcattttagtgcagtgacatgctgtgcaccaaaataaattctaggtggatttcaaagagttaaacatttttaaatggaaacaaaactagaagataaaagagaatagtcttcaaatttgtttgggagaaagatttctaactgtcagactacattgtacttttgcagatgatcatgaatatcacatgaagtgagagatgtacaaatacatccccagttacttgtcttcctgtactgacagagaacatttcctttgtcttttataagggaagaaaagactacaattcctttaggatattgcccctaatgcatgctgttctgcctcacagacatttaaaaatctgggctttgtgcagaagcatccagattttcaggaaaacagtgagaacagtagggatagatggatgccaaattacaggtcagaataagactctgctggtacaactataaaccttaacgatggctggtcactgtggctcatgcctataatccyggcaccttgggaagtggaggtgggagattgcttgagtttaggagtttgagatcaccttgggcaacatagggagatctcatctctatggaaaaaaaaaaaaaattaaccaggtgtagtggtgcacacctgtggtcccagctacttgggaacctgaggtaggaggatcacttgagtctaggagttcaaggccagcctgggcaacatggtgaaaccatatctctacaaaaaagaaaataattagccaggcatggtggcatgtgcctgtagtcccagctgctcaggaggctgaggtgggatgactgcttgagcccaggaggttgaggctgcagtgagctgtgatcacgccactgcacttccagcctgagctacagagcaaccttgtctcaaacacaaacaacagacgaacaaaacctctacttacaactactgattttgtactttgtagtatctgtgctgcctgtccacctcccggtcttcaactgataagctggcttttgatgttggcttgcaagaggacaccacaggtaagcatcttgtgctgcgggaagccaggttcagagagaaccctgcaggggttggattggaagaagccgggaaatacgatacatgggatgaatgttcttatggatggagtcaggaaagaatgttctaatgaaagtttttcctagaaggggaaagtgtatatcattcctcttggttattcccacatcattagttggatgttcaaactaggcttcaaaccttattcttcttgtaggtttggatagaaaattaatatttactacatgatttactgggtgttagccatattaatgtacactaattagtttgtgaagtaattctacatgtctctctcaaaaatgtttttaagtctgaaaatataacatacttgatgccaacattcaaataaaaagataaaaaatgaaagtctccttaatttctctgcccacagggcattattctacatacctgtccaagcagacatgcattttcagatttgtgaaacaaaaatgtatatattaacacttttttttggagaatcaaaataggagaacacaaacttgatgttcttctcaatactctgaggactttgcattgactttatatatccctataaaattggactgttttgtcttttacaatgagcatgcatcactttgtaattaaaaataaagaccaagtagaaaaaagaatggaaggaaatagttcaacttttattaagttgttcccttcaagagtgagatcaagctatcctctcactccactccccctcttaaaagtatttacccatatttactaaatcttttacaaacaacaaaaaggtgaaaacaaagctatgtttaccagcctcataaactttttaatagaccaatgcatcgtcttataaaagaaattccaagaacccctggcaccagaaagataaataaatatattattctgattttgttttgtacaggctctatcattcctctgtatttttgctagttttttagttttcttattctagttaatgtatttcagcacacagttaaatgagaaagttgtcagttctctcttcaaaagaagtaaaagacgcagtctagaatttgttttcatacattgagaagattatgtaatagtcaaaacaaaacaagtcagtgttttctccctgcgtcctgatttccttatgctactctgttttttcccgtagttccctacctcttctgaattcctcaattatttattgtatttattatttgttgtctgcctgccttcatcagaattaaactcacaaggcagatrattttttcttccttcttttttgatgtatcccagcyactaaagcaatggttagccaatagtgggtacactataaatgtttgaatggatgaaaagctacctgcaactgtaaaaatgtgaattggatgaatgaagataaagaattctgccaggtgacattcaggttagattatggtttgtgtaagaaaagcaagttagactatggtttatgtaagaaaaaacacagattacatgttgactgtaagaatacttacaaaatattgcttggtaattcacttattcactcatgcaaaatgaatttgtggtgagggcctatrataggctagcaggagctggagaaacctcagtaaacaaaacataccaagtcccactgttagggacttacattctggcattgaggaattaggaaaaaaaagagttatggaaacaccataaagttgagtgaaggtaaagaatggtaaatgatgacggatatcatgaaaacactcctctgattttgggatagaagttgcatttaggttttcaaaggtattatgaacagaatgaagaatggcatgctgaagcttctatgttaggtattgggaagaaagagtgaagaagagacatgtggctcatgaggcttatgcttgacttgtgctagaagaaattgtttggttgatgtaaaccaagatcttttataattcatttttctttagaaggattctcttatatgttacctttagattaatagaaaacaccacattttaaaataataaagtagaaaggggacaggatagtacaatctttagatgataatactttgcatccttttttgagtcagcatccaaaaataactactgagaacattttcaaaaaattgttacaattgtcacgtcacaaaaccccaagtccttatgaaaattgacaaaaaacaagatgattttatagaaaggaattggacagtataatgacatgtgagtgtgtaaagaatgaaatcagatcagtgtgagtggtgaatttagccttagatgagtataaataaacatcgctttaaagcaattcttagtggaagaaaaagacatcaaccttccctaagtgtcacacccagtttctaggagaagaatcttattttatcctaagctaaggcttaattctttctcttttcatggtgtaagagattaatttgcattaattccggatttctgaaagttgtgtgttgggaatcattggcaaagaaaatagattttaattaagaggaactttttcatgtttcacatatccgtatatctgcaggggaggcttgttggtggaccatacaccctgcctctaagcagcgatcagaaggagaaaaagtacgagttggagatgacctcatcttagttagcgtgtcctctgaaaggtacttggtaagtgtggaaagtaggatcatgtatctgctgatatgctaaatgacaagtcaataaaatgatctctttaaggtttatattgtaaattatctatgaaaattgcttataaccattcctctatctctattagattaattataaataacttcctaaacggaagaataatgtgatgtgggtgcaaatatagcttatcaggttgttcaggcaggcttccctcataaccttgatatgcatgttcatgatattgatagtaccttttaataaattactttattgatagaatgtaaatgcagtctaatcaggaattaaaaattctatggtctttattttgcmcctgatgaaaaggctatattaatgaggttgtgattacctattctgatatttatgaaagcaaattattatgtgaggaacacatgccatgttaagaagggagaaatagacaaaagaagaaatagtttgaagtctatcattgacactgcattgtttcaaagagtaggggctggaaatgggagaatgaaggaagaagtttgtgtttaatcatgaaatgctgtcttagtctgttttcatgctgatgataaagacacacccaaaactgggcaatttacaaaagaaagaggtttgttggacttacagtcatggtggaaggtgaaagacacgtctcatgtggcagcagacaagagacaagagcttgtgcaggggaactcctctttttaaaaccattagatctcatgagacttattcactatcatgagaacatgggaaagacttgacccccattatttaattacctcccaccgggtccctcccacaacatgtgggaattcaagatgagattcgggtggggacacagccgaaccatatcaaatgcattttgaacttttgtggtaaggtcaatatgtatttaatttaacttatttagtaagttgtagttttgccagagagtagtccaatacagaagtttacagtaaattgaaatgaagtaagttgaaatgaagatgtgaaggatgctagagcaaaatattcattttaaggttgaaaggtgactaaataaatataaaatggggcattgtaaactttatatgaatattcacatgaaaaatcccaggcatcacagtgtgtgatgattgaaacaaaaatctgaaatagggcatgtggcaatttagcagataccgggttatagaaagtattttaccactaccataaatcaaaatgtagttcatgtgttactggtttaggattaagtaagtagttgataccccctttgttctataaacatgaaatagggtaagtttggggatgttgtaagtcagttttggtttaccaatacatttaattccagatttgaaacatttctaggaagattggttttgttttgtttcacttgccttgtagaagaggtaatgatgaagacaaggaaatggtataacagtgtctcgtgtaactgacagaaactattaaattaaatggagtgtctgatgttgcgtagctatagggagacctggagcatttttctacttttgtcccttaaccaatgtaggtagaaatagtcaccatgcgaatttctaggacaatacaggtgtgcagattgtaaaataagcattaattaagctcttgctatatgcatgtgctatgtatgttaagatgatgtattttgatcagatatgcattttgaattgtagttgtacctggaaaccaatagcagtagaaataattcatgcacacttttaatatataaattatacacatactttatttagattttgacataactatgaattttttcttgttgttgttgttgttttacaatttgtacttccgctacgtatcagagtttatttgacaggatggcatcattatgcactgaaaaatggaaaattcagacctcacagggccaggacttctaacatctattctacaactaactacctgagaaagtcatctaattctctgaactctggctttctcatctgtaaaaaatgaggttgatgctgataatcatgcatagtgccaaggttattgtgaggaagcaatgagataatggatttaaatatgggcagaattaaaaagcactacacaagtgaaagcaataataatgatgataagtgaggtttacctcctatagaaggaaataaacctcatgattaattaaaatttacaagtgatttccaaactacattttattgttttttttattttattttatttattttttgagacaggatcttgccctgtggcccaggctggagtactgtggccatcatagctcacagaagcctcaacctcctattctccccagtcagcctcccgagtggctgggactacaggcatgagccacaccttgcccagcctgtgctacatagccaattatttatgttctctttcctggtaatcttttatatggagctataagagagcagccaaccaggttgttaaaatttcactttcatttgataatgaagtcgttgcttttattgttgatctctatggacctagcatatagcagaaacaacaggaaaggccaaggacacatcactcatgctttctaacctcaaataattagtggagaaaacaaatcaaacacatacagagctgtatgaggatattgtaagacagtaaatacgcattacagtatagcttagagatgctgaaggacattcctatgggtatagagatggtgaattattattttacattcccaccatggtggatagtagcgggtatatgaagtactatggtgtggattcaaagacttatttggaggactcagtgaaaaggatctagagaaactgaaagatcaagaagtgagttcgtgaaaggactttgggataggcagagggagttgaaataatctatagaataaaccctgaataactaaagttgggctgtgtgtatatatatgcacacttgccttgtagaatacacaaatatatatatatatatatatatatatatatatatatatatatatatatatatatatatatatagtaaatacgaagtctggtgagtatgaacctgggctaatcatgtaacctttagaaaccctcagttccttcatctggagtctggggaataataaagaacttaactcataggggtgttacgggattaaatgctggaatccaacaaggctcgtagttctgtgaatggcacataaaaattatttagtaagttactgtcactatttacttgggagatttgtgcctgttaagaatggttaaagaagttaggcatggtagcttatgcctgtaatcccagcactttgggaggccaaggcgggaggatcactttaggccaggagtttaagaccagcatagccaaaaagcaagaccctgtctctactaaaaaatacaaaaattaggccaggcgcggtggctcatgcctgtaatcccaacactctggaaggccgaggcgggtggattacctgaggtcaggagttcaggaccagcctggccaacatggtgaagccccgtctctactaaaaatacaaaaattagccaggcgtggtggcaggtgccagtaatcccagctacttgggaggctgagacaggagaattgcttcaacccaggaggcagatgttgcagtgagctgagatcgcaccattgcattccagcctgggcgacaagagtgaaattccatctcaaaagaaaaaaaagaaatgatctgggcttggtggtgcacacctgtaatcccagctactaaggaggctgaggcaggaaaatcgcttgaactggggaggcggaggttgcaatgagccgatattstgcctcatgccactgcactccagcctaggtgacagaacgagactccgtctcaaaaaaaaaaaaaaaaaaaaaaaaagaatgcttaaagaaacagcagatatttaaccagaagaagagatagttgggaaagaaacagtgaaaggaacattataggtgatattaactaaagatctatcatgtgaaagcaaggttcatcttctgaagagatgctggtgttgttaaaaataagtaagtttaacaatgtgtctgataacaaattagttaaaactaacttctaaaaataaacatttccagtcattgattttacaactccttggtgatcagtgtctattgaccgatgagcgatttttctttcactaacagcgatggttaagctaagattaaactaatagtgcatggggtacactaatacaactattacaatgctaaattgatgaaagctggttgagagggttggttttcaccctgtcctctgagaacatgccttgtggacagaagaggatactgtggacagcacctgggattgctgcaccgttgtctgctttatatgttgaacattggggctcaattctgaggtataaagggtcttaagctctaraaatggttgtaaacgcctcacccagataatgtcttttctcatttttgctgttttatgttctgaggtaaaaggatatgttaatcttcttttcaaaaatatccaaaaggaaagaattttttttgctcattgaaaatcttattttcttttaaagaaggccttagcaaagcaccttaagagaaatatacaatttaaaatagaaaaaacatggccaagtagatattactgactgaatttatttcaaactaaacaaaatgaatcttacaaaacaatttttttctgtgtgttaggtgtaaaaatcactccagtaagcccaaatgttttcaatctgtggattggattgtttgcactggaaatgtagatttccaactgattttctactgatcaggttacttaatgaaacaggccaagtttttcggatctgtgaaaacattgccaaataaacaactgattgaaaatatattaggaaaagcagaatgcttatctaaagggtgatggaaaatgcttaagagaaagctattctacagttcaaaaaatttctttctttcttacccaactctaaatttctttttttattttttattgttattttttattatactttaagttctagggtacatgtgcacaacgtgcaggattgttacatatgtatacatgtgccatgttggtgtgctgcacccattaacttgtcatttacattacgtatatctcctaatgttatccctcccccctccccccaccccacaacaggccccggtgtgtgatgttccccttcctgtgtctaagtgttctcattattcaattcccacctatgagtgagaacattcggtgtttcgttttctatcgttgcgatagtttgctgagaatgatggttttaaatttctaataaaaaatatagataattattgattgcataataaattgctgaactgcctcaagttgtgtgaaaataatgataaaagagtgatcataaatattttcaagtgatttattatatgaaccaattcatttttgattaatttgctgtgagcctttctttcctctgtggctcaggtaatggaaccataaaatattacatttggaaagaacatctatttctctgcccctcatttgtttttgttttttttttttcagaagaaaaaactgatgcctgaggagtaatgtgacttgtttacttgtgtttcctgtccttaaatgacaatttgttcagaatgttgcatcaccagggccgaagtacctgaaagtttaataaaaaatgaataaatgaatgaataattgcatcagataagggttcaattgagagattcttggtacgaagtttttgtaccatggacttccattgcaaattgataaaacttattgacctcatcataaaaatggtgaagtgcataaaataaatacgtaggataacaaaggaaactaaaggtattgaagtatagtctgtgtactccagctaaagaactcctggaaggtgatttatcgtgtcccttccatttctgagatgttgcacttctatcgtgtaatgtcttgttactcttggatcagcagtcttgattgacaacccctgcaactactctgcattccaatctagatttttttacattttcttttcttttttcttgttttttttttttttttttttttttttttttgagacagagtcttgctctgtcgcctaggctggagtacaggggcacgatctcggctcgctgcaagctccacctcccgggttcacgccattctcctgcctcagcctcctgagtagctgggactgtaggtgcctgccaccacacccggataattttttatatttttagtagagacggggcttcaccgtgttggccaggatggtctcgatctcctgacctcgtgatctgcccgccttggcctcccaaagtgctgggattacaggcgtgagccaccgcgcctggcccttcaatctacatgtttaaatacaatatcctctgaagattcatgtgcctattagagcttgaaaatcactagtcctgggatcaaagtgagacccgggtgcccagagattggtgcccaaagcccttgtactgctgytggtggactggtgctactatatttttgtgtaaatcctgcagtggttacatatttcagcctaaggccgacttggctttcatcctctgccagtgtctgtttttgctttaaggataattcatctcagtttcagtaactgaaactgttgttgctttctgaatattgcataccacaagcctgacgtgatgtagttttyacccagacttccctttgctgtttaagcagcaaaattggaagcattcaaattagaatattttcttcagaagagtagaccttatttagagaactttatatgactgtaatatgatcttaaggacatatttgggaccttttcccacagactgaaattttcatatgcttatggttctctcatatttattatttatcttcaggcatagatatgatttggaaattgcctttttaactccgtcacctattttrttactgctgtaaactccttattacctaaaatcaaggtcgttggtttggcgccagcctttgtctgtggacctatcagtcattccacctcttagcatgtgctgtcagccccaaagacaaagctctcggctgtaatgtatgtccccgtatctccacctttgtgctcacgctcttgtcttcaacacattccccttatcacacattccccttctcagaacttcttagagggccagggggcccagcccacttctgatagcaaggtttctggtatgttaaaaataaaaatccccaaatggtttacaaaaatttttggtatgttttaaatatttgcacatagcgcattcacattactaatctacatactcaaatccaatgtatgtagacacttgtttggggacagcaaatatataaatgtgagacacaggccaagtgatcctactggctccctcaaagcccccaacccatgagaaactctgctctcattttgttgtctgcagtgttctctccttacaattcctgtagcacgttgattatgatttacacagcatttttaaaggctttttcctaccttccatatccatttatttatttattattttatttttttttgagaagtagtctcgctcttttcgcccaggctgcagtgcagtggcgtgatctcggctcactgcaagctctgcctcccgggttcacaccattttcctgcctcagcctccygagtaactgggattacargtgcctgccaccatgcctggctaattttttgtatttttagtagagacagggtttcaccatgttagccaggatggtctcaatctcctgacctcgtgatccacctgcctcagtctcccatagtgctgtgattacaggcgtgagccaccatgcccggccgtatttattttttaatttaattggtacataatttattttattggtacaaaatatcacatgtagcccataaatatgtatatattttacatatgcatatacatacacaaaatacacaaaatgctgtacctcagtatataaaaagtgttgtgtgtaatgtttgaggtgatagatatctcaattaccctgatatgatcactgcacattgtatgcatgtatcaaaatatcacatgtgatatgtttatatactgaggtacagcattttgtgtatgtattttactctatgagattacaagcacccttggggtggagaatgtgtactattaatatacatagtacattcagtgaacccatgatgaattaacaaatgatggtaatctacttatcataatattacatgagctwtcacttggacacagatatgagcacgggtattttgaattattttcagagtttggttaaaatcggtgtcattcacatggatttgtatgtgtgtgtgcctgtgcacgtgcttttttttacactaggttattgaaatacgagtatttatggaacagcttaaaatgtgtgtttttatgtttatgatactttgattttatgatttttgttagcttctccacatacgtgtttactggataacattgccagatgctaggaacacagctgtgaacctgtgtcaggtagcttctaaaagggaaaaagaaaataagcccaagaatttcactgtgtgataattgctttgaagggaaatatattctgcttgtttgttaaagcagatgggatatgatttatttgtaaacaattaaacagttttaacatactggagaagaaattgagtcaataaaggaatcttagctgggattacagctaagactgtaagaatgacagattgaagtaaagaagaaattgtacaaaagcaggcagctagttgaggttgaggagaggaataagagcaaattattgccaagtcttatgtatcaactggtaaactttcaatcttattcattggaaaaatgactgataaacactgtgtacmtatcacaatgtttaaagtttctttggttttatttttaagagaaagagagtgaacgacctcttcttgatggtgacttgagaatagtatctttatgttaaagagacccgtaggatgtttaaaaggcctgtggagtacacctaaggtgactactttaggcgtgactgatcatctaaataagatggtcaagatttctgggaaatttctggtctgattaaagtctgtgaaaacttaggctgtcatcagcattggcaaagcattgcagaaacattgcagggatattggcgatgtttactgagaagactccacgaaaacaggtggttgctctatgtatgtttgaaattctagaggcagccaagttatgatgagtaaaataagcaagtaattttgtttttcttagttaacatttgataattcagtcttatggctctaaaagatattaagtatgttttattttaatgtgtttctatttttaggaaggaaaatctgaaatgtgctagtatctgaatttcggaagaaatgtagcttggttttagatagctgttaggaaatatcgccatctaatggcttttgcatcraattgcagataacagttcctgaaggactccataaaagaccccataagacgcctaaggacttcataaaatgaagactccataaacttggtccaatagatttcacttacttcatcatcaaaaagctgtcagagtgtgatatgtagaaaacctaattataattttaagtgctcattttgttcatcaaccatcgttaaaacaaaaatagtatcttgttacaaataaacttmtttagtgtattcatttatgcatattttgattattgacttaagtcagtaactgttagaatgaagtttaaaaatccgtaaattcagagaggaacttcttttcttctgactagttttttgattcttgaatgacaggttgaaacagatgttctctatgaacataaccaaatcagcaacgttaagtttgcattcctagaagcacttacatgttacagcttaccagagcctgaagtgatgcctccttttgcctcttgatacagcacttgtcttatggcaacggcagcttacacgtggatgccgctttccagcagactctctggagcgtggccccaatcagctcaggaagtgaggcagcccaaggtaaaaactccacttcaattagagggcctgtccttgctgcaaagttgacagtcatctttggaattgtgataatgagctgattgttaattagagctttttgtctgtgtctaaatattctgtaatgcagatacctgacatttgaggatcttgtttaaactgctattttaacagtgaagcttgggtgaagattaatcttcccttatttttatgctactgtcagctttagtttatttgtgtatgctttatgtgatagcttcctatggattgttttcttcaattttttgacctcagagtattgcctggttggactaatgtcaagatttcttattttctgaggtcatgccttatagctggaatacgaattttacaaaggagcagggtttcctagggaaatatctgtatatgttctggttattccaacttacataggttcacatttgattctaaatgtgtttgtatgtttaacagaggattttatgtgtctgaggtcatgcttttagtgggaatatccctaactgtgggactcgggcacccaggactcagagggaacagcaggcactgtctctatctctgtgaccttggccaggtccttaagactcactagacttcagtttctttacgaaagtagaagattggaccagatgatctgtctggctatcagcacctgacactgacagtccagacctgaatgatttttaatccttacagggtatctcattggtggtgatgtcctcaggttgctgcatggacacatggacgagtgtctcactgtcccttcaggagaacatggtgaagagcagcggaggttagtacctgagctcattgcattgagacttgcactcttttgccttgatgtaatgttttaaaaactagggatctattcattcaggccagtagcatcatacaagatgggctactgacattcattgattcactgaagtgatccatttgttgccccctcttagctttttctcatgttatatttctattacctaccaacagaagaactgaaaatttttgtataattaaaacatattaagaaacactgaacaaaattaacgaagtgagaagagtgaccacattgcattaaactacttagaacttcattaaatgctcattagttttgattaattttctttttagaatgtttaatctcaaactcagttttgaagtcagagttctcaaattgcgtacaattttaggaccctttgctatgacctctcatttattgatacagatgatagaattgatcactttctctcatatttaatctgatataatacctctctcatgttaatttatttggcactgggacaagattacaatagtatgaatctactgagaaaagtgcacaaatattacaaaaccataaaaatatttagaatagtttgctactgctctaccttacaaattaatcaatgaatgtagtaagatgaatatgtaaataagagattgcagtgagagaaggyactgtgtggatggtttgttatgtatctttaaatcttttagtggacatttttcatattaacayggacacttaggtaactattagttaataattatttatttttataatttaataaaaatacatagggaccatttagaaaattaagagtcatttaaccagctgcataatctcaggaaaagtccctctgagacctgggtactgggtcttaacctctgttcccaggcagacctagataatggtcaagagtgacataagtcccctggaaacattccgtaagctaaaactgcctctttcagtaggtttaggaagaagatgtcgatggtgtcagtagggtttgtataaaagataatggagattttaagacacttggataaggaattagtttcaaacagaaatataaacttaagaactagagagatgtcaagcatattctgggaatagcaattattccagagtgattagggggaaaatggaggaaaaggtggaaagtagacaagagaaagatccttagtgccattcccgtgggctggcttctattctgaggttgttaggaagggatgtggggatcagagtggaatagttagttctcttttaaaataataactctgttaggcaaggagaacttagattagaggtggggagaatctgagtcacggaaatgaaatgcagtaattcgtgtgacaaaatccaagaacttagcccagataatgccatcagaatggagaggtttacttgcatyatagacatttagataaaagtgatgggtttaggggagaactagacacaggctgtgagagaaggtatctaatccagcgccatctttttttctgcctcaggggaagacagctggagctaaggattgcaggagatggtacatgtttgctatgaaagatggagttaaactttggttacagatgagtacagtctatgagacgtccagtaggaaattgggatgtctgagtctttaacttaacaaaacttgggatgggtgcaaattctaagtgtaagggggatatttaaaggaatggggtctatcatatgttcatcagatggagagggaagagctgggattagatgtgtttgtcgattgggcatggccttatgaaggctgtaaagacctggaatagcctaatcaggcagggggctgaggatggattcctacagaatgctgatgtttaggatgtgggcagagaaataagagtcagcaagagagtcagagtgatagtttagtagggaaccagggaagttagtcattgaagtcaaaggattgggttgtggatatgttaaatgctatggtgtgtttatttggagttagagcttataagagaccatgccagagtctttggatcctcagtccctgatttgttaaatggaagacagactaagtgtttcttagagctttttcggctgtatctacagacactgtagagcttcgtggttaaggtaatggactctagaaccagacagatctgggattggggttctgctctgccacttaccagttgtgtgactcatgtaggtgacatagtttctttaaacaatggtttcccctctttgtaaaatgcagcttaaatattatctcctgctttatggggctattgaaaagactaaataagaaaatacacgtaaaatacttgatgcatattgagaaatcaacacatttattgttattatttagtctgttgctattatttagtctgaagaggcagcatttagccagatatgattgaaaagtttgagggactctgggcatatggatgacagaatggcagagcatagactttgtaggaagagaggccagactggatccaagaggatcctttcgatggctagttatgattgcagagaaatctaggggacatttcaaagatattttaatcatgttctggacccactctccctttgcatatatgttgaagcctgcccctcctttccaaatagtcttcttgatttcatgttgataatttcagttcaacttattcttagtatgtaattagaccagcctatcaggactcttggtaggtagtgatggtggtaagaacacgtttgtttgtgtccctttttatagcatatttacatgggtgaaattagattaaaatggatgtcagattatgactcgagggagaaaatgagtcagcagtaggcagcatggagctgaagggatgttgcttaagaaaaaactatttgtgttggttatactgggattgagcaattatttgaatagaatgataaaaataattccttgaatttcacaattatatagcacttcattatttctaaatcttgttaataccattgtttagaaagttttcaacctccctctgttatttccctaggtcattgtaaggaacttgggggaggcaaaggatagctcaccccggaagcagcctttatttatttgttatcagtctgtactgggggagacatgcataatgatcatctaaaaatatacttttttcattcattaaacaaagaagtaaaagtaatttgatttttgcacagtgacatgaaagctagagaaggtcctgggaaatatgtaaaaaaaattttttaccttataattctttcctgtaattatgatctggctatactcattaattgtatgctgttgttaacgttaaataactaaagtccaatttactttgttaggagacatagtggaaactattaaggagatggccagaaaagatgtttacttctgagtgatttaggaatagtctggtcataaatgctgtgtttctacatggatttgtgcacctgttcctgctttgttctattgacagttatttaatatacataactgtaattgtagctattgaaaatccacctcaataatgggttttatgattctggatatcagtagagttacctttaccttcctcttcacatttagatatgtatgtgtatgtggttacctattcattctcctaaagaatgttaataaagctcttagaatgaagagcatatagagctattcagttaagaacaactgaattggagatgatgcctatcagagttaaactaaatatttatctttttctcatgcttcctgcccattttgcttttatggattgaatcctgacgtgttcatgaaatacagcatcattattgttttaagttacttgagatttttttccgaaagacaaatcgctctaaaatgactagtagacaacttgtctaaacaacaacaaaaatagtaaaaatataacctatagtagttgtgagcagtcaggtataagggagagagctcattagtattaactatagtgtcgtaactttttagttcttattaaactcttcaattagtgagatagaatgagttaaagagaagcaagtctggtagttgggaagggatgtgtcagtatcccttgtcaatcatgttttaattattgctttaaaaataggcttttgcacaacagggtaactatagccaacaataaatttattgtacattaaaaaataactaaaagagtgtaactggattgtttgtaacacaaaggatcagtgcctgaagtgatggatccctcatttaccctgaagtgattattatgcatagtatgcctgaatcaaggcatctcatgtaccccataaatatatatacctactacatacccacaaacattaaaaataaaaacttaaataggctttcattctggaggcttgacatttgactactaaattttatttcaagcctgacatattttatgtggagagtattttctgttctagattttgtttctagattgcatctcattatttccatccaaaattttatgtgaatataataaaatatcaacaaaggcatttcctttatgtgcacatagacttatttatggatttgatatgcactatgtgaataaactgtgcatacttttatattgatacattttaaaatggatgcattggggaagattatttggggcctttagtttggaaatctattaaggaaacattgtttgaaaagcattatttatgttaaaaacaggtttgcaatgtcgaaactttttattgattcaataagaatgtgtagaatgactatgattttctgggtgctggggctatagtagtatacacaaagttacaaagtttattttctcaagaagtttacattctagtgggcatatgcggcaataaatacgtttatttctaaatgtatacacttacccacatatacagagatgaaatgcattaggtgatgataagagctaaggagaaaaataatgcatggaaggggatggagagtgttcatgtgtgtggtatgttttgtggggtggtatgacggagaggtggggagagaaggagagaaagcttgttcttcttccaccttatctggcattgctcttggcatatgcttgctgtgtcttgttactttcaaatgcaggccaattaagtcatagtttctgacagtatctggaaataaatgctacatttgcttcccaaaatgtgactcagcaggaaaaagctatgccatgtgtatgcatgacaagatttttacctccatgcccccttttaatattatgatgatttaatgagctttagttgtaaataattgataaggcatgagatggattggatgtaatgaattaaatgcctctccatctggcttagaaagagatgcatagtttatatctgtgtacacaactggatgactgatatccttgtgaggatatttgtatgcctttggccaccacctaggaggaagctcttaaagctattctgttgttctccaaaatggtcaaggataaagtttaacctatgagggtttttcttctttttctctgtcttcaggtcctgcatatatcttttcagcctggaactgagagttagatgagttagctaaacagtcttgatggaatagtcagtacataaaggagagctactttctgctctttgcctcttctcctttgggagagattcgctttttaccccaaacttaaactccttgctgattgcagagagtgcagtagctgctgtagtttgtcatgtgttctggaagcctgacttggtctagagccgcactctcaaggcaaggactgggtaaaatgactgcttcaaaaacgtgggcttctaacacaagattaaaaacattcataggaatttgagctgttggatcttggcaaaaatgaaaaacaatgagacatttgatgcatttagaktatatgaatagaaaaacagacaatagattaaaatcaacattatacaaaaaaatctctcgatgattttctcaattaaaatttaagaacatgacttgtctacactgggtttattaacttaatctatatgtaagcaatatctttcagaagaaaaaaagaaagagaagcatcttcttttgtaaatttccagatgcctttatggttgtattgtgttctgcaaagcaatggtaacaacatgtattttgttgtttttctgctctagtcctacctacatgattctttcaatggtgattcaaagtgtaagctattgttgtttcaaatctgtgctgattcatttacattttatgcagaggtgtcatctcaaaacatacctattttcccttgtgcagcaacttgaatagagctattgtggcaaactgagctcctgaataaacaagtaatgcttcttgggatgctggttaggcaagtacttcttgatttgttactaggaagagactcctgacagctgctttagcacctgcctgcggctcagctgctcagccacatgctcccaaaggtaccagcagcagaaattctcctatgaaaatgtgtcaactgaaacgcttatratttcactctgaaataaccttttaagactggatctgcttttcaatcacctcaactcaattcttttaatatttattgagggacttgtatagcccagacatytttggcatgtgctgggtatgaaaacatgtctaaggccctgccactatctttctggaactcaccgtctctattagtctgttctcacactgctataaagaaatacctgaaactgggtaatttataaagacaagagtcttaactggctcacacttctgcaggctctataggctggggaggcctcaggaaacttacaatcatggcagaaggcraatgggaaggaggcatgttttacgtggctggaggaggagcaagagagcaaaggggaagtgctacacagttttaacaaccagatctcgtgagaactcactatcacaaggatagcaaggggaaaatctgcccccatgatccagtcacctcctatcagtcccctcctccaacactggggattatgattcaatgtgaggtttgggcggggacacaaatccaaaccatatcaccatcttttaagatctcaacaacactatattcaggatgaagtgaatgttaatctgggagaagccatttataattttggtaaaacttagatggtagaaaacatattttaccattcaaccatgtgagaaagatcagccaagtctttgttgacctttgattttgaaggatatttttgtcagcctataaaaagttaacaaaaaagctttgcttttctctaattagtttgaacctgctattcaatatcaactctaaatgggaattgcaggtgagtaattgtgggtgactgtaactatttttcagacgattcctacatgcattttaaatacgagggtctagtcatacacgaacacaaccaaacttgattgaggacacgtccgctagtaggactgtcttttttttttttttttttttgagacagagtctcgctttgttccccaggctggagtgcagtggcgcgatctctgctcactgcaagctctgcctcccgggttcatgccattctcctgcctcatcctcccaagtagctgggactacaggcacccgccaccacgcctggctaattttttgtatttttagtagagatggggtttcaccgtgttagccaggatggtcttgatctcctgaactcrtgatgcgccctcctcgatgtcccaaagtgctgggattacaggcatgagccaccacgcccagccaggactatctttaacttccccacactttcacttcccgcatcccatagtgccactgatcacacgtgttggtctgcatattcatctcttccattcagttttcagccagggctgtgccattcatttcttgcataccttttgcatagtgaggtatatatgggaatctgcatacaaatgctattgtttcgtatttgtgaaagaaagaaacggagaaaaaataactcttgcactttaatgtaagtttggttaaggatggctgtatagagaatcacccttggttgtgaggtcccccatttatataattttgacagttcctgaaggattgttatctgccagcaattaggggcggggaaagaaagccatcttaataaatcagcataacaacctgagtgagtagaaaacattttgaggactatgaatgactccagtatgcttggctaagtcatctatattgagaataccttgatttcaagtgagtaactctacatacgggaagagtctctggaccaatagaataggaatctgaacgttgataacagtgatttaaaacaaaagcatttttggggttgtggatatctttgagaatctaatatatgctacagattcttccatagagaatttgcatacttgccaacatgcacaatttttgtgatgttaaattatgttttctcccactattttctcttatttcttcccatttaagcagccagcagtccctgtgtttctttgcctgaggggaggtttgagacttggcagaaagctcaagttttctgcaaggcatctctcttcctgactctcagtccccaaagactaaatctaaggcatttgttatgcttaatgtcttgaacagaaaggaaagagggattcttcagacagaaaaaggagacgttttccccagacttaaaagacattcacatggatcaactggacttccaaacatacacaaaagagaacctgggcctaaacttcacattttatatcaaatctaattccaaatagatcacagacttaaatatgaagcacatacttttaggaaaacaaacataaaagttttaagggaaaaaaaatcagaaaaaaatctttgggatcatagagttcttaaacttgacaccaaaaktatgtctataaaagaaaaaattaggctggacgcagtggctcacacctgtaatcccatcactttgagagactgagacaggtggatcacttgaggtcaggagttcaagaccagcctggccaacatggcaaaaccctgtctcyattaaaaaatacacaaattagccagctgcttgggtggctgagacaggagaatcgcttgaacgcaggaggtggagattgcagtgagctgaggtcatgccactgcactctggcctgcctgacagagcgagactgtttcaaaaaaaaaaaagaaagaaaagaaaaaatgataaattgtgttaacagagaagacaaaaatctatgaaatattttacagaggttaattctaagccgatatgagtgactgaagcccagggaaaaacacaaactcaagaagccttgagtaaatggtcccgaggccgttatgtcacgactatgttttatacagtctagggaagtagaagttacaggccaagtcataagtgaatacatggaggtgatatacatcagccttgcctaaaaaggtgggatatcttaaagtggcagcttacaggtcataagtgggttcaaagattatttaatctgcaacttgttaaaggagcaatgctttgcctaaaaatttggagtcagcagaaagtaatgtttaaggaagtctgttaaccagtaccctgggtctgagtgacctgtaggggtaggggacttaacacttgtatggcctggccttacaccctgtttataatttggtatctttttttttttttttgagacagagtcttgctctgtcacccaggctggagtgcagtggcgccatctcggctcactgtaagctccgcctcccaggttcacgccattctcctgcctcagcctcccgagtagctgggactacaggcacccaccaccacatctggctaattttttgtatttttagtagagacagkgtttcaccatgttagccaggatggyctcaatctcctsacctcgtgatccacccgcctcggcctcccaaagtgctgggattacaggcatgagccactgcacctggtctataatttggtatcttgttgtcatgaagagtctgttctgtyagtcttctgagatctattttaacatgaatgccggccagtcattgtgtctagactccaaaaggaagggagataatgaaatgtgtctaacctcttgtctcatcatggccagaactcagtttttcaggtttctctggggtcctctcagccaagagaggaactgctcagtcagttggggggcttggtatcttatttttattttacaattgaatctcatcaacaggagaaagtgtgttttgctctgtaaaaatccacgtggagagggtaaaaagacaagctacagactgagagaaaagatttgcaaaccatatctgataaaggactagtatctaaaatacataaagaatcaacagtaaaatacaaacaattcaattagaaaataggcaaaaaccatgacagctatttgtcaaagatgacatacagattktaaataagcacrtagaaatatgttcagcattatracccattatagaaatgcaaattaagaccacaatgagataacactgtatgcttatcagaatgactcaaacaaaaatattgacagccacgtgctggtgagaatgcagagaaactgtcatatattgcttgtaaaatggtacagccactctggaaaacattttggcagtttcttaaaaaactgaacctgcatgaccatgtggcttagcaatagtactcctgggcatttattctaaagaatgaaaactgtgttcacacaaaaacttgtacacaaatacttggtgtagagcaactttatttgtaataatcgaaacatggaatcagctgtggtatgtccatagcgtgggatactactcagcagtgaaatggaatggtctattgaaacgcacaaccacctggctgtacatggtggttcacacctgtaatcccagcattttgggaggccaaagtcggtgaatcacttgaggtcaggagttcaagaccagcccaaccaacatggtaaaaccctgtctctattaaaaatgcaaaaaattagctgggcatggtggcacatgcctgtaatcccagttacacaggagcctgaggcagtagaatcacttgaactcaggagttggaggttgcagtgagctgagatcatgccacttcactccggcctgggcaacagagtgagtctctgtctcaaaaaaaacataaaaaataaaaattgaacacacagcaacctcaatgaatctccaggcaattatgctgaatggaaaatatcaatccccaaaggttgcatactgtgtgattccattttcataacatttttaaatgataaaattttaggaatggaggacagattataggccatcagatgttagggaaacaggggagggaaatgagagggaggtggatgtggatataaaagggcaacttgaaggaactttgtggcgtaggatcttgcctgtgatggtgaacccagtgttggatataaaatactccaggaataaatgctgagtgccatgaagtaaaaccagtactcaggaaaaagtttaatgctctcagcaaggcaatctacttctgcagaagggtgtcactcacatcaatcaagttcgcaagtgcacacagaacaaaggagaccagggggtttttatccttaacgcagcccctatctctgtgtcactcccccatgggctagggttggaccgcacaatctgagctgactccattggctacttgtacatattttcctaaatatagtgggggaggggaggggaggtacagaagtggagtgtgtgagacgtgcagtttcgggggaacaatgggtataggtaaccaagtgaacaaatgtgagttattgattagagctgatgggaagggggtagggtgtttacagtaactaggggcaaggaagaacaaaaaagttgagtttgagaacaaaggataaagaagttaacaggctaaaccctttgaagagaaactcagaaagatttcttgtgtcttacaccaggatcttacacaaatgataaaatggtttagaacttacacacacacacacacacacacacaaatgaatacaagtaaaattggaaaaatctagtaagtttgggagattgtatcaaaatcaaaatctttgttgaaaaactgtagttgtcaaactcttactatagaggaaactagacaaaatgttcaagggatttttattatttgttacaactgcacatgaccagagtgatctcaattttttaaggcattcatagagactggacaaagagcaaagatttctggggtcccctttcgggataccaagcactcagctcccgacagccttctcctccgcattccatcctggcctctaaggaggtggcaagaggtcagaagggaatgactgtggagatttttactttagcacaatgtcctgtgtctcccaggtggataaaaagcagtggccctcagactggaagggggcatgtaaagagagaccctgaatataggagatctagcaagcaaattggtcctgcccaatatctgatattaaggtactgctttaccaagaatgattagggcttgatttcctcactatcctgatgggagggagactcaaagttggaaatagttatattttaaagataatttttaaatgttatattcataatamtagtagacattatttataataattgttgacattattkcacaccaacctccccactcccactgagaaaaactaataaaggtagacactctcctttcccccgaaagtagagagtgaacaaagcagtgaagatgtagtattgggtcatagtcccaaaaaggaaggagatcagggaaatgaatttagtgtttggagcagcctcttctctctaggcagttgcaatgtctgaagggcttagaagtgaagcacaactgttagaagaatcataggatggaaatggatcaaaaattgtacaaatctccctaaagaagaggcgtgtttggtgggacctcaaagaactgtatccctaaaataattgtgatccagaaatagaccagaccttacaagtattgagacccagcatcaaataatattaattgccatttgggatttgccataagacaatatgagattactatggccctcgtctgtcaattctgcaagaagcaaaagtaaacctttagggagaaaattacatataaaactcaaattgcctatataattttatatatacaatgtctgataatcaaaattaaacaggctattttgtttcagcaccaactagcatactgcggtatatttctgacactaaccacctggagttagcacagactgcamaagttatgggctcagttttctccaaaactgcctctatctcagataccaatcacaaatgggatccccagaccacttgcggttctgaccaactggctatacatttagaggttcccataatccctttagattcaataactcactagaatgactcacagaacacagatgttatacttatgcttgcagttttattataaaggctacacatcagaccagctaaatgaagagatccataggatgaggtctgggagggtcctgaatgcagagcttctcgttccctgtggaattaggatattttaccctcttagcacataaatgtgttcactatccaggatgcttccttgagcttcagtgcccagaatgtttgagtgcagttttattatgtaagaatgatgcattcgatcataggctacatgatggaattcaatctctagcatccttcctatccctagatgttgtgctggatcaaacctctacccctttaatcgtgtggtttatctttccagcatggccagctcccatcttgaagctatttaggggcccaccatgaaccacatcattagcataaactgaggtgtgatgtaaygggctcatgaataacaaagccacttctattcacttggaaaattccaagggtgtactgtcttccaggaatgaaggacaaagatcagcctacttacttattatcaaacatgggcacagaagatgataggacttgactaaagatcaagagcatatacatagtactgaaaaaggcacatagatattagacacacagataatggagtttaattaaaaatatttatgattatctggtggggtacagtgtttctataatctcaacactttgggaagccaaggcaagaagatcacttgggcccaggagttcgagacctgcctgggcaacataaagaggccttgtctctacaaaaaaaaaaaaagttttttaattagctgggtatggcaagtggagagctgagtatagcaagtatggaggagagcttgagcccaggaattcaaagctgcagtgagatatgattgtgtcactgcactccagtctgggtggcagagcaagaccctatctcttaaaaaaaaaagaaaaaaaaatatatatatgtatgattattatgttctaagaattaaaagatgcaacaatttagtagagaactggaaactataaaaaatgatcatatagacattctaaaactaaaaaataaataacttagaaacaatggatagatttaatatcagcttagaactagctgaaaagagaattggtgaactggaaatcagatcagaagactattcagactaaaacactgacagtcaaaagattgggaaacaggctgggcttggtgtcacacacctgtcatcccagcactttgggaggataccttgaactcaggagtttgataccagcctggacaacatagtgagatttcatccctacaaaaaaaaattgaaaagccagatgtggtggtgcatgcctatagtccctgagactcaggaggctgaagcagggggatggtttgaggccaggacatcgaggctgcagtgagccatgatttcaccgctgtactccagcctgcccaatagagtaagactctgtctccaccctccttcccyccaaaaaagattgggaaatatagaaaagaacaaaaaagatggtaaatgatattatagatggtctatcctacatgcatgtaattggagtcccaaaatgaaaggacaagggtgggagagaggaagcagccaaggagagaggaaagatggatggagggagacaaagannnnnnnnnnnnnnnnnnnnaaaaaaattgaaaagccagatgtggtggtgcatgcctatagtccctgagactcagagtcttactctattgggcaggctggagtacagcggtgaaatcatggctcactgcagcctcgatgtcctggcctcaaaccatccccctgcttcagcctcctgtctccaccctccttccccccaaaaaagattgggaaatatagaaaagaacaaaaaagatggtaaatgatattatagatggtctatcctacatgcatgtaattggagtcccaaaatgaaaggacaagggtgggagagaggaagcagccaaggagagaggaaagatggatggagggagacaaagagaactcacaggtgcgtggagtaaaggaagtatttaatacaattgcttgaaagttctccaaaattgactaactatattaagctactgattcaagaaaaactatgacccctaaataagacaaatcagatcacaggtatgcacatcagaggaaaactgctgaaaagtaaacacaaaatgaaactcgaaaagcaaaaagatatagtacctttaaaggggcaagagtaagatttgcagttgatttcaactcagaaacaatgggagacatgggaygtaagcttaaaagtgcttaaagaaaatatctggcaatctaaaattttatatccggtaacacagtgatactttatttaatttactttgggacagggccttgctccggctagagtgcagtggtgtgatcatggttcactgcagcctcaaccccctggcctcaagcaatccttgattctcccaccttggtctcctgagtagctaggactatatgcgtgtgccaccatgcctggctaatgtttaaattttttgtaaagacagtatcccactatgttgcccagggtggtcttgaatttctgatcttaaccagtcccccctccttggcctcccaaagtgctgggattgcaggcatgagctactgcacccagacctagtaatacttttagacaaagttgagggaattcatcaacaccagattcacattaaggaaataccaaaaagagtttctttgagtagaagaaaactatctcatatgtaactttggaggtatagaaacggaaaaaaagccacagaaagataaatacgagagttaaatcagaggatactgagtgaataaaataatgataatgatgattataaaaacagcaaaaacatcttggattttaaaaccatagagaacaggctgtggtggcccacatctgtaaacccagcagtttgggagactcaggtgggtggattgctccagtctaggagttcaagaccagcctgggaaacatggcgaaaccccatctctacaaaaaatacaaaaatcagccaggcctggtggcatgcacctgtagttctacataatcgggaggctgaggtgggaggattgctggagcctgggaggttgaggctgtagtgagctgtgattgcaacactgctactgcactccagctgtggtgacagagggagaccctgtctcaaaacaaaaaattatagagaacaactcattacaacactggcacatgagtcaaggggaaagtaacttgaattaaatggtggttcttgcatggtctggaaagtggtaaagttactaattagatcctgttataataagccaagaatacatattgtaatctgtaatcactgcaaacatagtaaaagaatgtaaaattaaaggagaaaccataaaaatataatagtaatacttaatccacaagaaagcaggaaatgagaataagaaacctggagtaggacaratattaagaagaccaaattctgatgtggcctcgagattctcaccccagctatacacatcctgtatataattcctccctttttgtgtgatgggactgggtatatgacggacttcattcccatgactagattacattatttgacaaagctgaaagaatgttgcaaatgtaattatggcccctaatcagttgactttacgttaattgaaagggagattctcccagggtagtcctgaagtcttagcttcaaggtgtgtgagattcttctgccatgattgatgaagtgagctgctgtgttttgagagggactgtttaggagactgtattgcaaagttgctgagagccctctccagctgtcagagcgcaatgaaataaggccttcagtcataaaactgcaaggcactgaattctgggaaccactggtgagctcctataagggcctgagctccaggtgggaacccagccccaaccaacactttgatttcagcctatgagaccctgagcagggaacccagctacatcatgcctagacttccaacctacggaatggtagaataagaaatggtggtgtttctcagccatgaagtcaggggtaactgattacacaggaatagactaccaaaacattctgtgtgacatcaccttgggaatgaggacatatagtaaaggactgaccctaaattgtagagatgaggagcatctagcaaaggatgcaactgccagtgatgtaggaggaaaacctggaaagagtggtatcctggagtcaaagcataagattgccaagggcagtggggtgakcaactatgtcaaatgcagttctcccctcaaatatatccacaaatggaatgcccttgaaacaaaatgttttcattcttttctttcttatagcctcaacgatgaactttgtgaattactgtcaagtctaatccacagactcattctcctgaacttctatcctaaatgttcaagttcttattgcgtatgtctgcgtgaatttcacttgagacagcaattcaaatatatcaaccttaatttaattccrtcagagatgttttccttcttacagcccataacttggttatgtataccagtctactatgctcaaaactttgccttgacttttcttttaccttttatgaaacaagagaaagaaggattttaggtcytattgattttattgctaaattttttctctattagacttgtttctcttgctgatgtcaattttaagggtgcaccttcctgtttactgtgatttgagggttctgttgtgctgttgctttcagattaatatccaaagtctttatctttaactcctttttatccttgtggatttgtgaccaccattcagaaaagtaggtgaaaaaactttcttaactttatctcttcatcccaccatcaaccactgaggtattcttgcactttgaatatggcagcattctacttcatgattctgcagcctttctactctcactgccacgctctcattcctcatatcctcattcttttctttgcatgctgaattcttactcagctccaggagtgaacccaaatatctccctcatgaaaactttgcagagctcttcttgacaatttatgtcctttcatcccctcccctccccttcccttcccttcccttccctcccctcccctccccttcccttccctcccctcccttcccctcccctcccctcccctctcccatctctttatacgtagtttccccatactactacctaggctagtttttggtgttcgtgtctttcttaccatgtcaaactgtacattcgtggatacaggaactttggtgttttatatttctttttcctaaaatatatacctatgtgtctagaatatgaatggtaaacaattagtgtttgtttytggctaaatacaattatatttctatatactgttgtttttacgaaagaatagaaagataatagttcttcatattatttacttttgcaacatttacacatacacatttgtagctctcyatccttctcttttaaagagaataatccaagtttatttgagatagcctggtgttattttgtatattctggagaaaaaatgccctaaaaactacctccttttttccctgtaatatattcctaatatatttgtattactatattagtatttgttgagctagaatacctaatgatttttaaaaaattaatagactttattatacacttttaggtttacaggaaaattgagcagaaagcacagagaattctgcctcaccagttttcttgttattaacatcttgtattagtatggtactcttgttataaatgataaagtaatacggacacattattcttaattctctaaattaggcttactcagtgttgtacattctatagactttgactaataacatgtatccacaattgcagtatcacacacaataatttcactgctctcaaaattccctgttccccatttattccttcttccctcccctgaactcctgaaaaaatatttattttactgtctccatagttctgctttactcagaatgttaaatagttggaatcatatagttatgattccaaactggcttctttcacttagcaatctgcatatatggcccctctatatcttttcatgamttgatagctgatttctttacatcactgaaaaacattccaatggatgtgttacagtttattcacattttggctgcttccaagttgtggtaattaaaagctactattaatatttacatgcaagttttgtatagacctaatttatttgggtaaatatcaagaagcacaattggtgaatcctatggtaagagtatgtttagctttttaagaaactgcaaaactgtcttccaaagtggctgtatcattttgtattctcaccagcaatgaatgggaatcctctccagcatttaatgttgcagtattccaggttttggccattgtaacatatgaatagtgatacctcaagttgcaaatgttgacatatgacattgagcatctttttatatgcttatttgtcatctgtatatctttgatgagatgtcttagatcttctggtgatttttaaattgtggttgttttttttttttttttttttaaattgagacrgagtctggctctgttgctcaggctggagtgcagtggcatgatctcggcttactggaagctcaatctcctgggttcacgccattctcctgcctcagcctccagagtagctatgactacaggtgcccaccaccatgcccggctaattttttgtgtttttagtagagatggggtttcaccgtgttagccaggatggtcttgatctcctgacctcgtgatccacctgcctcggcctcccaaagtgctgggattacaggcgtgagccactgcgcctggccaaattgttgttgaattttaagagttctttacatatttcggatgccagtcctttcccagatatgcgattgcaaatattgtctttcagtctctggcttgtctttttattctcttaatagtgttttcttgcagatcagaggtttttaattttaatgaagcccaacttaccaattttttatttcatgaattgtgctcttgatatctaaaacatcattgtcaaatgcaagaacatctagattttctcttatggtattttccagcagttttatagttctctgtgttacatttaggcctatggttcattttgacctaaatttagtggaaggtgtcaggtgtgttctagattagtttttctacacatgtgtataaagttgttccagcactgtttgttgaaaagactatattttctccattgtattaggtctgtgatccattttgagttaatttttatgaagggcgtggtctgtgtctagattctttatatatatatatawatggatatccagtcttttcagtactatttggggagaatgtccattgacttactgattctttgttagagatcaatgtgctatatttgtgtgggtctatttctaggctctctattctgttccactgacctgtttgtctgttctttcaccaataccacactgtgttgaatactgtagctttatagtaagtcctgaaatcagrtagtgtcagtctcccaacttcgttcttctccttcaatattgtgttggctcttctatgtctttcacttctcatataaactttagaatcagtttgttaatatctacaaaataacttgctgggattttgactgtgattgctttgaaactatagatcaaattgggaagaactgatgtcttgaaatattgagtcttcctatccatgaacatggaatagctctcaatttatttagattttgtttgactttttaaatcagaattttgtagttgtctttatttagattttgtacatattttgttagatttgtatttcagcatttaattttttggtatywagwtaaataatatttttactttaaatacgtgttgttcattgctggtatagaagaaattgatttttgtgtattaatgtcctgaaactttcctataattgtctattagtttcaggagatttttgttgttattcttgattctttgagattggggtaaataatcatgtcatctatgaagaaaaagttttatttcttccttctcagtctgtatacatttaatttccttttcttatgttattgcattatctagaacttctgwtacagtcttgagtagtagtggtgaagagaacattcttgatttggtcctgatatagaagcaacaagtttcttatgattgagtatggtgttggctgtaggcattttttgtagatgttctttatcaacttgaggaagttcccttctattcctcattggctgagaatttgtattattaatagacactggattttgtcaaatactttttcttcatttattgatatgatcaatgatttttttctttagcatgttgatatgatggattayactatggttcagtgatatcttaattaccttatgtatacaaaaggagaaaatattcatttttgctatcatacttgtattcaaacagcacattccttttgaaataaaaaacagtgatttctagaaatacctgttatgacatttataatatattttgtttagmttatgaaataactactgatttttgaagggagaattgaattctgtggtatatcacagaaattctatggtatattcattgaaagttgagtttggataaatgaagtagtattttattacttccctgcattgcagtaactaaaatacattgatatggcttcttctttgtccctattatattctacagaaacatgtaattataatatgaattggcaaggaaatcttcagagcctggtaaactgttttctctacttttaacatatgtaatggattcatgatcaaaatttgatgtgactgattgaattgtcttttattattatttacctcttctggtgttcagtatttgttatataytctaccctttttcttgacaaaaaatgaaaccagaatgttatgtattcagaaaataggactctgaatagttctgtatcatttccccattgctctaaagtcatggtaaatgtaaaaaagagaaaaataaagttcacttagagcccctctcaaagtgtccgtgatactgtagtaataatagactatgtaagctattcagcattactgcactaaccttgtcagggctttgttatgttgaagaaacaaaagtagattgaaaaatgccccagctgttctttcatgtggcttttttggataagccaagtgctctgaagcgctgtgaatttgtctatatttctcttaagggcaaaaaagatctgtcacaatgtagatatgaattctagatttagaaatgttattcaagatagataaggtaagacatttcyttcaatttatgaaagaccctagaccctggattttatccagctagctttctctgagattaaaatgaccaataatatgggtagaatattctagatctaaggtcaaccaatcaaggcagtaggtcaaatccagcccactgcctttttttgcaaataaaattttattgttacacagccatcctatttttaaaaacatattgtctatgtttgcttttgtatgataataacagaattaaataatgagacagagaccatatggctcgcaaaaccgaaaatatttactaactggccctttacagaaaaagtaggtctgctcctgttttaaaccaccctttcatggtggcaatgaaagtcatagtggtgggtgtcaagtccaacagttctcgagacagtggatccctgtgctggagctacagtaagggtgacaaagcaggtgacttcagaagaggatttaaataagagagaaggtaggaaaagaagtattcttttaatctatataatgtatgcattcttttcagagcttgaattttttatagtgtcattttacaaatgtattgcgatgcatacacaatagaatattatacaacctttaaaaagaaggcaatcctgtcatttgcaacaacatggatgaacctggaagacattatgctaagtgaaataagccaggcacagaaagacaaatactgcatgattttactcatgtgtggaattcaaattcatggaaggagagagtagaatggtggtagctagaggtcacctccagtgactacagccctagctaacaacttgactgcaacctcacaagagactccaaggcagacaccaagcaagaagcacctagttaagatacactgtattcctgacccatagaaacagtataaaataatgtgtttattatttttttaaaaaaagaatgctgagatcctgccattgaattgcaggaggaggctagcactgaagtgactgatttatgatgaagctattaataggtaggcttcatttcctagttacgttgtcccgagcgattttataatttagggactttgaatatcaacaagtgtataatatgattgatttagcaacaatccattcaattcaggcaaaatattattgaatcttaactccctatatggaaggattgaatataaattatgaccayaatcatggtcatgatcatcaccatcaccatctgcatcctcagagctgacatttgttgtgcaaggacttttccaagtggtctacgtgggttatattactcattcattcttcacagtaacccagtaaaaattattcccattttacatatgaagaaaatgagrcagagaggtcaacagcttgcacaagttcacacaaagaagtgacatcttaagaaagttaataacaatcaaatgtgaaagtgagtcatcaacttttagttgccctgcagaacaaacaagagagtaactgtgatgtcattggttgacagagccctgtggcagcactcacaatgaaaggaagtggtttccttgcaggttggaggtgtcgcttacaatgtgcaatctttcattaataatgtattttatgattctgtactaaagtccactaattagaattgtgtgccctataaaatyttattgtaaatatatgcccaactgtcaagctatgaagaactcgtaaggatttgtgcttttattaatatgctaatgctagtcttttctgggccttagattctaaagatgagctatcctagctgtcaaagtgcctgctttttaccgagaaacaagtggcttgacaactgagataagactcaaattgtgttttatagccaaaaatacaaaaataactaattttatatcagtggacaatattataatacttatgagcagcggaattgatggtttactgggaagaatttgtacttagaataaccttaaagggcctcttcaggcagttttatgcgatcagcctgaaatatgagttcctaaatgaaatgtattatattgtgggataatgtgttatgtaggcataacttacagccttaagtctggaatttttcaaagtactgttgaacaagctcatactgctggttattatatgtgcatatttttaacattcctattcagtgaaattacagtgactttgactttgtctggtttatgagattaaagtttttaaacaaaattctgttcaaaataataacaatgtccagttcttttagcacatactctttttctcagtagctgyaacactgttttagtacattgcaaaaatagtctccagttaacaaagagctgcatgagctcttttgtattttcatatccgtcgaccttcctgaattctggcatccttcctgccatttgcattaaaatcccttgtgatgattacctcaaaaggtgctgttgctatcagtctgtgtaatttcttagagaatctttctcccttttcagtcatccagctggaaagggcatttgctctgagtataatcgtttatttgtatgagttcaaagttggtaataccatttggcaaacttgttggtctttagaacaattgtcctcctagactctgatttgatacttgaaatgcattgcagggaaaagggacaatcccttaatggagcaggtgtattcctctaggtgggctgatttctaaataagtttgagtgtccttaaagtcctttatgaaggactgaaattcctatttatttaagatcttgatattgtggtgccaattttcagtctgaaacagcccatgaagacttgattagacaaccattgacgctctgcacatgccgtgtaatttacgtagggaactatgtaatagcaaagattccccgcctggcaataaataatcaaaagaagtcatcagattctctatacctgccaatgaaacttttaaaaaaatatgaagaggaacaattcagggcacaagaaccttcaagatagagctaaaaatatttcaggtaggaaggaggattcaactttccttttgactttatatttgtcatgtaaaattttaataaaaataccattagatttttataaaagatcattgttaaattcaaaaggtaaagttgtcaaagtaaaccatttgcgtgataattcttcactttattgtataaatccatataactttacaaagatatattattcatgctatttgtatcttagagaccttttaaaaatgttttgaacttaatttctgtataccttattaccttatgtaattgttcctctaacgtaattaatgctaatagtttgatgttcattatttgacaactttctccatgctcatacagatatatgttcacatatgtacatatatgatagatttttagtgataacttgcacagaaaatgtacataatttacactcttgcatcttattgaacagtatatcattgagtttcttcctctattttctgttggtttattttgttctctatatgtcttcaggcaattctttatttacatgttttatttaataattaaaggattgcagattaaaagtgttcaaagtttacctgtgaatcatagacttgttaagaagtgcttttctcttcattatattctagatagagtataattttgtttccctctttgacccatgaattatttagaagtttcttcattttccaagttgtcaatttcttttcttttcagtatttgtttctaatttttttgtttatgatcagaaaatacgatgagtaaaagtctttaaaaatctgatarcattttctttgtggtcaagtaaaagacccttattaaaggtcaaatgtatttaaaaagctgtgtctttgtgtgagtgtgtctatttatatatgtgtgtatacacacacagacgtgcacaatgtctatattttgtcattcagtcttacttaatcagtctgagtgttatctgtacattggactttttaaagctttccaggtgattctaatatacaaccaaggttaagtatgttgccaaaatgaaataatgggtctagtcaagtggttctcaaaatatggaccatcaacatcacctgggaatttgttggaactgcagattcttgggcctcaccctaagatgtggtcactyagaaactctggggatgggtccagcaatctctttttaaaaaattattttaattagcacataattgtacatattatggggtagaatacgatatatggcacaaaattatttttaattggcacataattgtacatatttatggggtacaatatgatatttcaatacatacacacagtatagaatgatcaaatcagccgttggcatgtatatcaatgcaaacatttataatttctttatgttgggaacattcaaaatcctctcttctagctatttgaaaatatatgctaagttgttaactatggtcatgctatagtgctatcaaatactagaacctatctctccaatctacttgtaatttttaaatgacattctgtcattcttagcaacatggttgagcctagaggacgtatgttaagtgagataagcaatctgggtcttaacaaaccctcaaagggagaggattctacctcacygaagacttgagagccrcttacctatgtcagtggctctacactgagggtgattttgtccccaaagggacatctgacaatgttggagaactcttagaactcttttggttgtcacagctggtgggaggctactggtggcatttagttggtagagggcagggttgtaaacatcctgccatgcacaggacagcccaaaagagaatcacgcagccccaaacatcaacagtgctgctgtggagtaacttacttagactgtactttccaaggcttggcttcccattgcaaccagcgagagagttttttaaagtcctgactccagatctgtttaatgtcattggtgagggtgcacgtaaggatttctaaaaactatccatgtgagtactttatgcagcgacagttgaaaatcactgctgtggacactggttattgatggcaaaaactgcaataacttttgcaccaacttactacctaaaactcttaggtcctaatggatggattagggtgatcccaaactaactgattaaattttatctaaagaaatagacaattatgtacccctgttgtgttataatgggaagtagaaacaccaatttgtgaaatgttcttgccaaaaattcaaacttggacaagcttctagatttctagatctcactaccaatttagaggtatgtgttaaaaaacaccataggaaggctgttggccaaatctagaatgtagaaagtcctcyaggacatatggtacagactgattatcaccaaataaatrgcaagaagggaagacaagagaggaatggggactattctagaataaaagaaacttaagacccctaactgataagtgtatctcttttggaactggatttgaaaaagcaacaggggaaaattaaaaacatctgtgaggcaatttgggaagttcaaacacagactagatatttcataatatcaaataattattttcagagttgcatgtggaggggtaagtagaggttacaggtaaaacgcggttgtccctatgttgatcattgttgatgtcttctgctaggtgtatgcggatttattttaatattctctttacgtatatttgaaacattccacaataaagatagaatgagaaggattatctaaacaggtagggaamggcaggtgagaatggtgttagaaaaactttcaagacaataggagtttccacagtgttaaaaagaaagtaagtctattggatttggtaacatgaaggtcacttgatgactttagcaaagtctgtttcagtggagaaatgggtctggaagcaagattggagcccactggaaactgacaggagtagacatggtattactgctgtctgtgaggcaggataggctttcatgtgtttacataagacagaccctatagagaggaagacagttaacactcaggaaagaaagagggcatgtgcatcagctttggtttccaaaataatctcaaggcgttggtgcagtcatgaatttggatacttacagcaattacttagcattatgtatggcatattaacacattattttgagggttttggaatttgggtgcatgtgatatgcatccaaagaaattccttttttgtgactttttggatattcatattttgatataaattgcagattgctgtgttaaaatattaagaattgtgttcttacatttctttaaaatgctttaaataatctaaaacagaatttggaagtgcaaatatttatatacatatgttgaaataatgatatattaaactatacctaaacttatcacagagtactttcatggacctaagttagatgagtaaggtgaaatctwttcactgggagggagggatgggaagaaacacacacacagagagagagagagagagagagagagaatgaatgagattagagggagaaaatggcaagagagaatatgtttaaatcattgtttattcagggaaaacttaggttgatcactgttactgttattttggttatttttatttccagctatactgtctcctgccaaaaaagtataactttaactgtttactcacaggccatttgcttttctctcctaattagcttcaaaaaattagagtccaaagaatgaaacatgtttaactcacatttgggcttttgtttgtttgttgaaacagaactgttcattatgaaggtggcgctgtgtctgttcatgcacgttccctttggagactagagacgctaagagttgcgtaagtagaacttctaaacacagcctaatgcaccaagtgtaccaaatagctcagcgttgtgcttctgtgtcagcctgtgatgctgaaaactacagcaagcaagcgaacaaaggaaacaccgagaaagtggtggacagtttctcttttgtctatttccttccacctacctttatcattccttakcctcasttcaccagctagcaaacctgagaaataagcaataattttgtacagtctgcttttgtctttagcctcatttgtttttctaacatcatctcatcccagaccatgcatctcttggcagaaatggctactaggacagagtgatgtaagatttggagacacgacaagttctttgcaagcctgtcgcacatctcagatctgacagactgtggatttaaccttctaaaagtacatttaaaacaggaaacttgaacatgagcgtaggacagagtcattactggaagtcactatatttacttaaaaatcacttgatagctaagtacaaatctgcattgcaataaaagtcactgtgtattcattatagtaatgagagtttttatatattaatatttatgaaacataaatgtataaagtatttttttctgatgacttaactgtctgaatatttccttttagttcctgtaaatgaatacaatatgatgataaaggtgtcattttgaactattttaagtagaattaaaatttttaaaaataattcgaagctttagtcctttgcctaaaagcagtaaattttcaatgtgtttacttcctagtatattgggttttaaagactttattgatttaggatgataattgatttgtattgggctttaaagacattattgatttaggataacagactctatgggtgggaatgagggctatcttactctagtataactatatttaattaattaatttatttatttattttgagatggagtcttgctctgtcactcaggctggagtgcagtggcgcgatctcggttcactgcaagctccacctcccgggttcacaccattctcctgcctcagcctcccgagtagctgggactacaggcacctgccaccacgcccagctaatttgttgtatttttagtagagacagggtttaaccgtgttagccaggatggtctcgatctcctgrcctcctgatccaccagcctcggcctcccaaagtgctgggatcacaggtgtgagccaccacgctcggcctagtataactacctttatagacattttattttgagattattgcctgtctaatggtgatgagaatagtttagaggccttcagtcgtttctgctcctgtgtcccatgcaatgattttgaaaaactttgtccattcttgaacactgtgaggttgacatagaaatcctttcattatcagtttagatgcatagaatataacttccagtgtattttaaatagtgatactttaaaataaaatggttacatcacccttttcaaagtatccaattgactgtaagtaatgctgtggtttaatacctttgtttattgaaaatggtcttctttaacaataaaaatatawattattcagtytttccttttcactacatcctactcctctgcaacaaaaatatttatataaattwatttcttatatttcttatgttagtctgtaactttaaaaagctcttctatattgtcattaataactaattgaaaacattaaatgtctttgatataaatgcacaattgatcaaatctacctaaatattaaaacttttggtaactaccaaacttaaaagaaaatttttattggaaatgcatatcataatgagatggaaaaagaagagacagacttctaaggcaaacaaaggaaaactcatagcttttatatattttgtgattattcagataatttaaggaaagggattttaagtattactcatatttttttacattgtgtattataaaaatgaaagagtaaagaagtgtttatacaaattaattgtatacataattactaattatatatgtaattaaattgtcactataagtgcagtttcgagaggttgtattgaccttgtaaaacagattgaatatgtgttttcaaaatttagagacatacctatacttcatgattgagtgcttaaagaaatatttatcttttttgtagagagagaccctacatctgtcttatttttggttaaaaaaaaaacatgaaagcttctgaaaacctgataggactttgtttttattgttatcgatactattgatgagctgtgactacataaatctagattattcttcaaacttctgaattaagtagtcttgatcctgtctctctactgttgcttatgtttgyattttgaaatagaagtttggagtttattttcactttgattacagataatcaatatatagaaaggagatgatcttatggtcagccactggggaaagggaatgctacttgcttctcatagtccagatgtcactgaggggaataccacagagaaggcagagcaggtagtttttcaaccatttagcagcttaaagagagatgttttgttcttctctctgacccttgattaaatttcaccttcctgtctagcagtaggaaagtaggagattcatatgtacggaatatcattattttaagaagtttttcagattatactgactctttaaactactttggctttattgtagatatgtaaattaagctacattcagtttaggagcttttatttttttaattaaatccctttcattctaggaagtttacatgtcttatatgcaatggccacataattactaattttgcattatatttagcaatttatagtgaagatcctgcttttgtttgtgatagaactatattgcctaatgccaatgtttatattcaatatttgggatactcggtcttctcttttctccagtgagatcctatactatatatttgttgtagttgatgtggcccattcattatatattttatactgcatactcttacacatgaaactattgtcaaaagtttttcagtatcatggcctttttaataaatggttttaatgtagggagttaaattgaatagaaaatgctctcctatattttactccaggcaaaattatagggatattgtaagtgagatatgtgttagttcctgtaataggaatactcatggaaataaaaactatgaattacatagagttcaagttctattttttatgttgcaaataaacaaaattaaagggtgacatatcataaagaagtactcactattccccaattccctttgaggtaattttgagtaaatatcgataatacgtagggcacagttttttgatgttaccataggaaattgctttataaaactccattactattgccaattttagtttttactacatatgattttcttgccttgccctctcatttgggaggaggtgggggtctgggcatgtgagaccaggctagtttgagtggctggaaatgaaagcaaatgtgcttagacttagactatgcagtggttttgccaaaaactggccacattcattccatttctaccagaatcctcttagagacttcaaaggagcactggtacatatgagttctattgaatagaactgagcccagaacatcttccagatacgctagcaaatagtatatatctggttaaaattttgtgctgttttgaaaatgaaggtgtgttccatgatgattaagatgaattgttattcagaagtgattcattatttacaaatatttcattgtttttccaaataatggaaacaaatattaaacatatttccaaatatttcattgtttttcaaataatggaaacaaatattaaacataattgtgaccgggcacagggtggctcacgcctgtaatcccatcactttgggaggctgaggcgggcagatcacaaggtcaggagatcgagaccatcctggctaacatgatgaaaccccgtctctactgaaaatacaaaagttagccgggcgcggtggctggcgcctatagtcctggctactcgggaggctggggctagagaatcgcttgaacccgggaggcggagtttacagtgagccaagatcgcgccactgtactccagcctgggtgacagagcgagactccgtctcaaaataaaaataatagtaataataataataatgataattgtggttttcatagtatttgcaaacaatacacttaattttataagaggaggattttaaaaagcttgtttatttccaaaatagaaatactttaatgtgctattattggtaacaaactttaatttcatcttaagacaataccgtgttatctggttttattagtatacggttattaacttaattggggggcttcccaaattaattgtctttataaacaaattcatgtgaaaatgaacttgttataacattctactgctaattttctatgctaacatctcaagtcaaaaatccaggttaggaaaacaacattaaattgatttataatttactaaaagattgctagctttgaamcaagtactctcaatttgtagaacacaaacatttttaataagtctgtatgaacccaagtttattaaataataagattatattgaaaatctccatatatttactttttctttgactcattgtattttgacaaaatcatccagtgtaaactgtcttttaaaaaattatccttatgtttcattttctgcttgttgttgacatatgaagctttacaacattcattatttttagagtatacactttttcttcataacatatctggctgtataccttttgtgctttttggccttgaattggaattatctaatatcaaatttgtcatttccttttgaggtttatttgcttgttgaatcttttctactcattcgtttttagttttcttgcgtgctttgatcttaagcttgtgtcttatcaatgatatatatggcctgtcctcactttgcatggtacggtgttaagggaaagtcatgcacgatagaactgtgccatcactctgcaccttagcatggttaaagctcctaaatacacaaccttcagttaacaaggtaatgtgcaaagcaagaacagcttgtattttgatttttctattttatcctacctgaaagtcatttatttatttttaatatacaagtgataatcgtacatacttatggggtacatagtgatgttttgatacaggtaatgtatagtgatcagatcaattagcatatccatcatctcaaacgtttatcatttctgcgcattaacaacattcagtatccttcaaagcaaatttttaatgatcataacttatcattttactgaaacattctatattttctgtttattacattttttcctgacttttttagaattttcattttcttggcttatcttttttgttcatcgcgttctaataatataattgttccacaatattaaaatgtaaagtataagaatacatttcttttgtcaggtaaatatagtctaactatagacttcagtttatatatatgagttccaattaatcatacttagacgttgaccacaatactactgtttttcaagtctgtgcaaatacagcaacagtttttaactagtaaatgctaaaatattacttggagttatacttcctgcattatttgcattagagcttgactaatctgtattagagggtgacttggagcacaagttctttgttatctttgcatagaatagggcgctgtgtggatggtacggcatttaagtcagaacaccttgagttacatttaacttcttcttactataagctttgcgactttgtgtattacttatcattctgaatagccattttgttatttgtgaaatgaaattaatatcactaatatcctaagttttttgagaacattaagacaatatatatgactgttcattgtccgacatatgttttaatagctactccttctgtgattgtgggtgctattggatcaagtcctaactgttttcattaggtggagtggaagccacataagatggggacagccattccgactacgccatgtcacaacaggaaaatacttgagtctcatggaagacaaaaaccttctactcatggacaaagagaaagctgatgtaaaatcaacagcatttaccttccggtcttccaaggtgagacagaaaatattttgggtttcctataaatgttacccggtcatatttcctttgatgttagaaaggagaaaagaaatgagaaaataaatgatgtaagtatgtcttatgtgtatttctaaattcccagtttctcttccatacattcctctctggtaaaactgacttttctaaaccattaaaacctgcctatagaaacaatctaaatgtacaataaagggtaatgattacataaagggtaatgattgcataaatcatactgtatacatacatattgggatagtatgaagctgtcaaaaatataaaacatgaaaatacctattatacgtcatcaaatgaaaggtgtttcatgtcgtttacagttcttaaaacacatccatccagctccttcctgttttcttaagcattgacagtatacagtgaccacagatattgggatgtttttgggttacagtgtgaggataaagcacactggaatctgtgtctcaaagatacatttatacatccattcttatatgcggaccttcatccttaaccctattgaatcatttttatgataattgctatattcgtccattttcacagtgctataaagaaatacctgagactgggtgatttataatgaaaaggagtttaattgacttatacttccgcatggctgggaaggcctcaggaaacttacaatcatgacagaaggggaagcaggcaggtcttacatggaggcaggtgagagagagagcaggagagtgagtgtgaaggagaaagcgtcaaacacttaaaaaaaccatcaggtctcacgagaactcactcactgtcaggggaacagcatgggggaaactcgccccatgatccagtcacgtctttccctcgagacgtggagattacaaattgagatgagatttgggtggggacacagagccaaaccatatcaattgcatatttctgttcataatttaatgaagattgtgaaacttgggaaagatgattggaacaatattaaactactaactagctttcatcttagaaaggcaaaactttgttcttttaaatagataaagatttgactttgtatttctgcaattactacatactcatctaggtataggcatcttcacagtgttattcagggctcattgaaaagaaaaaaacgtattactttgttttttcactgctaggaaattcttagtattcaatcgcctttcccatattttgtatgctggcccaattcaagttggatttttgataacaatgttattagatgaggaaaagatgttaagtaccatgtataatatattcaaaacaaggtcatgatttggcttagtagaactacaatacatgcactacaatgctttttcaatactggattaggtttaaatttttactttgcccctctctagagatctatatgttaggtaaaatcttctaaatattttacaagcattaacaaatgattatttcctatttaggtaaagcgtttaccctaaaagaccaattttctgtatgcttaataaattccattttattaatcttataatggtgtcctgtcacagcataggattggcagcataaacataaatatttattgaactttgaaggtgtcccacagaacttctatttgcagttgtcactggaggccactgaccactttatttctacagtaggtctatggcctggattgctccagtgagtgcaggaaatagagaacattaattttgctaattatgaaaataaactatttcactatactcttaataatgtatttcatataaataatgtctaacaagaaaacatattcattatttagagtgataattgtaacaaaattaaaagtagttatttacaactacttaaaagttttttagtgctttaatcatatttcatttcttctgattttgaaagcagtacatgttggtctttgaaagtttagaaaatacaaaaaaaagtaggagtaagaactacctaattatgcagaatatcaacgttttgatgaatttccttcctaatcatttttcttttgctgtgtaaacgcacacaaccttgcaacatggggatatagggatcaccaacacccctcccccatgcaattgaaatctacattttgactctccaaaaacttaactactataaagaaggctgggtgtggtggcttacacctgtaatcccagcactttgggaggccgaggcaggtgaatctgaccaacatggtgaaacctcgtctctactaaaaatacaaaaattagtcgggcgtggtgacatgtgcctgcagtcccagctactcgggaagctgaggcaggagaatcgcttgaactcgggaggcagaggatgcagttagctgagatcgtgccactgcagtccagcctgggcgatagagcaagactctgtctcaaaaaaaaaaagctataaggaagataaaatatattttctatgccttaggtggaagtggaccatcaacaaaattggtccttgttttcatgttgtgtaggctgaggaggaggaggaggaagaagaggggctggtcttgttgtcttaggggtggcagagatgaaggaaaatgcatgtataagtggacctgcacagtccaaatacatgtcgttcaagaatcaactgtacattacaaaatatgactatagtttggtgttctgctttcatttgaggatgtatagtaggtatttttatattttatatttttgacagattcatactatcccaatatgtatgtatacactctgatttatgcgatcattattctttatgtaatcattaccctttattgtacatttaggttgtttctatagttatatacatatattcatatatatatattattataaataaaactcaaaccaaaataaggtgtggggagaccagaagtaattctgaaaagrcagtatcctgaatgaacattcccaatgcctttctctttcaactcctgttctgggttataccgaatggtagcagatgcctctgattctatgagttaactggagagctccaggaaagacagtcagggtaggtctttattctccattgtgaaaatagagaggcacagctggtaaaacctcattatccttgcaaagcatctgtatctatatatttgctctgtggactcttagagggcctctacagtgggccagaattgctccttgtctctgtaactggaaagcacaattaatcccattatggggacatgggcttctttcttaaatctagctagcagaggggtgggaatttgctagtttatctactgatagcacctccgtccagaaagaaaaaagttcaacccactaaagaagaaccaattatttgatggtagaaacccttttcaagtaaagaaggtggtacctattaaaatggcattcagcttattgacaataaattagaaaaactagaagaaattgayatccttccagcaaaatataacatacccaaataaaatctcgaagaagtagaaaaacatgaacyggtacatcacagtggaagacattggaatgatttgccaaatttgagtattttaaaaagctgggagtctgtggtgggaggatctcttgagctcaggartttgtggctgcaatgagctatgatcatgcccactgcattccagcctgggcaacacagtgagaccaagactttatagaaaaactaaaaataaaaaaattaacaggcagaatacatctaacgaaaattggaggaaaaagaggaagagtgaaaggtacggtaggtgctccagttgccttctatgaaacaaacatcaaagatcttcttaagattgaaaactcaagtaatggaagcataaatacttaacagccaaaaaggaaacactcaaatataataccatttactaaaacaagatgatggaagagagaaaagttggtgagagaaagaggaacacgctaccttcttcatcatgcgtaatccagcctaataaaaagaagtaaagtgttactaaagagtcagagacataaacacagatgcaggcatgcagacaatgaggaaaatgagaccacagagcgaatggctctaaaaaaaggtatgaaaacagaaaacctaaaatatgacacagtgaaaacctaaaatatggcccactctatttgcttatcaatatatataaatggactgtatcacaatttaaaattaaaataatttcatatttgggcatgcagcataaattatgctgacattaagaggcacatctaaaacaactttatttggaaagattggaaataaaaagatggctagtggaataccaagaaaatacaaacaggccaggtgcggtggctcactcccagcactttgggagaccaaggcaggtggatcacttgaggtcaagagttcgagaccaacctggccaacacagtgaaaccctgtctctactaaaaatacaaaaattagctaggcgtggtggcatgcacctgtaatcccagctgcttgggaggctgagggaggagaattgcctgaacctgggaggcagaggttgcagtgagcctaaattgtgccactgcactccagcctgggcaacagagcaagactctgcctcaaaaaaaaaaaaaaaaaaaaaaaaaaaaagatatctgttcttaatatcagatgaggtggaattcaggcaaactaaagcattgcaggagacaaaaaaggatattgcatggtattgaagagtgcaagatagtattcgtaaaacaataaaaagtgggcaaggaatatgaacagacacttttcaaaagaagatatttatgtggccaagaaacatgaaaaaaagctcaacatcactgatcattagataaatgcaaatcaaaaccacaatgagataccaactcataccagtcaaaatggtgattattaaaaagtcaagaaacaacagatgctggtgaggctgtggagaaacaggaacgcttttacattgttgttgggaatataaattagctcaaccattgtggacgacagtgtggtgattcctcaaggatctagaaccagaaatacaatttgacccagcgatcccattactgggtatatacccaaaggaatataaatcagtctattataaagatatacatatacctgtttattgcagcactattcacaatagcaaagacatggaataaacccaaatgcccatcaatgatagaccagataaagaaaatgtggtacatacaccatggaacactatgcagccacaaaaaggaatgagataatgtcctttgaagggacatggatgaagctggaaaccatcatcctcagcaaactaacacaggaacagaaaaccaagtgctacatgttctcactcataagtgggagytgaacagtgagaacacatggacacaggaaggggaacatcacacaccagggcctctcggtggggcgggggtgcaaggggagggagagcatcaggactaatagctaatgcatgtggggcgtaaaacctagatgatgggttgataggtgccgcaaaccaccatggcacacttatacctatgtaacaaacttgcacattctgcacatgtatcctggaacattaaaaaaaaaaaatacaagtcactgaagttgtaagttgttaaatttacataacaaataaatatagggtagtactagtatttataaaacaaaatctccaggagctacgaggagaaacaaacagaaaatcttagtattaggagatatcaagtcaccttttctcagttcatgatacgcacacacaccacacacctcacaccactgagggctttatggtgtgtggagagctgccgcagaagccctacccttaattggacattcattttgttcactcaggaatattgcagggctgacttgagcgggactgggaactgggaacatgccaacagttagtgccctcagagcttgggagggtgttcaggaagcagggaccctgtcctcccacactccttggctttttaaataaaagaattgctgccattctgtgattccttgtaagtcagccaacagagctgagcattctctctagttgatctcactgagtatcaggacccccattttacagatggggaaaaccaacgcagggaggatgagtcacttgaccaagtggcagggctaggaacacagaagaatcggtggacacagggttatctctgcaccaaaacaactggccagggtggggtggttacatataactgggctgtagctttccaggctggctggttcactcattcagttcaccccaggctgtaaggactgccatgggagcctgaggcagatgcttgtcctgtcagggcctcacccagctaaagtgtcaccccacccctccacagactgctgcctgaccctgtgtctaactgtgatctctcaaaatcctccctttcctgcagaaagctgaatagagtccatctttctcatttgattctttctctagtaatcctaatcctcctggaggttgatgaatgcctgtgacaaagcaggtgattcacatggaaatggaaatgcaaaaagggaaaagtatattaacatacttcaaaaatattcttacttatatagcctttcatctgttgatctatgtatttttaagttgtggttgggggtgggagggtactgtcttagaaaaataaagtgaaaacttgtaggtaaaaatatacgtgcaagttaatttcatctttctttgtcatgccaaaaaaatggaaaagtcacacatttgcaataaagattattctatatctataatattaaatggtattagctgtcaaaatatattaatctggaaagatattcttgtaaatattgttgaataaaacaacattttattggaagtatttttcatggctatctttccagatcaatatatatcaatatattgttatatatatttccagatcaatatatattgttaggtatataacatatataacattcatatatataacatatatgacatctatataacatataacatatatagtcatatgttttatatgttatatccataacatatgttatatgcataacaatatatgttgaatatgttatatacataatatatattgatctggagatatgtataacaatatattgatctggaaaaatatccatgaaaatattgttcagtaaaatattgttttactcaacattttgagttgtaaattgtaatataggtattgcaaatcttatgatagattttaatgtaatctattgttgtaatattaaaggtattacaaatatttttgtaattaaaaagaaatcttcatacttgtgtttgtatatgattttatggtagttgtggaaggatatacactaatcatttaactcacagtattttagaaagatcaaaatggaagctgtatgagaatatgaagacagagagaaattttttctttaacttaaaaaatgtatctctggattattttggctattacaatagtcatatttattttacaatgaaatcagttaaagataaaaaccattgcactgacattctgggacataagttctgtgcacatttttgatttgtttatttaggatggattcctacaaatggaaatagtgacttaaaagctgtgaatatttttgaatgttcttgatagagattgcccaaagcaatagcttttgaaacctttttctctgaatatccctcctaatattctctccatgttagaatagggctcatatttgaggacttttgactctccagatccttctgtgatttctgctyagggattctgtttctggaatttggcaattgtgtaatgtcacaggttgcatggaggtagagaggccgaagagcccaactcaactcttctttaactgagcaatttagtttctctgaagctactttcctgcctggtgttcatggaaccactcgagtgtacaggttaataacgcttccatgcttccagccacttcattcatacaggtaatttcatatgatgaagtggttgaaggcagtgaaagtgaaggtgagatttcaagagaaatattttttaatcacagtatatttttaattttagtatcactggaagattagataataaattttttcccatgaactagagacamtaactcttccaattatttcttttaaaatgacttcttctattatatatttaatgcatagtcattacagaaaaatgtaaaggtagtacaaagatggagaaaggagaaaagtaaatccatcactcagaaacaacctcttgtgtgtatttgagttgtaagcaaatattacatattttgatgatgaacagtgttaattatatatgattttgggcctaatttttatttaataacatatactactatattctttaatagaatttggcaataattcaacatcttattacatagatttatcataattcatgcagctactttattatatttgaatatttagcttattttcaatttttcacttttaagctgaatatttttatctctgaatatttctatatattgctgactacttcttttttggaagttgtactatttggtctaaaaatgtgaagatttcaagtgtttggtactggaggctctcagagggcagaacagtatctgttttgttcaccatggatagtgcagtgcctgacacttagtggggattgctaaatgtccctagtgagtgaatgcacctggccaaagtactcttcagaactttgcaccagtatttattctaagcagcagggtatgaaactttacatttctgtgcgactcatcaacagatgattttaaaatctgataattttgatagatgaaaaatcagttatatcttattttatattctgtgagtaagttaacctctttaactgtaaagctcctatcattttagaagcaaattataatgatttagtattcccatgaatgaaacaaatgccacagtaagcaatttttagcaaatggyyttttttttttatwcatttcttggaacgcatgtggcttttacaagcagatgaatttgaattttcctkcccttcattccatgtatcccagagcaatgactttaggctttttttwaaaaaaaatgccttttacagtttaatctcgagtgtacttcagattattcaaggcatttaatatatcttaaatatatatgcatctcmtaatatttcaaatgagctccgaatcataacttgtagggacagaaacagaatcaataayaacaatatgttttcaattgggaacttctgaatgtacyagcaaagctactctaagactgggcataaatatattcagttgggaatggaaagaaaattcttattatctggtgagtcgaagtggtatagggggatttgattctcctgactcagtcttctctgggaagggaagggatggasattttttatgcccacttccaaattcttcgaaattctgctcawgtcctaacttgagctttctgtaatcatggttagtgtctttccaattagggctgtctctggatattacaaatttggaatttaaaaaatgacttttgtttacaacaatgcctgacatccaagactatagtctggagctggtgattcaaattcctatttcgttggttaaaagtagagcagtggtgtctttttcttacatctgtttttctgtcatcactatcattatcatcagcatcattttcttaaagcaaattaatgcttctggataacytacttcctttagaatgcacaatactctttttgttgtttttttttttttaccactgtattttaaattttctaattcttagatccctgattttcagaagtttgtagataccaataactttataagaggagagctataatttaaataaatttaattaaaactatctgctaattaaaatgtttaggtgactgtgtgtgggggggggtatcttaaagaaaagaacaaattagtgtgtgattcttgtgtaatattttacccaattttgattggtagaaaattggttttaaaatagaaggcatttctgatactagaaaagtagttaaaatccagctacaaggtacagaaaaaagggctgtggaactaacataatttgatagtttagtttcatttaaaataagttacaaagcacaaataggtatctcaggaaaaaataaatggcacagaaacacatatctaaaactacactcacatatacagacgtgaaaaattagagtaatygatagtgctgattwtatttataatagaatcttgttttgattggaagcccaatgacataaaaatccattcatgctgaaaagtattttctgcaattatataataaagcagcattgaacttataattattgaaacacaataaaaagagaccttgattaaagatgaaaatatatatatttttaagatattgtttcacattgtcaacatttcagagaaaatagaatagctcaacagattcacttaatccctttgttagtcatcacatttgatcatggtctctgttctttaaaatacatattggattcacttaaaggtatatttgatactttttccccacctcagtgttactggtaggttgaaaattcttgccctctctttacatacttctgccacatttcccatgaagaagagttatactgtggaaggcaaacactttttaaaaaatgacgtaacatatatcttagaccttagatcttagacatgtatcttctaccatatttcccatgaagagtacttacattatgaaaggyaaacacttaaaaaaaatgatgtaacatatatcttagacctgaggtatactttgagtatgcaatagtgaactgactgctggttgacataattactgtgttgcaaatcaagatttattactgatggaaaatcaaacttttctaggtcrgttgcaaatctcagctttcatctgggtttaggagttttggttttgaaattctgaaaagaaaatcaattcttgtgaacccttgcatttacctgagcagtcccttacccctaactgtgtgagacggtattgaaagtataagtacatttggaagattttataaatcattaagatcattttaactttagattttaaaggtgagactggctttaaaattccatgttgctagttgacataaggagcatttcctcaattgtcattggggtgtctttgacagtaatgtgaacattcaccagccagtctcaaatacaggatttgagggaagaatcaacaattgctggcaaccctatatattcagaaaaaaactgaataaaataggaaatcatttataatgtaacctactttggttttcttttaaggaaaatatcttacataacgaagaatgctatttgataaatgtagattttcttagaaatattcttcactttctctattcctagaagttgtaaccattgttttcaagtgtgttgaaatgtttgttttaatcataaggcaggtcttgccaatcatatgtgtatccaatccccaaccctccagataaaattttttagcttaaaatgccactgaaacatttctctgtaggcgatttcctctggtttttcctccctgtgtacaatgaatagaagtcttttgctatggaaatgatggaataacagtttcaaataagactgtcaatgagattacaagaattgtggaacaaatgtaaaatataaaactttttttttgagacagagtctctcgctctgtcactcagactggagtgcagtggcaagatcttggctcactgcaacctccacctcccaggttcaagcaattctcccacctcagcctcccaagtagctgggactataggcatgcaccatcacacccagcaaatttttgtagttttagtagagacggggtttcgccatgttgcccaggctggtcttgaactcctgagctcaagtgatctgcctgcctyggcctcccaaaatgctggggttacccaggcatgtgctacgatgccagactaaaacattttaaagacatttttactatattatttttatctggattttttatttttcattcagaatatgtttcagaygttttaaaatgtacactttcacacagtgaaaataaaggtagaggtgaataacttactatgtgtcaaacaatgtgctgagcacctttcatgcattatcttatttaatcctaacacaactgtatggagttaagatgctgtttttttatctttattatgcagttgaggaaactgaggcttagacaagttatgtggcagaaccaaacttaactacatagtaagactaaaaccctctttagtaagaaaactaaagattttataaagaacttgtaattttttttcttatcaaaacagttatacaaagttacccatggagatgaattttgcatttacttgggattaaattcaaaagaaatttttgcagtagtcttttctcaaggggcattgatacactgataaaatagtgccaattatggttttacagaagatagagaaattcagttayagttgtatgctggtcttttttaacgactgtaagaacgagaatgaacccattgaagccttctgtgattaacatatcataatttgatagtttagttttatttaaactaagttacaaaacacaagtggttgtctcaggaaaaaatagatgacacagaaatacatatctaaagctacattctcatatatggaaacattgtgacgaattagagtaatcaatcagggttcagccagagatgcagaaccagtggagatatgtatatattaaggcatttattatataggtttgcttaatgagattgtgagggctgggtaagtaagcctgacacctgccgtgcaagtggtctggccaggatgattatgatcaggctggaatccttaggcatgggctgatgctgttggccacaggtggtraggaagagagaaccaagagcagggtagagtcccatggaaactagctgtagtttatgtgctcagggaaagcctgaaccctttgaaagagctcacctggttaagtatcatccaccttggataatctctcgtttgatttactcrtagtcaattgataaggaaccttaattacctctacaagatcccttgacctttgccatctaaggtaacctcattgcaggagtgatatcctgttctattcattggtcccacgcacactctaggggagggtattgtacggggtgttagagggctgttatttaggcastgtgaccttaagctttgtggctacggctgtggaagcccctcatagaccccttcagcatgagaaactttaaaaatcctttctttccacaaactcacttaccagagtaacttctcctgagaagccgagggataatgtgtgattttccttttttttttttttttttttttttgcatttctgtcctggaagggctaactaagcctggcctggcctgtcagtaccagtcgtttctcttaccacgtaacatttttagactttcttttcacagtgaccaactattctgggctgcagtgcggcaccataaaggagcaaataaaaaaattmttttgactttttaatttttttctaactttaatcattatttgtcttaaagagacctggctattaagaaatcaataaaaactccatcatctgaggatctattagttacctgatagagtaatttggatagacatacggatgattttaactatgctagaagaattcctctgaaccgcatgctctgtattataagaaataattctataggactagttttagtcttttactgagtctagttttatatatctagtatgtatatatcacttagtatatctatgtgtataaggccacagttcttcagaaataggtatggcttcattatgagtcaggttggtatacccaatgccaaatattacttaatacttttcagaccaatcgtttttacatctgggtctattttatttatttattttttatttttattttatttttttgagatggactctggctctgttgcccaggctggagtgcactggcgcaatctcggctcactgcaagctctgcctcctgggttcacgccattctcctgcctcagcctcccaagtagctgggactacaggcacccgccaycacgcycagctaattttttattttattttatttttagtagagatggggtttcaccgtgttagccaggatggtcttgatctcctgacctcatgatccgcccacctcggcctcctaaagtgctgggattacaggcgtgagccaccgcgcccagccacatctgggtctattttaatattcatttgaaaattagatgttccaagcacttacgaatgggattatttgaatgctcataatgggagtagtttgtcagcacagtttttatgggaaatctgaagggatttccagaaattcatcaaggatctgacatttgcaggctgttctggtcctgaggttatgtggggtcaggctggaggaatcagacataygattcctgctgtcaaaaaggtgaatgatagtcaagtggaaagaagacaattgaggaacagttttaacaaagtgccaacatttccctgatagtgaaagtacaacatgctatgagagtacatgaatgaaaagagaaaatatccatacgcacctcttagactgaaaaagcagtgcttgcaataattctagactgtgctgaaaagagtcattttatctttgagtatttttatagctcttaaggtctcaagattattcttgcaggatagaagactataaaagttaaaaatttacaggttttaatgaataagataatgcttataagataatgctaagattaggaggatcttgacattttcttgattaaatgtaggaggcataggaattaaattttatatagtcttttgarggaggtttccatttaatagcaaaatacttaagctagagtgttttaatggcaatctgatctacaagattgaaaaatttctactgattaacttttaatttcattaactcttttttatacaattccaatctgatgctaagctgacccagttaattttgtatttaaattattttcatttttctatttcatttatttttgtgatgtataatttagctctattcattatgtatgtgttttcctttatatttttgaacatattttatatttataatagttgctgtaaagtcctcgtctgctagttgtaggatctgggccatctttgcattgatttgtattgcctatactcttgttgtttttgtttttccaaaaaatatagctcacatttctagtttctttgtatctgcttatttttgacagtatattggatattgggaatgatatgtagtagaggctctgaatttcaagtttttttctgaagagtgattttggttttgcaggcagttaacyttgttgggttgaaacttcagttttctctcttttacatgaggagttgcttatatttttactcaaatctttcagcttccatctgttgccattatactggactttcctccagcatacatagtcagcagaatttggataatttttttacaaagattttgtagataactttgtgtccaggatttagcccatctaattattttgttgcttgtggtccctgaagcatatcctctgatacctcaagcccataaagcagcagattgctgctgccagagtagcagacagattgggcactgcatgccccaaggcaaaaggcagccacctaccaatcacgcaaggtgctrtttgtcttttgagagatctacttttcaatttcttcctgcttttggtccaagtgcctttaagtcaattcttaaaaggattttttccaaattttataatagtttctataggagaattcactccagtgaattacttcatcattttccaaagtagaacaactcaaaagaaaaataaaatttaaaagctgatgccaaaattaaggccattaatatagatatggtacagctaatacagagttttagtaagattattacttgcctaatctgagcactttatttccagtaatacaggctactattctgttggatgcttttactagatgtcacatttgttgttcatgctgtacttcagcttacggtcattcaaaggatctagattattttcatctgaatttctcctaagcctgagctacagaaaatgacaggagataaagaaggaaagaacatggatggcctttggtctttcattcagcaagtgttctcacttattttttctaatgtaacttcagcattttttacctcactcaagggtcayagtaattattaaaacagtcatcggcygggagcggtggctcacacctgtaatccctgccctttgggaggccgaggtgggtggatcacctgagttcaggcgtttaagactagcctcaccaacatggtgcartctgtctctactaaaaatacaaaaattagcagggtgtggtggtgggcgcctgtcgtcccrgctactcgggaggctgagacagcagaattgcttggaaccaggaggctgaggttacagtgagctgagactgtgccactgcattccagcctgggtgacagagaaagactccatctcaaaaaaaaaaaaatcatcatcacgatatttcacaattaaatcttctaatccagagacggatgtgaaatacatcaataaaatacaaagaaagcataatttcacaattaatgtttacgtgacttcttaatatataatccatgcacccataaatagtctagacacaaaccaatttgcttgaagaaaagaccaaaaaaaaaaatgttagaggctcactgttctattctgaagagataattacagtgttctatttttatcacagaatttaatttttctattgacagggttggtaaaagtagattagtagtttatctaggttgatagaatgaaattggaatggttttattgtctgttttattacagatacttagaatagtgtttcaggttatttgcataatgattgaatcaacttaattgataattatatattttcttagttgaccttgacattttgtgttaaaaatttcaactcattttaattttaattttcaattgtttatggagtgttcataatcattttcaggtcattaattattaatacattatgcaaatgacatgaaaaatctgttaaaccttggggttattttaaaattgttcgtttttgtttagcagacatacattttactctgactgaatcttcaaaacattcgtttaactataattctaaataaaagtcataagaccaaagacatagaagacacgtaaagtaaattaacaaggaaggttagaccaaggaagaaaaaagaataagagactaaagaaaggaggtacctttggctttttcattgctgctttagggactgtacaggactttaagacatagtgagttcctgaagatcacagctatgcatgggaggaaaaatggaaagagtatgttggaggaggaagtgctgacataaacagagatttgaaaaaaacatttggctggtgtcagaggatggattgctacttcctaggagaggaagcttggcatagtagtcctttaagagtgaatacctctgtagtctgagttggaaattgcagtagtagaaactgaattttagctttgattagttcaaaataaataatcattttaataggttcattaacaatcrttgtcaccgttattattgtcaaagttgtcaaaaaattttgaagtgtttatcccggggacactattctgaaatctacatgcattatcttaatttttttttgatcctatggagaggtaccttattagctttatttatggatgagaaaactgaggcttaaaaggtttaattaacttgctaacatcttagaggtaatgagtggcagaggctggactcaaaaytaaatctctctgtcccccaaatctatgctcttaatcactaataatgaaaaaaaaaatccacaaaaacccaggaagtatgtttagcttaactactgattttaagatctctggtttggagttggccattatgcaacataaaatttaaaaattttacattatggcaaaaatagtgttttaccaatgtgaataattcaagcataagttagaggtcgaactgttagagtaaaatatttggccattatttcaggggacttcagagggctgaatttttcaaggaacatatttgcaataaggcaaaattctattgccatacactagtatttttgaaatgtttactgacctttttttcctcctctccccttaggaaaaattggatgtaggggtgagaaaagaagtagatggcatgggaacatctgaaataaaatacggtgactcagtatgctatatacaacatgtagacacaggcctatggcttacttaccagtctgtggacgtgaaatccgtgagaatgggatctatacaacgtaaggtaaggtgatagaaaaaaacataatttatagaagtaattttttatgaatacacaagcacaagtcaaaaataattggctgatctttttagtcacctgcaaaagttcataattttgcaagtgaaagggcagattccactgtaatagactctttagctttgtaaagtgaacagagttggatgttacatcactcatatataggattatgggatgcgtgcatttaaatatgaagtgaagaaatatacagtgccgtcttctggattctagtttagtaccgttcactttgtcctccatgctgtgacaaagtccgttactgacatccccttgcttacaggaagaggcccactttttgaggtccccagaagccaacaagccagaaattaaactaaacacaatctaaggagggggcggggtcagaaaggaaaggaagagttaaaggtgtgtaattgtgacttattctgtcttcattactagactctgagattggaaccaagtctttgatttatgtatattcagcatctagcagagtgctgaaaccatagtaggtgctcaataaatgtttcttgaatgaaaacatgtattttcaaggatgtggagttataattgagttggtgagattgcccatgcacctgctaacttggtcttcaactgcattagctttgcagaattatgagccagggtgagctgggttagcattctcaaggtgaacacctaatgttgtcgaaattgtggcagaagaggttgatttggctttaaagcaaatttttcttttgataatgacgtttggtcatggttcttctactagatttagcagatgttatctttttctttttttcttaatattttacttataaaaatttcaactataaaaaagttaaaagactaaaccaataaccatccacatacccttgaattagagtcaacaattattatagttagccagatttgctttcctttcctcctgtctttcttttctctgtgtgtgtgtatgcagtcagacatccacagtacagttacatagcattaaggtaattctattacatcattgactatcctgtttgtattcatatttattctgttatctcaataatatcttttctagttgattaaaatcaggatgcaatcaaaattcatgcacttatttatttttatgcctttcagtctcttttaatgtagaacaaattctcagcttatttttttcctgtagcatcgagtttttaaaaaatccatgccagttatagaatgcctcatgttctggatgtgtctgactttttttccccattgcctatgctcttggtaattcccatgaacttgcagctaggtataaggctgtgctgtccaaatcagtaactgctagacacatgtggcaatttggtatttgtatataactcgaactagatgaacacaatttttagttttgtttaactttaattaaattttaaaaacgcacacttaaattgttggaaaacttttatgtatgtttggaacaagttgggtatgtgaatctacttttccaaccatgtctttggttcctgttttcgtgccattttagtctgctggtttctttctcaggaacatggctgtctttcctcacagtgttctccctgaccttttctctacacttcgcttctcaagtgtgtcttccaaagtactcatttttttctttggtgctgttctgttcgtaagccctttctgtacctttaaaattttagttttcatgctttttttttcttgtcyttatctcacccagctcacctttttatctcagcttgctgttctttcatctggtctgctggtttattatctcagcatattttcccattgtgaatttccactcctattttatcgaagtcgtaacttgcatcctgaggacagttgaaattgtttttatgtttaagtagcctcctgctatttcaattttacttagctttttaaaaatagcaatgattactgaattttattaataaagaagataaaaatcatgtgttgtgtcttttaacttgttgataaaataactaagttaccagacctccaattattaaagagttcttaaattcacagagtaaaccctacttgaccatagtgtatgattcttttgaaattctactagatttaattaattaatatgttattcagaattattacatgtatatttacgggggaagttaatttctctttatggacattgaattttgaatttcatacaatctttgtgtttattaatttttatgtgtcacaaaacaccattctactctggtctttttttcaaccatttaaaaatgtaaacaccattcttagctcatgggctatacggaaacaggtgatgtgctgtagtttgccaatccttggtctagactagtctgccatgaaaggtagctgttctttgaaactttatcacagctcacctgtgaaaccagctggtcctaggtcttttaaatattgtatattaaattatcttttcaatccttttctaaagaaactggtcaaatagagttggattccttttgattagtcttatttggctaaaaatctattctattcccctggaatacccagttttgtttggttggttgatttttggktttgccatggagttgcacacagtattgtattattgtaatttcccattctttgtgtttttactttctgttttatctttagcctggttkgtgagagctttgttttatttatcatcacaaggaatcaaattttgagtttataaatcttttctagtactttatttgacttctagtttagtaatttcacttaatcttcattagttccacttttcaactctctttgcygttctatttttaggacatgaaaaccgcaagttctttcattttagtcattcttttctttattaatcagggcacttaaggctataatattttgcctttgaatatagatatatctgtgtctcactcattttttatataaggagtttcctctttacattgctttctagataatttatagttccagttcctagatttagttcagtacacctgggtaggtgtattaaattatcttgctataaatgttgaatgaagataagcacagatgggaacaaacggttctacttatatatagtacacaactgatctgtgctgtcaaaagtctgcaaggtggtgaaccttgtgaaggatagggataggaagagagcactaaggaggattttgagataccgtaatgttttctttcttgagctgggtgttggtcatgcaggaatgttcacttgtgaaaatcatggaactgttttcttaagatttttgcatttctctttcctaacattatagtttcatagaaagttcaaaaacaaaaaactatcaaaagaaaagaaatatatgtatacatttttatcatttagatgatttataagcattgttcagtgcttattattgaccagtctatgttcagaactactgtatgactggtgtgccagtgcaacgttagctttgctgctttgtaccaagtttgcttaggctgaggatcagtcgttcaatgtagatatgtgaaaaggctctgctgtttgttttactcgactcattgcattttttgagtagttctttaaaatgataactgagatgggcaaggtgatgggggcttgtaattctagctattcaggaggcagagggagaaggatcactgaagcccaggagttcaagaccagcctgggcaacatagcaagaccccatctcaaaaaaatgaagtaataactaaatgaataaatggaatggctaatttgtatagggagctgtgcatatgattttatctgaacgtaacagcttcacagtcccctgtacctgccttttgattctatctgttgttatggctcagctgtttgagtacacatctccctaactctagtttggaaaagagacgttgggagtaatggccttatttttgctttcttacaggctattatgcatcatgaaggccacatggatgatggcataagtttgtcgagatcccagcatgaagaatcacgcacagcccgagttatccggagcacagtcttccttttcaatagatttataaggtactttttcttttgtaggcgtagttgtttgatacttcattttcatttctttattggatatgcaaatagacaatttaaaagtatgctatgatggtaataaatctcatactgtttggtaagtcagcagaaacgttaggaagtgttaatgagatgatttaatgtctttcttttaaataaacttttaaaaagaatatggttttggaaattggatgtgtaatttgtaattgataggtatagattaggatgatttaatgactacttttccttgtactgaacctatttagttcctttttcttttccttttttctttttgagacagagtctcacactgtcatccaggctggagtgcagtggtgcagtctcggctcactgcatcctctgcctcctgggttcaagcgattctcctccctcagcctcccgagtagctaggattacaggtgctcaccaccatgcctagctaatttttgtatttttagtagagatagggtttcaccatcttggccaggatgaactcgatctcttgacctcatgatccgctctccttggcctcccaaagtgctgggattacaggtgtgagccaccgtgcccagcctagttcctttttcaatgagggcagtgaagcctatatagctgcggagttttgatatgtatttttttaaagtaattctcataagaactgttcttccacctaataattgcatatctatagactaaattaaacttgtgaccaacatgttttctggtaacattataccaacatatgctctgacttgcgagagattgcatttgtctctttaaactttgctaatttgatgggggaaactttttgttgaccatctttcttcatttattttttcttttgtgtttaatcctattatttgttaatatttctgttaagttgttctgagcttttgttatgtttagagatattcatttcctgtcatcataagttgcaaacctttttaccagtttattggtttgggaaagaatttgaaaggatttttgtagtagttgaattggtaaattttttttttggctttacagcataaaacaaatctcccctactcaagattatattattttctacttcttttataaaccatctcttttataaaccatacacactgtgtgtatatgtgtgtgtgcctgtatgtaaccaaaaaatgtgcacagcatttggccacacatcctaagtgtttagtccatttttctgcctcgtctcaactccaagcctcatcagatgcagtaaagcttaaatcgaatggggtatgcaccacatttttgtattttttattacttgtattacttttcagtattatttgtattcttgtagtttaatatagtatttatttcttacagtaaaaatttattacattttaatgcattataaaactagtcaagaagttctacttggaaattataacttattttggaaacaaacttagccttttcatatcttgttcttcccactagtttttctttactagagctgatcaatcctatgatagggattgagcaaattaatcataaatctttgaaattgtcgattttatatttagtcarcactgacttcttcaaatatgagggactttttaaaattcaatttgactgctgtagagtattcagtggcactgcagakwtaccatttggtaggttaatttaatactagaccaaaaactggttatttgttttgaaaactattttgtgggaaagctactatctcagtgttatagacataatgtagtgctagtataccataagtgacatttttttatgctggctgaaataccaraattcatcttgaatgtgatttactttagcacatctgctctttggaagaataattttaaaatttaactattacttttctgattagatagagtaccaagtatgagaaatttggattctgtgataaaaaatgttgaattatacactttctgctttattaaatcttgaaaattattttttgtctgggctatttgagtgaaattcatttgttatacctgtcatgataaaataggatggttacattaacccctattaactatgaaaagattttctgattcccagtctcattttttctattttctttcttcttgccttgctctcttttttctaactttataagatgaatgctgatattattgagacctttgttgacataaacatttagtgttatacatttctgtttttagtggtacctcacaccttttgattttcctttcttctttctttcttttctttccgtctgtctctctctcctccctcctttccttccctccttccttccttccatcctttcctccctccctccctctttcccctccctccctccctcttttcttttttctttccttttcttttctttctttctgtcttttcttctttcccctcccctttcctccctcccctctccccattctgctcttcactctcattctgtcgcccagactagagtgcaatggccctatctctgctcrctgcaacctgcctcccaggtttaagcaatttctactgtgtcagcttcccaagtggctaggattacaggtgtgcatcaccactcctggctaatttttttatttttagtagagacgtggtttcaccatgttgcccaggctggtctcgaacacctgatctcaagtgatccacccacctcggcctcacagagtgctgggattacaggcgtgaggcaccacacccggcattgatatgttttctttcagtttcccctttgatgacttctttgaccaatagattttttcagtttccaaatattcggggatttcctgagtatttttctgttactaatttctaatttaatgccattatggtcagagaatatactttgtgagactgatcgctttgaaatttattaagacttgttttatggcttagaataaactttattttggtaaatgtttcatgtgaatttgaaaagaatgtgcattctcctcttgttgggtcgtgttcaaaagtgtcaatttagtattatttagatctttaatttccttacgtttttcagtctctttgttctactaattactgagagaaaggtactgaaaagtgtctgactgtaattgtggatatctctgtttctccttgctgcttgtcaccttttcttggtgcattttgaagctccgttattaagtgcatacctgtttaggattttgttcttttgatgaactgacccctttatcattatgaaattaccttccttaactctggtaatattcttttctatgacatgtactttgtataatatgaacatagcccctctagtttccccccaccccacctttggtattagcatcctatgacctttaacctctttgtatctttacatttaaagtgcatttcttttaagcaataagtagttgggtcttgcatttttgtcccatttgataatccctgttttaaattgtattgtttaatccatttacattaatatgattattgatatagtaggcttaagtctgtcttcttcctatttgttttatattcgtcccacctagtaataggataaagaggagatacacacacacacgccaccaccatcaccacccttacacgggagcgtgagagcatatgggttacaaaaaataaaccacctaagaacactttgtcattgtcccatttcctcctttttcttccttcttttggattagctgagtattttctattatttcatcttacctcctttttattggtttattagctgtaatattttgtttgtattttagtggttacttacggattaaagctgtaatactttatttgtattttagtggttacttacggtttatagcatgtatctttaatttgccacagtctacctttaattgatattttgtcactctatgaatagtataagaacattataatagtatacttccctcccagttttcgcactttgtcattcattttacatttatagatgttattaattccacactatatttttatttaaaatcaattagtttttaaagagatttaaataacaaaaacatctatatttgcacatgtagttatcatttctagtgctctttttgtgtgtgtgtgtggatctgtattttcttcaggtattgttttcttctgcatgaaggactttctttaacatttcttatcatgcaagtctgctggagatagactcttttggcttttgtacaactgaaaatgtgttytttgccttcattttaagtgatatttttgctgtgtacagcattctagattgacaagttttttttttctttgggttgactaattttactccctattgatgattgtattttatagttctttatatgcctggttatttttgtttagttaccagacattgtgaatttgttaggtgctggctatttttatattcctgtaaatattcttgagctttttcctgggatgctgttaagttacctaggaagagtttgatttgtttggatcttgcctttagaattttctgggtgggaagagcagtgtttactctggggcaagtgattccccactattgagacaagaccctctgaatactctatccagtgtcccatgaattgtagagttttccagtctggctgctggggacaggcgctgttttaggttctgtgtgagggccagttgctgttccctctaatcctttcaggtgattctgttccctgccttgagtagttttctcatgacattctcatcagtgttctgctgaatatttgagggggaccttctgtaggtctccagggttccctcttgtgagccctytcctctctgtgtcctgtgaattctagcaaccttggtctcctggaygctcagcaatatctcttcaactcatggagactgtcaggccacacctgggttcccttcctgctccatggcctggaaattctcctaggcagtaaactgaggcagctgtaggactcacctgatttgtttccattcctcaggaattcctgtcctttattcattgctctccagtgtcttgaaagttttcrtgtttgtttggtccctgccccgccactccccattatactttgtttttttgggttgtttcagagggaagggaaatcctgccctgtcactttgtcttggccaaatgtaactcacatctagttgacatgtgcaatgcttatttccagatgagattccttgttccccttgggaaatgtagcctagaacstctttgctaattctgcattgatatttttagctatcctcctcattacaaacccatcacaaatttgccatatttttctgagttatctaacatctgcttttaacaatgtctctcccttgtgatcacctgagaagtgccatggataaacacaattaacctttctttctcttgtgcttaactgaccttaatcatgtattagctttttcaaaaactaaattttaattaagctttcgtttattctccttgtttcttttctatatttatcctttagttgtattatttaactccagtaatcatgtttatattgcatatatatttatattgcatatatatatatccagtaatcatgtttctattgcwtatatatataaacttgcaagtttcacttaaatgcacaggagtattacctattataagtcccaaatttaggctgggcacggtagtgactcgmacctataatcccagcactttgggaggccaaggtgggtggatcacttgaggccaggagtttatcaacagagagtaaactatattgtattctaygttctatacaacagaatgctacgcaaccagtaaaataataagacttacaaagtagcaaattgggctgagtgtggtggctcacacctgtaatcgtagcacttttgggaggctgargcyggcacatcacttgaggtcaggaatttgaaagcagcctggccaacagggatgaaaccccatcyctactaaaaatataaaaattagctggatgtggtgggcatgagcctgtaatctcagctgttctggaggctaaggctygagaatcacttaaaccctgaactcaggaggcagaggttgcagtgagccaagatcataccactgcactccagcctgggtgacagagtgaaactctgtctcaaaaaaaaaaaaaaaaaattgaagtcctgaatttatataattttttaatatatttagaagctttgaaaagttttacatgattactgagcattttaaagagcatatgcttttcagtaaaatattttattcattttatcacattcatgaaagcaccgtctttaaaatctcagtatttttacaatattttmacccatgtatttttcagttatttttttactattaattttattaatgccaatttacttattacatattaagagactaatttaaaaatttttaccttttgraaagaaagtcaagatagttaatcatttgtstttttcttatgtggtttatgttctgtgatccttctgttctctctctcccaggtcacggtggttgtggtagtactgtgtgtgtatgtgtgtttgtgtgtgtgtttgtgtgtgtgtttgtgttgtcttcagggaagggagctctattcttttggcctggggtggggaatatatataaaattttgtgtgtgtgtgtgtgtgtgtgtgtgtgtatgtgtgtgtatacttctaatagtaatactcatgagcatttaagtaatatataatgtgtgtgtatacgtggaagtgtttaaacatacatattatatataattatatgttataatggatatattatgtagtatattataatgtatagtatagtatatgttatatatactatacaatagcatatataattaatggcatatattagtatatgtattatatgctatactacataatagtataattaacaattgtatatattacattatatatgtaaagtatatattatacattatataatatagtataaactatatactatagagtatattatacattaataatatactatatcagcatatactattagtatatactaatatatactrtatataatgtataacmaatatataatatataataaatatatataatatataacwacatatatcatatattttatatayactatatatgttttcatttttcttctggatatattaataaatatattcttgaagtagatgagagaggggaggaacctgtatttgttaggtaataatatagtttaatctttaaattacaaaatgtagccayaaggttaatagctttcatttttactctagcawagtgtgattctactatctttggatttctggatgattttttttctccttgattcttgattatattttttgttcttcataaattaagatgatatacatctttgtattagaggaaagccctgaaacataacataattaataattttagaagtttggacaacatttcttctgacaagagacttctcttacaaagtaattgaatagttacattcctcatggtagatatgtttatttcaatgtaataacctaaaaactgacatttactgttgttttcacttatatttgaaaatgtggatactgaatcrtttttgaattttattcacttattaasagttgagtttgaatttgttatacatttatttatgtttaattggagttaatggggtaaaatgtttagaaaaatacttcactgcatgtgaattaaatgggaaaaataattttctaytgaaaagtcactcttgcattttgggcacagaaaaacttatagaggcgataaaacttgggggtaggtaggtgaattctgttsatatataattggtatagaatttcaggcaaaaactttaaaatagttgtacagttttactgtttctactgtttgataaagctgaaatcaaatattccaaaatcattagcaatctttgtggaagtgatgacatattttaaataatkttttaaaactataaagttcaaagctaattctcattaatgagtattttattgttttgtaatgtaagttccagcatagtcagaaaattagtcagaaacatttgcttgaaataaaatgttaccatacagttttgctaatacagagagcaggaatggaagtgtaatatttctatgcattaacaacttgtcatggctatagaatattacaatatcaactacagtagagatrttgtcccattcttttattgtatgcattgttttaaaaaatatttttattttgaaatacttttgatctgtagacatgttataaagttcttttcagatacattcaaagctatgagtttaaaaactgagaatctcagtaagctcaacaaatkaacacatttacatgccagtaatatatcyttcttccaaggctagaaaatacttcatgatatttttgttagtataacttttaaatgcatttctttcagataatagaaaagcattttaatatatatttaccgtttcataagcagattttctaaattaacatcattagaatatatttttgaactcacaggaattaaacagaatggcaagctagggtccatgaaaacttaggaattcctttttgaagacaaaccacaaggaaatgtcagaattatgaatctgggaagatgaagcctgaagccttaaagtgtgtagtgctttccaatgaaaatcmactggtttctgaacattccwactatyggttttgtagacactgttcctgtagcctatgaggttattctctgggtgagtggccgtggatactgctttttataacataacattgcacagtttctgacttgaatcagaatccatgatcactgcttttggagcaggaggacctttctgacatgtcccttttacagtgatgtagggagagagattaatgcctgaaatcatctataaatggaaaaatgataaaattgtgaatcactgacaatagagaaatgtttatggtttattttaggggccttgatgctctcagcaagaaagcgaaggcttccacagtcgatttgcctatagagtccgtaagyctaagtctgcaggatctcattggctacttccaccccccagatgagcatttagagcatgaagacaaacagaacagactacgagccctgaagaatcggcaaaatctcttccaggaagaggtccgtttctatcaacactcatttctcttctgttattctcttgtaaaaacagcttcttggttgggaaaattttccatctattttgaccatctttgcgttttgcaatatagaggagaaagtatactactgaacaggagaaacaggccttagagaaatctcracatgatttttatttatttatactatccatgagtattaatttaaaaacatgaatcttttcattctcctggcaagagacatttactgtctgctcagccctcaccctggtcttttgcaagcactatagttctcttcatgtgggttatatcaattaagaatctcaaagtgtctgtacgaatacaggctttagaaagcatcagggttttcaaactattcagcaggtgctccttggaaatggcccaggatctataggaagcttcgtgttggggatggaagctgtcaggagagggctaccggagtaggctgagctccaggaaccctacttggacagagcaaccctacccttctcctttgcatctattacatttccatgtatgattgtattgccccaaaagtttcactgctaaaaagaactcaagtgtcatattttacaaacaataaaagaaggaccaaatgatatatctcatgttctaatatagtcaggagcttcgttggagactacgagggttgatgggataaatcaggcttgttcagctggattcccattcttttcaatgcatcttgtatgcagaataatgatttttttctgaataaatacttagctttgtaaaagtaacaaaaaaggttattcattgagtacacatggacacaaagaggggaacaataaataccagggcctacttgagggtggagggtgggaggagggcaagggtcgagaaactacctatcaggtattctgctcactatctgggtgatgaaatcatttatacttcaaaccccagtgacacgcaatatacccacataacaaacctgcacatgtaacccccaaagcctaaaataaaagttgtgacacagagaaataaaactaaacaaacaaaaccagaaagggttattactaggttctcataatccctgtctacttttaaagctgtgttctaatatctcatcagaaacgcttgaaactgacataactttttgaggacgttcccactgggtattcaaaagagatgacctatctagagacctcaacggcacgaaagcaaaaaagtatcaacataaaccaataataacgtggactagtttcctgggagctttcacatatgccaaattgttaggctcttttacaatgctgcatttatttaatatctggaagaagtaacattaaatattggggtgtaaaaattaaaatagtaatttagtttttttcccaacttctcatataagacaatctggatggggacttggaaatgttcttaggtccatggtatctcttaaattctgtgtgaaataagttaattggtttagatagtggtttatatagctctttatgtggttagatagctctttatgtggtttgccacgctttttacaaccttgatctaccaataataataaaaataaagcataatttcaaactcaggctgtatcttacaaagttcacgataatgcaaaaatgcattacagcatttttgatttgctttaaaaatatcttttcatgagctttacctgatatactatatctttaagaataataataatgcctatctaagaataaggatctgctcttatggtcacttaacaatagaaggccataagtatgaagtacatatttttaggttattcttccactgctatttgatgatggcatacagaatttaaaatctgcttgaactatctgaagaacatttcatttcacatgcaaatgtgtgtcttcctgtcctttgaatgatcacagttttctttatgattagtagatgaaccttcagtcagacttctatttttaaatcaacttagcatttttagtctgtaagcagaatgacagttttggatgtctgattgtgattttttttttttttaacgttccagggaatgatcaacctcgtgcttgagtgcatagaccgtttgcacgtctacagcagtgcagcacactttgctgatgttgctgggcgagaagcaggagagtcttggaaatccattctgaattctctgtatgagttgctgggtaagaagcatgaytgggttcatagcaacagagttatctatttaaaatgtccataaatggactaggtgtgatggctcatgcctgtaattccagcaatttgggaggctgaggtgggaggatcatttgaggccaggaatttgagaccagcctggacaacatagcaagaccccatctctacaaaaaataaaataaaaatcaaacacaaaagcaaaaaaaatcacataatagctacagcaattttataacatgcctcctaattgagacttaatttttaatttactgtgccaaatcaaatggtgcttagtattaaaatccatctctgagtgagaaaggtagctagagaagtagatttgcctttggttaaaggaggagaaagtcattcagggtgcagtctttgcagatgaggggcctttatatggatgtgtgttaaatatttcctttttgcttttggagttagttccgcaagggtccctcttaattccttacattcccatctaatcaatgatctgctccagtcttctctctattytttatatgatctctgtttggcaacttctaagtacacctgacattgattaagcgacagttgctgtggtttaccctgcattcctgtgggctctctgcaaacacagctcctcattatttttgacctcctgtagcttctacttgtctcttgtcaaaaactaaagggtctgagatttttaccctatttgcaagctagtaagttagcctgcagttagggtaaagagggacagtttagtagtcaaagaaatagctgtagagattggctgtagtgccaattctctgagccccagttctcaaaggacaatgtgaaggggacagatgacacctgcacatgcagctagttgagttacagaaaaggaatcctgagctcagggagtgtgagttagttacactrgacagaaagcctgcctggcctttgctgtggatggagacatctctctcttgcatggcctcttgctgcaaacatcttggaaaagatttcctgaaacaaagccttccaatgacaaatttgcaagatgtgcaaaaacagagaccacggggaatggtctctttctctaccctaaccctcgcctccaaaatctcagattcatcctgtatgtcacaactgttacatcacttccctgtttagacattgttcacatttctatatcattctagaagataaagttcaccttgttgycccggtatatgaggccccagttaacccttccagccttctattttcccagttcccttatccctacccccttacttgagccacatcacagtttcctgaactttccatacacatcacacctctgggacgttgtctcaccttttccagaattgttgtatatccttcaagacccagttcacatgtcactgtcttttaaagttactcttgataaccgggcacagtggctgacacctgtaattccagcactttgggaggctgaggcagccagattacctgaggtcaggatttcgagaccagcctgaccaacatagtgaaaccctgtctctactaaaaatacaaaaaattagccgagcgtggtggcgggagcctgtaaccccagctactcaggaggctgaggcaggagaaccatttgaacccgggaagcagaggttgcagtgagccaagattgcgccactgcactccagcctaggtgacagaatgagactccatctcaaaacaaaaacaaaaataaagttattcttgatgtttctcccaactcttaagtataattgaaccttccttctctggtttcttgccactaagtttcacctgtattttatagcacttgtcacatttcttatttagttataagtgtgattgatttctaaggcaagaatagcaccattctggtttttgtatctgctatttaactgaatgtctggcacataggagatactcaataaatgtgtattcattacgtgactaagttctgataaaataggaaagcatacctaagtatagaaaggagataatgcaaaaaaagttaaaaaaaaaaagaaaaaagaatgcatttttaatgggaagaatttagtcaaaatatttgaaaattctttacaatctaattaaatgtcattaaaatttatagagtcataatacaacctagcaaataaaactcttgtgcctattagaattgttaatatgttttcattaggtgggctatttgatatttattaaaattaaacacttgcagtttggaactttcagactaaaaggtgacatgcggctgccatttctgagaacaggaccagggatattgaggctttataggaatttggattcatcattttacccacagtaacgattgagataaagattttgtgttgccaaaattctaatgactgcatttctttgcaaatgcagaagttatagcactaaatttcataatatagcagagactaaagtgtggtgatgtttttaacactacatcctaccttcttcacttggtataagatgaatttcttggataaactcgatgcttaagtaaagagttgcatcacctagcctggacagcakaggaaaaccctgtctctaaataataataaaaactggctggatgcattggctcatgtgtgtagtcccagctrcgtggggggctgaactggtaggattgcttgaggctggaagtttgaggccagcctgggcaaccacctctaaattttaaaaaagaagaatwtcatgtatgaatgtttgagggtagaaagtgttacgtgcagaaagaacattgttttttaggtaaatctagaaaatatgcatcttttattttcatatcaactctttttatagtctctgttcattggtcccttcaacaggtattgtatccatgagtagcaaaaatgaatagaaggaattataattttttatataatcatagaaaaggcccattgcagcaaagttagcacttcagctttatccttctgagctacttatttctcaagccaatcctccctttacctccacagagttatttggggattaaatttgattattttagaacctacaaaagtaacattaatagactttacaaaatgttggggacttggtgggtatgaacacggttcctgctcctaattagttttgaggttggcttttactggaacatggctagaagtgtgattttaaaatggcttacctatttaaatagaacgagaaaggagctcttgaaggtggagcaatgtttctattgggatgtgttcagttggaaataacagaatacccaaacccaaactggcttcaamaacagaggggattttggggcttgcacagctcgccgtctaccagtgggtttgacacaatggctccatcttatctccagaaccagctgctttatgtctccactctgccttccatggagtcatcttcctctagtgcggccttttcttgatggtctcagctgtctgctgtcagctcctagtactgcatactttctttctgacatgggaaaagtgaaagagggcttgttccagaagttatcccttgtgaaagagtgtgctatttcctaaaatccccaaatacaacgcttctcgcatctcattagcccaaattgtgtctggccattcctgaaccagtcgttctggcaagagtagggaaattttaccaacattggtcttgactgatcagggatccactgttgaaactgggtcaactccttggactgcctatctgtcatatagggaatgaatgttatagaggatggtggccaagaagctgaagtgtccatcccaaatgttgactcatctacttcctcaaagggttttatgaactgaattctaatcagaatgcttttattcactacctagcactatgcttgaatagagtaggcagtcaataaatatttgcttgaattatttaataaatacgttacagagatttccattgacttttctgtagcagggtgcatttggctatcaaattagtgtattaaaaaccagtggaactcttactcctctttcattaggttcctttcttgaaaaataagcacctgaactttcattcaggcatatagcaagtggcatctattgttactataaatattacctgtaaaatggcaatagtcattcccctcataaggttgttgggtggcttaaatgttataatatatagaaaatgctcagcatcgcatattgttgttcttcttatcattattcccatttcttttggatgtttgttatcatcctttcccttgttaacatagtaaaacttttgtctccaacctcttgcttcattcttattattgttgttttgcttttcaaagatgtcctagaaaagaaactttacttagatttgttggatatagcaaagaatgttatggattagccaatagagcacatagaatcataattattgtaggtgtatactggttcttgttttcctcatcggaaaatggcaggaacaaagtttgctttatcactatccccagactgcaaattttatattctattattctacccatttttgaacacagtatcrcacatctgcatctttaccatctggtatacagctaaatacttcagatctcaatgacattcatatatggtaaaatttgtggttaatctctttacctccactccttctcttctccagtctttactcagacctcagggagctctcacacacttcttatgaactttcatagactctgtgaccttgtttacacccctcttttaagaagaagggcctggtctgtctcttcctttcaccagcaaccagatgttgctggtctgtctctaamctctctgtattgcgttcttttaattcttggtccggtctgtcccttcttttcacctctgatgtcgctgattctgtctagttagcgggctacaacttgggagagagatcttgatattatatttttcattattctgaatctattaacatgcattacttttawaattgaaaaaagtagttaacatatatctctaatgccagataattgatagcaaaagtaaaaactgaatgtactaattacagttgagtaaaaaaaaaaaaaacatttatatattagtgcaaatgaagagaatctcttcccataatctacaaggtaattttagtgggagatggggtgtttccactggatagaattatgagagtttttttaatgtttttgagttcttatgattttctttttgtgttatagtgagcatcratttcatgaccagaaaagggtaacaaatacaactttatrttgaattttgacatgcaaaatacttcagaaccatmtgctgccaatattttttattgaattcattgtaatcataagatagccacatatacctaaatatatacttcagtttgtctggaaaagtctcagatctgcagcaataattggagtcctgtaagacatgtgtatctacctttccttctttatttggctgtcaaaacctttggttcaaatattaactccaaatttgttaagcctccttcccgttattcsaaataggtagaccatagattctctcctggggttatatgtgaaataagccactgtctttgtattttttcttcagtgtgtctattttgcacagagagaaaaccaagaaggtgggaataagaatctataacaattttgcattcgacatggatatatttcatgtgttttaggtggagaatgacaaaggtagatttgtgagcctactgtttggaatacctcaggatcttagaaacagcgatactcatagttggaaaagcatcactgtggcatgctttcatacatcttttctgacatccacacgattaatctgtgggatgcttacaagacagaatgattttctaaagatgtctgagaaatggccgctgggcaaactttcstatgaatactcattttctgaagattcaaagtatgaaaccaacaaggatagattgctgctctttgagtatggccaaaatgaatgtttgaagacttggaaagaatacagccattagccattatttctgcacattcaaaccaatttcccagtgtctcaaggaggcagatctccctaaatgccataaaacattgagaaaaggcagtcaagaggtgaagaagaaggaaatgggctttagacatgcacagatcggtgttattctagtgtttgtgcatctagatagttcgatcttgttcttcaggaagtctcagaaacgtatcgtataaacaagacacatcctttaaaatttcagcttggtgatagtctcattgtcccttactcttgcaagttcccaggtaggagtcctcagactccagtttacaagatccccaaacacagggacagctctccaagctctccaagaagtttcaatgcattatcttcttagattcttcagtacattctgaagtgttttgttttgtttgctcgtttgtttgtttaatgggttttrtttttttcaggcttaggagcatctacttgttaatctcaatattttgaaaaatgtttctagattttagtccaattagcccctcatttttctgtgctgcgtagggcctgttcacttagtgtttccaggctttgaatgtaaattccaagagggatgttgtttcatttcctctgtacctccagcacctagaacaatgcttgacacaaagcagggaatcagtatttgttgcataaatttttaaagtgaaggtaatttcttggaatttcttttaatctaaatttttctgtaagtctcagatttttttagtcttttgtgaaattttgagtccaagaattcaaagacattgaagcatgaagcctccggggataggatgatactaataaaacagatgaatattgcatgattccacttataagaagtatctagaatgattaaattcatagaattaaagaatggggccaggcaaagtgactcatttctataatctcataactttgggaggccaaggcagtgggatcacttgaggaagggagttggagaccatcctaggcaacataaagagaccctgtctctacaaaaagataaaagatcttaacttagtctttaattaggcagcaattaaagagtattgtaaagttttagggagggacatttgtcttttgtttttgtaccttgacgcaccataccaagttgccattgcacttcgaagatgacagtggtgctctgagacatctcataatgaaagccactacagatactgatggcatggttttccgttttatttttggaaaggcattaactttattgtactatttggtattaaaattaatacattttagataaggaaagaaataagaaaaattaagaaggcagaaactactcttaaacttaaccacrcattttgatctataacctttacaaatgttcctttaaatatttatcacgtaatacatgcagaaaacattttgcacacctgcatgcgtgcttgcagaataacacgtgtgtacatatctgcacatctttgcagcaagacatcacctattccctcctctccttgaagatttgctcatcttgctccaaattccaggttcatggrctaagatagtcaaaaggctttcctttgatgttggtacattttaggggcttatttggttacatttttttggacttccgtgcttttttattgtcgtctattttttctctaagagtgaaagtgtagccacagaacatctcttcacatcctaacttcacatcctaacttccattctcttcacatcctaacttccattcttattgagcatttgtgatttttttttttgacagaatttattgctggttcaaagggtcactgtgaaagatcatattacaggacatggcccttttttttcctctcctgggtccattcttcttccaccttattttggaataagaaaatgtacctttttgacctggggaagcagtcccactaatatcaatcttcctcaagctctctgtttctatctcagtcccttatcaagatatttcccccccaaatatcagcaatcattctctaagaaatttctaaaaaacacagttttctccatgctatacatgtacttatattcagtgtatacatttactttacaaaaatggaatcatgctatcaatgttcttttatagcagatgttttcaattaattctacattgtgggcctctatccttggtagtaactataaaccttcatcagactttagcagatgtacacttctgtgctgaggtaatgtcaccatttacttatttaggcacatttaggctattccagtattttgctgttataaagagtgctgtgatgagcttccttgtatttctctgcatactttttcattactttagaaactcacataactgatatcttcttaactgactggatgaattataataattcacagactccatttatctgtaaaatgtattggtacccatgacatgcgcctacatacacacacatgcacacacacacacacacacacacgcatgcatgcacgatgttcaggaggtactctattttactgagttaatttttttcattagaaatgtatatattttcgtagtatattgagattgtttgatcttttactcattaacagatttcctgatatatttttgtctctttggaggaatgaatctccacttggatgaaatgttgctaatgtattgctaaatttgatttataaatactaaatttatattgctaaatttgatttattaatttcattaatatataaacttatataatatttttggatttataagagttcytcttgttttgtgatgtgtgctttgatatcaatgtcactgatactgcttttgtaaaatcagggaagtttccttagttttttggctttggaatacggtcatgtgtcacttactcatgggaacagttctaaggaatacatcttgcaaacatcatggaacttacacaaacctccgtgttatagcctattgcacagctacgctataggggatagcctactgcacggctatgctatacgggatggcctactgcatggctatgctatacgggatggcctactgcgcggctacgctatactggatggcctactgcgcgtctacgctatacgggatggcctactgctcctgggctacataacctatggctgtacatttgtacagcaatatgtacagcaaattaccatactgaatactgtaagcaattgtagcacagtggtatttaygtacataagcatagaaaaggtacagtaaaaatatagtcttatggtcttaagggatgatcattttatctgattcattgttgaccaaatcattgttatgcagcatatgaagtagtgtagaaattacttatttattgaatatgtgcgaaaaagcttttggtctttgacatttcaatattactcatgatttattattctgtttagatgttttcccttctattgcatcagttttagtgaaaaaatacatatctatatatctatgtatctatatcttgagaccattttacccagatgttcaaaattacagtataaagatgtataaaattgttgtgtttataattccttttttgagatagggtctcactccatcacccagggtggagtgtagtggtgatatcatggctcatggtagccttgaccttccaggctcaagcaatcttccctcctcagcctctgaagtagctgggaccacaggcatgtaccatcaaacctggaaaaattttttaaaaattttgcacagactgggtcatgctatgttgcccaggctggtcataaactcctgggctcaagtgatcctcccaccttggctcccaaagtactgggattataggtatgagccacyacgcctggtgtaatgcccttttcttaattttgtccttttttccttttctttttgattaaagtagtagttggtagttagcttatatttaaaaaatagtccttgaatgtattcttgatcaatcttactattatataaattatttttatttctaatgtattaatttctacttttattgcgatttatttttttctgttttactgatgtttatttgatgttcttttcctctatttcaaaagacgtatttaccatttttcacccaattgcttagcaattaaagtgtttatttaattttgccttgagtacacttttggccatttaccattggttgtgttaggtagtattctaatttttgatatttattagatattttatattatgatattgattccatcattgacccaagagttattaaggagagagtttaaatttttatatgctttggttttattttcattcctgcttttcttactaaattctgacacggttctgtcagagaacatggtttataccatgtctgtttgcagtaaatttaatgaacttttctttgtggcttactttataattttcttaaatgccccatggcttattaaaagagttcattcttacactattaatttctttcaagaatcacttatgttatatatatcatatatataattttagatagataatatgataatgatatatgttttcattttagatggataatatgataatgatatatattatatatatacctatataattttagataatacaatagtttatatataattttagatagctatatataattatatattatatataaaattagttttacaaaatcagaaataaactgaaaagcatgagttaagttttaaacaaaagggactcttaaaattcaaaaactttatcatgtcctttttcccagttgctattgttctaaattgggaacagatattcttacagaataaaattagttctgcttagaacttagtacttctcattcctctgctatattccacccctatcttttgtcccctgtactctgcagtctgtgagtatatctcgatggctggctcttaagggaggctgctggacccagagccagaggagagcctgagtaatgagtgtattagctcttaatctctgtacaaatgtcacagaggcgctatacacaaaaaagctcttctcatgaagttggcgtcttttctgtgtgtttcttttcttactctcaggtcagataataactttatttctttatttttggaaagaggaaacatgaaggacatctttaagtttaattgtacactgtaactgtagggtctcttccctcctgctcttaacagggaggttaacaggcggtagcctcaaacttcactacttcaaacgcttgcatcagctaccagattttctctgcttttttttttttttttttgaaacggagtctcacactgtctctcagactggagtgcrgtggcacgatcttggctcactgcaacatctgcctcccgggttcaagcgattctcttaactcagcctcctgagtagctgggattacaggcgcccaccaccatgcctggctaattttttgcatttttattagagatggggtttcactgtgttggtcaggctggtcttaaattcctgacctcatgatccgcccacctcagcctcccaaagcgctgggattacaggtgtgagccaccacccctggcctaccagattttcaatagtgattattcttatagagacatctttctctctttaaatatcatattgtctaaacatcttgccatcctcttgtaagcaattatactgtttctgaataaacttaggggtataaaagtagaaaatatttaccatgcttgctttgaaagaatttaatgattttgaaaaattaaaagtttaaaaktgagtgtataaactaggctgaaagaaaccagaaaagtcacataggagttttatttaaaatgggttgttcaatcaaagaagtgtagaaaacagtagtctaagccaagctagaatcagtttctttactgcagaatttcaggtctttaatatacattgtgaatctctaaatccacggaaatgatataagaaaataaaagggtttcaaagttagtggctattggtcttctcatccattatttaatgtaacatttagttatatctctctgtatacctgttagagttataattactagttatatctcctagtattttgtggttcattttcagaaaaactgatttgctctttttattctataggtaagaaaattgggcttgagagagaagaataatttaatctcatggctaattaaaagcaaaggggattagaacccaagtgagggaactcccaggagactgtttttccattaccctttactattacctcccaatgtgaaattcactttccgaaattacattccttctaatgagcagtggtttgcttcagtctcaattaataattattaatttgtctttaatgtctcagtgttgtatatgtacgtgtatgtatgtttgcataagtttttagatgtaacagaggatattttgttcttgatccaatattttagggctgcatattagcttatctcaattttcgagctagaaaatcacataaaggtgaaatctatttcttcttttgcagcggctctaattagaggaaatcgtaaaaactgtgctcaattttctggctccctcgactggttgatcagcagattggaaagactggaagcttcttcaggtatgttttctagttttttccttgttgtgatagatcactcctatttttctttgcttcgtatcctttaagacaaaaaaaaaaaaaaaaaaaaacaactttgagtgaggtgtggtggtggtgtgtactgagtcccagatactcaggaggctgaggtaggaggatcacttgaggctaggagtttgaggytgtagtgcactatggtcactgcactccaacatggacaatatattgagaccccatctttaaaaaacaaaaagaaaaaactctgatgtttggtgtaatataagtgttttccttttaaattatgttaagtatttttatttcttgaaaaatcattagtattttcattagtcatttctgaatagtcatctaacaatatcatgtccatttatatcttaaaaaacctatttataaagccctgaaaaccactaaagagccagaattctcattctttttcaaattgattactgctagtctattctataaataagaagatcagtttggagttctcattgttttccttgtattcaaaagattatttggatagattggggagacagttcattttccaaatcctagagtgtaatattttatttaaaggaaatttagtaaatactaacaaatggtctgtataatagtaaaatatttataggcagtcaacccgatacacacatctctaataagatgttagttttatttcagtattgtggagacttatcaatgactgtgaagacttatcagtgattttggacttaccagtattaaatcagttatttgaacttgttagagctctctagctcacacataattgacctctctagtgccatagattgcctcagtgacacccaaatgaatctactgctcttccatctgtttgcacagtatttcattatttgcctttctttatcactaatgccctcttatgttacttatttttcctctcagtttccttcattagtaatgaacttcttgaagataggggcatggtttcattcatctttgttctttccggatctaccataccatctggcacctataggtgtctagtattgtttgttgaatgaatggatggatgaacattaaaattcactcaaaaaataccactgtccatacaaaatagttctgagacttttgcatgataaagacccactcagggacaggtttgttggaattgaatagagacagagaaacaaccatgatcagagagagtaattttaagtcacagagaaaaatttgtagagtttagatagtggargacaaaaatgtgtagagtttagatagtggaggacaaaaatttgagtcatagtgagttcttgggcactgctagatcgttgggcagcagaagtaagatagaaatggagattgttgtaataaaaacaaaaataattatgagatgagggtgttaagagtatcataacatgaatgtagtgactgtgcattaattgcagaatatattaaggaaaaacctgtaacttctagcataaagaagtgaccaaataagtggtactgaagcaaagtcattgtctggggtaaatacctgagattcattgtcttgcaccaagaaaattaaggacatggacacacacacaaggagtgagtttaggagcagaggtttaataagcaaaagaaagagaaaggagaacagctgtctcaaagagagagagggagagatagggaaagagagaggaagagataggggcagagaggagagacagagagagaggaaagagagagagagagagacrgagagagatcacgattgagaaatctggcctgcaccagagtgcaccagattttataggcaggcttgaggaagcagtgtctgatttgcatagggcccaaagattggttggactcggtatgacatttgcataggaaggctggccaggaaggctggctgctccaccctaatcttatgcaaacaggctttccacttggcaggtgccatgttgcctgctccttactgtacacgtggctggcaaggagacgggaacatggagccgccattttgaacatgcctagtcccaggtggtcttttcctattggcacaactgctggcattcacccgtggaagcttccaacttgcttctctatgtctgcagctcgattttgcaggctgctctttgttagaaaagaacatgattttgggactgctcttcattaaaaggtaaaccttaccaaggactcctgtaccctcactatctgcctaaataatttctccttaactcctgtatcagtaacaagatggtggcatagattacaaaaatggataaatgtttagggccaagtgtccagaatcactggaaagctacagaagacatttaaaaaatgctcatgtcttctgctggacccagtggtatctgtaaagagataggtgcagggcagcctcagagcagagtgttaacactggctgaatcaactgcacagcgaaatgcttaactggaaaacagagagagaaaagrcatgaacagagccaagcatcctttaaggtcaaccaagtacagtccagtgttttcagagtcttcagttttgtcagttacaggcacagtttcatcagatacaaattattatttgctgttgtctttttccagtcaatctgttgattgcaggcattcctamtgaaaagggaagccctgtgctcagagataacataatgaaagtcaagggaaagaaggacccttagagtatatttaatctaacattcttactttagaggaaaagaaactgaggcaaagaacatttaaatgactgactcaaaatcttagaaaaattattgttactgccaaggttaaaactcagctccctagcatcagacttgaaatatgaccatgatactctgtagctcttgttttttaagtatctaaaatatattttgctgaacaattttttctactgtagttaacatttatgcttttaatgaactgttttttctccagaggaagtggtgttgcttagtttttagaggcagtaacaatgatgagatgcacatgtgtatgtatataacttatttcaattgtgctttsctctttacaaagtgcatacatatgcatcatttttttcctctctgtaataagtctgacgttgctgaacacacactctcctcatctcgttrgtgccctagctgcagattcaaactgaagaattcttgagtagaaaagggatcaaaagtagggttaattgtcttcctgggatctagaccattctagtctttactgccttggcaggtccccagtgccttggttgttttggttgatggctggcctgaaacacctcgtttaccattgccagatgcagaacaatgcctaggattgccttaaaaaacaacattggaaatgaagtgatgaatcataggtgaatagttaaattatattacaacaacattttcagctatattataggtattgcaaagaattgtttagatgtatatcctgaaatagatttagaatatatttttaagtgaaaattcatttttagaatgtgtgataggatatatttttgtaaaaaaaaaaaagtgaagatgaaagtagaaagaaataaatgaaaagaggaaagaaggggcaaaaaccctgtgtaatatgtatatatgtctttgcacgcataggctgtagaaatatgtacaccgctgtttactttggtgaccaaggagttcaaattagaggaaagaaaaagagtaaaacactgggttctctaggacrgggaattgcttgtcaaaacttgtgataaatagcaaatgggaagtcattagacccaaaggatagagaagaaagggtctaatgaacagtaacaccaattattttttccaccttscttttacttttttttttwaattgctttttccattattctttacattctaccactaatttagtggcagggacaatagtgttatctacccgatagggctgttagggggattaaatgattaatatttgtaaagtacataaaaaagtatttggtgggcgggtgtggtggctcacacctgtaatcccagcactttgggaggctgaggtgggcaaatcagctgaggtcaggagtttgaaaccagcctggccaacatgatgaaaccctgtctctactaaaaatacaaaaattagcaaggcatggtggcaggtacctgtaatcccagctactggggaggccgaggcatgagaatcgcttgaacttgggaggcggaggttgcggtgagccgagattgcacgactgcactccagcctgggcgacagaacgagactccatctctctctctctctttctttctttctttctttctttctttctttctatctatctatctatctggcatatatgtacttattaaattagatctgtccgtccaataattccagttagattcatacaaagttgcctggctgtagatattacatattgtaagaggccttttatcaacatggtgttcagctgcaaataagggaaagttctactaccctgacccaaactaggaaggagcggggcagtcaacagcacttgagttccatgccatcgaccacccaggctcctgccatttctcctttcctcagtgccccctgcctgtgcgttgttttctctaatgctggcagatggctgcagcctacaggttgctgcatctttactccaggcaagaggattgaggtaggactcaaccgacggagatactgataatgacaagcattacctctacatttacatggccaatagacagacctctctctaatattattacaaacagtagtatcttttcaacatttcatgaatttacttccaaatatgattttacactgtcatgaatcatagctcctgtcatttctgttgccaatagtgaggaaaaaaagctgatgaatatggaaaggggaaagacgtgtgagtagaaacacaaacggcaaagctggagtagaggctccgggagttgacaggtgcaggaagctgagctgccgtcagccctgactgtcagctgtgtgtaggtgtgtgtgagggccacagaagggagttatctatacataaatatgtatgtacgtgtgtatatatgtgtgtgtgtgtgtgtgtagatctatacatatatatgtatagatatatacatatgtatagatacctacacacacacacacacatatatatatatacacacacacacatacatacatatgtacatgcatacccctacctgttgggcaaggggtttgaaacagtttcagttttcctgacaacgtaaytggttttacctcaagcctttcccactcaatgttctatatatgcctgggaccacagtgattaagaagtcagagtgaatacctttacagacaaccagaaacatatttaaggcttgtgaagaagattgtgtagattgcctaacctagtgctcttgaaccacattcttccctcccttctttagttttagaagctgaaaagcaaaattctcaaaatcttaacctcacttaaaactgcgggtgcccatrttgccccattctggcctgtaatatcagctaaactccctgggagagctttgcttcccaaagaaagcctttctaggagaaagactcaggccctacctcaatctcttgcctggaacaaagatgcagtaactggtaggctgcagccatctgccagcataagagaagacacctcacaggaaggagggactgaggaaaggagaaatggcaggagcctgagtggtcgatggcatggaactcatgtgctgttgactgtcyggctccttcctagtttgagccagagtagtaggactttcccttacttgcagctgaacaccatgttgataaaaggcctcttacaatgtgtaatatttacagccaggcaactttgtaagaatctaactgaaattactggatggacagatcacatttaataaacgtgtgtatgccagatactattttatatgctttacaaatactaataatttaattctaacaactctataggttaggtaacattattgtcctgtttaatagatgaagggactaaggctcagagaaattcaataartgagctaacacagaaccagctcccggagccaggcagtttggcatcagtatccttgatcttaatcaccccactgtgttctctaaagattcttactgactatgagattatgaatggaaattaaaatatgtatagttatattgatggggtgttctcttattttggggttctgtttttgtggggytttttwatcttttaataagctaaaatttctaagcaggctttcataggctttctcttgatcttaatttctttgagcctcctggtgtawtcttaaattccccaattatatttacatttttaaataccatggtgagaaatgatctgaggccccaaagttaggaaataagaaaaagtgtgggtggtggtagtaataaatcatttatagtggaagtggaagcaaaaattatacagagacacattagcaacaccaagggagttttttaaaatttattttaaattgacaaactgtaactgtatagatttgtgggatacggtgtgatgttatgatgtatgtatataatataggatgattaaatcaagctaattaaatatccataacctcagatacttgtcagtttttgtggtgaaagcaccagtgacaccagtcactatgtatactaagagtatctgatcagttcatacgcatgaccactctgaattcmtttggggaatgaaagataaatcacatattttccctgacttcaagtgtgtctagtgattatgtcgctgggccaaagttaattgaaaagacaaagattggtatgagtaagtacagttgattgagttgatgtatttcagaatggtggcattttcttctggatgttctcagtccttgaaatacgatttgggggcaagagatagctgactaaaaactgctagtcaggaggctacagagtatttctgagtttgactttttgtgyagtctgttccctgcacagttttgcagtgatgaaagtggtctctctttggcattcctgccatttcttcccctctcttagtaagtgccagtgagtgaagtcctgtctgggtttaagccaaagaaggagtctttgaggctggtcgtggtggctcatgcctgtaatcccagcactttgggaggctgaggtgggtggatcacctgaggtcaggagtttgaaaccagcctggccaacatagtgaaaccccgactctactaaaatacaaaaaattagccaggcatggtggcaggtgcctgtaatcccagctactcaggaggccgaggcaggagaatcgcttgaacctgggaggtggaggttgcagtgagccaagattgcgccactgcactccagcctgggtgatagcgtgagactctgtctcaaaaaaaaaaaaaaaaaaaaaaaaaaaaaaaagaacgagtctttgagtggtctccagatatcaaagcttcatgctcatgtacagwacaacttgtggtacctgtaaataggayggtttaaggcttccaaagtccttataattctttcttgcagagtataagctcatcatttttcaaagatgaaaaagttgtaagctgtgraataaattgtgccataatcttgtgtagcaggaagttttcctccttgatatttacttaagtgtgggcaattgaattagaaagaacaagagctcacatgatatttattgtctgagatccattattagtgatgcagaaatcatagctaactgatttgagtagtaccaacaattcaggcaacactattgactttctccagggttagtttggaggtgggataccagcaacctgtgctcattcactacttttttctgattttattttccctttgcatagccctttagggtggcattccacaaaaatcttagttagccagaggaataaaagaggaagtcttgtctcgtaaaacccaccraatccattaagggcttacttgagaaaaactgcttattagaaaacaaaatcagccgggygtggtggctcacacctgtaatcccagcactttgggaggccgaggcaggcggatcacgaggtcaagagatggagaccatcctggccaacaaggcgaaacctcgtctttactacaaatataaaaataagctgggcgtagtggtgcgcacctgtagtccctgctactcaggaggcygaggcaggagaatcgcttgaacctgggaggcagaggttgcagtgagccgagatcacaccactgcattccagcctggtgacagagtaagactccgtctcaaaaaaaagaaaagaaaacaacatcacaagcagtgatgtgatttgcactgcacatccacctggcctgtttctagtctcctttgggaactgagcttaagtttcattgtcagggacagaactgaagttttggcttttaggcactgttactgacagatggctatttattaccattgtctggtctgattgcatcttgctcataccattctagttattaaatatttttagcatcacccttggtcaagtaattgcattgkgtcacttgctttccgtcaagtttaagtgtctgttacctacctaaggtacattgtcatggcttaaagcctctgtgtgggtctgagttcagagrtgcttctctgcattgtgagtaacttagttcaatcttctcaagccaacttgcctcttgatggcccttttagtcctaagcttttaaagtgggagcatatgaacacagtagtcaaaagagggaagtcatttgccacccacccaaatgttccatctgcagtatcgaggcagggtgcaccactgtccaggcagtcccctcagggtcagtgtgatatagtgaaagtagtcttgatggatattagccgaggtgctttggcacccatgaaaggtacctgctctggagagaggtgaccaggatgaggtctcagagtgtagtcagcccattaggatacaatgtcctaattgtgggcaatagggcctgttccaaagtttcctactatttcrttatcaaaaacagggttcatccctaccaagactgactcatcagaaatggcagctcattttaaaatcattctatttctatcttctttgctgctatgtttaggagaagcagagctcataggttacaggtatggattttagagttggactggcctaagtccaatcccagctccaccgtttatataatagctgtatgaccttgaccaagtcgcttagctcctctgtgcttcccgttttttaacctgtcaatgggaatggtaaaaatatctgcctcaaagtgctcttagtgacactacaaatgtgcttattaaattaaatgtataaaaataccacagtacgcacctagcaccttttatttttggatttagcagttgttggtagctacaagattaatttgatttattaaaagcaaggttttcccatgttcacactgctaagatatgatatggagaatttcagatggaaacgcataataatrgcaaaggctgatacaagttttactatgttttggatactgttctagtctctttaaatatattaacttacttaatctacacaataactttataaagtgaataatattagtattcccatttcacagctaggaaactgagacatggtgaaattgtctttccaaggccagacagcatgtaagccaccgaggcaggccttaagggacccctaccctcgcttaccatctggctgcaaatttcatgctctttcccttcataatagataatgtctcagttgggggccagcgggatggatagtgatggaatgagtgtgcactgtatgttatttgaatgtgatgaagaaatagaataactctctcatgtaaataggcaagttcaattgttgcagatctgtagaatttcagtgaaagtgaaagtgttttctggaggcttcgtaacccacctagcctcccttgtggctttactacccctctcttgagttacattgggtgatgcaggcttagtggcgaatgattcaaaatactactcttcattaaatcacaaagtgttttggtcttctggtagtactttctcatattctcaggtctgaagtgatttgctcagttttccaaaaatacatccactttgaaatgcattaagttgttgtatttcaccctacacatactgatatatctcacaactatataccattctgcacacagtgccctatctaaaattgtgctttttgtcaatgtattgcacaacctttctccttccttccccttactttacacttgctaactacaacaactagactattctatgcacctttatttgttttctttgcgatcactgggaatgatgcgcttggtttgtctttatactgcaggagaacttttaaaattgatgtaacgatgaagctgatgctatgctcagtttacatttctgcccaaaatgatagctctcaataaatatttgctgctttgaggtacacatcttttggaagaacttgctccaggggatccatcttaaaaaattctcaggtgtttatgtcttgtaaacctttgagtaaggctttagagcaaacagttacatctgccagcatttctgtgggtactgacgtttcacagggagacccagagtcttagacttttgaacattataatgactgcgtagtttttaattgtgcaacgaaggaaatctcaagtgaatttagggcactgtgctgacagtgtcatatgcattactccactggatttccacagttactctataaggtaggttttattacaatttccatttacaaatgaagaatctgaggctacacagctcagatgtcaccttttcaaggtaaaaggaaactaatgaacctaggaatgaacctctgtagtctgtctgtaagctctatgagagcagggatgaggccaattttgctcctcattttgctcaaaccctggacctaacacagtgaatggtccatttgatgtactcagcgatgcatgaatgaataaatgaaagagacccccagaaaaccagaaccatgattgttaacagcaagataggcatatctggcggggcatggtggctcatgcctgtaatcccagcactttgggaggctgaggtgggtggatcagttggggtcaggagtttgagaccgtcctggcccacatggtgaaacctcgtctgtactaaaaatacaaaaatcagctgggtgtggtggcatgcgcctgttgtcccagttacttgggaggctgaggcaggaggatcgcttaagcctgggaggcagaggctgtagtgaaccaagatcatctcaaaaaaaaaaaaaaaaaaaaaagaatatcttgaagtattaatgatttcctatctggcattcaacattttcttaggttttgagatgtggcaatttatacaaataaatgtttgtatagcataaaaattctaataccgttacttgttgtataatgaactgcttttagttgacattctcttttcttttaactggactttaacttctatagtttgtctatttttttataaatcatggttccttaaactgaaggcagcaaaccatcaggggcctaattaaggctgcatagtacattataattacagtgctcattttgtgtgttttatttcagctaatttactccagcaaactcctgactcatattcatcttttcttctaataaaagactcttggtccatcatttttgtttgtctgttttgcaaatgcatccacgatattccctcattctgtatatggataatgatgtgatccaccttttatcttcactaacttccatttttatttatttttctctccttttcttaattttgccaagccgtgttatattttagttttaacctctgttgcttttttctcctttttggagctttatgagtgctcaagatttaatgggcttattttcttctttagccacaaaaccagcataaaaatatgaagcatatgtaattatgtattttggtaatttggcttgagcccaaatctcttggaattgttatttttaagtgtatatatacatatatatatatatatatacacacacatatatatattcatatcaatttatttttctctatttctgtgacttacggaaactctatttagagtaatgtatttatttcatgagttaaccccctgttaacaggaagcaaaatgtgcactgcttcttttttcttttctttctgattatatgtaaagaataaaaagttaaaaaataatttaccagtttatcttatattgagactcaaatgatttcttgacttcaaatttatacccattttaaacaaacaaaaacatttttctccggctcagtggtgattcagtttgtgatacacaaaattcactgcaaacatttaaaaagatgtgttgtaattatgctatatattgactcatcattcaactcttgctatttgttttgggtagacccaattctccttggtaggaagagcaaactaagcttccagttagctcaagctagacgtttctatagttcctactttctcattttccctcatggttgtgcttactcttgaaaataagacaacttagatgcaatgcgtaagttatcactcattggcagtttaatttaaactcgtggaaaaaaacaacagatttgtgcctttacagaaccctctcagatgcacaggcccagatacaaattactgcttttacacataactcagattctttcccttacagcctcaccattgctgtgtagcaaaaaaaaaaaaaaaaaaaaaaaaaaccacctcccaaactccttggatcttgtgccaacatggaactagctagaccatgtcttctctacagcaaactgctgcttacttcatttgcatgtttttcttttttcatgatgttggtttcgtaagaagacactcctgttaaccaggggtgctttatgctttgttttagcatttattaaaccctaagtcttagttgaactttcactacttttttaattttatgagtacatagtaggtgtatatactcatgggacacatgagatgttttgatacaggcatgcaatgtgaaataagcacatcatggagaatgggttatccatcccctttcaagcatttcttctttgagttacaagcaatccagttacgttctttaagttaaagagttaattgtacatttaaaatgtgcaattaagttattattggatatagtcgcactgttgtgctatctagtagtaggtcttactcattctttctatttttttgtacccatcaaccatccctacattcctctagagccccccactacccttcccagcctctggtaactatccttctacttcctgtgtccatgaactcaaatgttttgatttttagatctcgcaaataagtgagaacatgtgatgattgtctttctgtacctggcttatttcacttacatactcatctccagttcatccatgttgttgcaaatgactggatcacattcttttttatggctgaatagtactccattgtgtgtatatactgattttctttatccattcatctgcagacggacatttaggttgcttccaaatcattgcaattatgaacagtactgcaaccaccatggagtgcagatatctcttcggtatactgatttctttcttttgggtatatactcagcagtgggattgctggatcacatagtagctcaatttttagttttttgaggaacctccaaaatgttctccatagtggttgtactaatttacattcctaccaacagtgcaggagggttcccttttctccatacccttgccagcatttgttattgcctgtcttttggatgtaagccattgtaactggagtgcaatgatatctcattatagttttgatttgcatttctctgatgatccttcactgcatttttgactcagctctcctgtaatctcaagaatgcaaaactttctgtggttctgcccacttgccctccttgtttctctgtgcytcgctgtgtctctcgccaaggtctaacaggctggtttaatttctcctgatttactaatttacctgattttatttgaatcaaactaactttgattccatgtcttcatgctgattcatagatatctcccctgaattctcctctgatcagtgttgtccattcagcatttctctacctcttacgactatcatcactgctccacaaaggagcatattggtaattcttccctgttgatctttgtttcatttgccttattttatttcaaccataaaataatagcaaatacttacatcacgttgctttgatccaagctctgttctaaatgtcttacatgtattgctattcataacratttctcctctcccaggcaccattattacatccatttcatagaggtggacactggagcacagagatgttaaatagtttgctaaaaacctgcaaggacacaaaactaggcacatcggcttacatccatgcttatcaccagtatataatacaatagaataataatgatacctcttactatgatatttccccattaaaytttgtaaataccaagactgccaatcagttactcttctgaaaggatgatggtctgtcacatccctaagttatttcatttaggaatgcaaatgtcgttcatgttctgtgtgtttccctgttctttctagtcatttcccagtttacttccccatctttttactcgttatgtcactttatttaattactcagagctaaaagacaaattttcctactttcagtgaaatgtcagtgaaatctggagatattaataaaaaggttctgaccaaaaaagctctaacaggtttcgactcccaggtaggagggaaaaaaatccccaaacaaatacctgtggtttgaataatttgtaattaattcactgggtctctgattgtgacttctttcgctgatctgctgtgracaccgccaaactgtttgactggcactgtatctccactgtttcctttacatggggcagttcaattcctactaattagcactcagccggagtcttcctgtttgcctacctctagcttagacgaaagggtttccatgtcatgattttcaggtggggccaggtgctccttctggagtaatcttttgtccagtattattactcctacttgaaatagaggtggaagagagactttccttctcccagagcagaatcacactcctgtatccttcatgaatagagaactaggttccatctaaatccacatacatcttggtgttctgggatgattttgactgtgttttatttttgcaaaacagttgtaaccatagatgagaaacagtaccatggggggtggggcatggtggtttctaagtctgtggttttcctgggctttctgcagtgatcatgggagcaccagcgtcatggcttgctttgtccccacgttggcctcctgtgcctgtgtggctaccagtctaattccattcacttcttctcccaaatgtaagcttatgcctacttgcgatggggcaaaatccccaggctagattcttcttggtaggtaaagtcagcctacgtagagcactcttgccctgtggcttgtttctagtttttctatacagattctcaacaaattttgttcaacctcagacagcctgagttgtgacctgtgaatatacaatagcaaagtcaactttgatctctaatgaagttcctacagatttgtaagtcaagtaacaaaagtctaagtctatcagtaaaaagcaaacaggaccacttttttttggttacaaaaaacatgataaggaatattctctacccatcacagcacttggccacagctcccaataccattaagttatttctagacatttagttacatccttggagattttcctttctcgggagaacataaataattcacagttacaaccataaaagttttaaggcaaatggctaaatatttgcacgtattaaacatgcagtgcctgcagcctcaattttgtgttctacaaacaaacagcacagaaatttgccgaattcaccaagtaaaatttttcctcaaattgaaacacagataaggaaatcctagcactaagaaatataaattccctatgttgtgtcctctgtcttttctacatttaaaataataacggttttaaatgaaattctccagatataaagtatttcagttattctatttacacttaacaattatgaatcttgttatgagtaaataaataaatggcagatttattttgtttaaacagaatgtgagaaccaacagtccatttatattcattcacttattcatttggcaaacacgagatgaccttccctgggtcagagtgagctgggtgacaaggaggcaaaattaaatcaatatctgctctcaagggctcgttctgtaatgggggattgaaatgagaattttaaaaatgtgaatgtgcttgttactacaaaaggaggaataattaattcatctcagggcattggtaaagactcaccaaatgaggtaactttcaacctttgcaagctgattgagattttgcagtcttagacggtgggagtgtatttagatctgagaataacatcagcaraggattgaaggtgggcaagttcctataagtttcaagagggccttgcctgtctggttcactgctgatcccattccttggaacagtgcctggtaggtgcttaataaatatatatgattcatatgtaggtatacatattaattgttgtttktgggaggaagcggcaggaattgaggctgcaaaggaaggttgcactatctggtttagggactgatattctatgctaaggggagtggactttgaccttggaaggtctgggaagccattaaagattttaagcaagggagtgacattgattaaatgtgtgtttcagcataaccacctacagtttggaggatgggttggggagggaggagaaactggaggagaggatatagtaagaggctattcastgaaaggagaggatgagtttaggagataaatttggacacaggattaatgaattttaacaattagatttaggaaaatgagaaagtgaaagaggattcaaaaatgacttcaggtttttagcttgaatatatggatgcacgatggatgagagaagcaattttacatatatacgtacaaagaaaggtgttatgttcagcttttgaaaaagttagttgggggtacttagagacattctcattgaaatgtccagaagataattaggagatgatatttgaaatcaacttggaatagtcaacctaagttcttgtaactcctcactactaaggtaaatcatgcatgttaaatggccagtaccctgagaccaaccctagtttattgctgtacaatacttaattctartataaactctcagtactgtaatttgtgtgttctctgtgtagcaactggtagcttttgtttatgcttattccaaacttatggaatgaaaataagtttatataacttggatgaagtataagacttaaaagactytccatagattaaaagttaattatagttatatactgtagagaggaaaggcagctaatgttactggccttttgttgtcaggcctcattaagttgcatgaattgactaagtattgagatttagtggcagaaataaaatgtaagtagacattacttcctattgttttatgattcttttaaaatacgtttcttactataaaagttatgcatgctcatttcacagaatttatgaaatattgggagagaagtatacaaatccagcaataaccaagactaacctttttaggtaataacttctggtcttttttaaaatatgtattttatacaaatgaatatattttacatagttgcaattataatstatatgttattttggatctactcttaaaaagttacattgattattatatatttctatgatgttaaaaggttctctcaaatcatttctataaacttattaaaacataaaattcaattgttttgcattattagttgtagttagttgaaatttttttaagtaatttgtagtatatttataattctttcattccataatactgttatgatctgccaagcttttaaatttgagaatctaaccataagcttcacgactatagctatttcttggtcttattgaatgtatttagaatttagtggtcaaatgattgtaactattgatattataatcttcattaagcactgtttctctgcatcatttttcatccaagtgttcaaagcatatatcagcataatttaaatatacgcataatattgtatacctattcctttttttatttaaaaatggactctttggtgtttctcatttgttgtcctttaagaattttttattatacaaaagcacatttgctgtttatttcaataaaattaaaaatcaaatttatttcaggctgggtgctgtgtctcgcaactataatttcagcactttgggaggctggtgggaggattgcttgagcccaggagttcaagaccagtctgggcaacataatgagaccacccccgtctctacaaaaaaaaaaaaaaaaaaaagctcagcatggtggcatgcacctatagtcccagccrctcaggaggctacgggaggctaaggtgggaggattgcttaagcccaagagcttgaggctgcagtgagctataatcgtgccaatgctctccagcctgggcaactaagcaagatcctatctcaaaaaaaaattattccaataaaccagggttattcttgaggtattggccatctartatgcctgcatatttcagtttattccaataaaattgaaaataaaacgtgttttctctgactttattgttataattaatagaattagaagckgtcaatgtttttcaactatttatttattggatctgacctgatagaattgaaaaacaaagaaactgttttaatgttaaaccccaaattctgaaagctttctattagactaggctaaataggagaaaaatcggggatttgttttcatatagccatttttgcactttgtgacatacgctatttacttccaaaatctggtcatatcttttctaatatattcagtttattcactctatgggccttcatgagtgtttattttagcacgaaaatttattggtcttcgtcttaacttcttggtcttttttcttaatggttatattgtattccacgattggcaatctttttctgaaaaaggctagtgtcttagtcaagtaggactgttgtagcaaaatatcacaaactgggtgatttataaacaacagaaatgtatttctcacagttctagattctgggaagtccaagatcaaggctcctgcagatatggcatcctgagggcctcctttctcatagaaagttcgtcctcacatggtggaagggacagcaagctcccttggggcctcctttataaaggcactaatcccattcttaagggctctaccttcatgacctaatcacctccccaaggggaacatctcctaataccattgtcaggcctttgagcccaaaggctggatgtacactgtgacctgcacgtgtacatccasatggcctgaagcaactgaagatccacaaaggaagtgaaaatagccttaaccgatgacattccaccattgtgatttgctcctgtcccaccctaactgatacrtatattctcccccacccttaagaaggtactttgtaatattctcccccgcccttaagaatgtactttgtacacctaccccaaacctataagaactaatgataatcccaccatccttcgctgactcctttttcagactcagcccgcctgcactcaggtgaaataaacagccttgttgctcacacaaagcctgttggtggactcttctcacggacgcgcgtgacaaccattgccttgggggttaggatttcaacatatcaattttggagagacgaaaacattcagaccatagcagccagatagttactattacaggccgcgtggaccatgaggtctgttagaatcactcaaccctgcctttgtagtgtgaaagcagccakagacagtatgtaaatgcaggtgcatagaatacacaataaaattttatttataaaaataggcagtatgcgtctgacaagggtctcatatccagaatctataaggaacttaaataacccaacgagcaaaagccaaataaccccattaaaaaattgtcaaaagacttgaacagacacttctcaaaagaagacagacaagcagccaacaaacatatgaaaaatagtctacccacatctccaatcaccagagagaaatgcaaatcagaactacaatgagataccatctcataccagtcacacttggctattgttaaaaagtcaggctgggyacggtggctcacacctgtaatcccagcactttaggagaccaaggtgggcggatcrcctgagatcaggagttcgagaccagcctggccaacatggtgaaaccccatctctactaaaaatacaaaaattgcctgggcatggcggtgggtgcccataatcccagctactccagaggctgaggcaggagagttgcttgaacccgggtggtagaggttgcagtgaagtgaaattgtgccattgcattccagcctgggtaacaaaagcgaaactccatctcaaaaagaaaaaaggcttatattgttggtgggaatgtaaattagttcagccactgtggaaagcagtttggagatttatcaaaaaacttaacagagaactaccatttgacccaggaagcctattactgggtatatatctgaaagaaaattaattgttttaccgaaaagacacatgcacttaaatgttcgtggcatcactattcacaagagcaaagacatgtcatcaatctaggtacccatccacagtaaactgcataaagaaaatgtggtacctatgcgtcatgaaatactacggattgrataaagaaaatgtggtacatatacaccatagaataccacgcagccataataagattgacatcatgtcctttacagcaacatggatgcaactggaggttgttatcctaagcaaattaatgcaggaacagaaaaccacatacagcgtattatcacttatagtgggagctaaacaaggggtactcatggacataaagatagcaacaatagactagccactactaagtgggaggaagggggatcgaacaagggttgaaaaattacctattggttgggctttgctcactacctggttgatgggatcaattgtactgcaaacctcagcattatgcaatatatccatgtaacaaacctgcccatgtatcccttgaatcgaaaataaaagttgaaattattttttataaaaaggcagccgtgtgctctatagcaatcaataatggggagaaaacaaacaaaaacatcgggatagcatgaccagtctattaaaaatgcttttccatttccatgattttattttagcacagaatgaatgagtttattttgtttctacgtttttagtaatagcaaaaaaaaaaggtattcagttttagtatacttatataaagatctgctttaactcgtcagcctcttgtagcattagtttctgttgtctttgatttttaactgttatgcattgttggaacacagcagctgattttgaacagctccaaaatgtaactcaaaatccttttggctgaatatatatttgtgttttaacaaactaagtcattagtgaagaaattagcattaacagtcctcgttttgtaatggattggggcttggatcaaatatagattgtgacagccatagagaattgcctctgtattctatgatacctttgtaaatgtaaaactttgtatttcttttctaagaatattaactccatttgagatgtatgaccctttccacagggttcctctggggcccttcccaatactatgtaactcttagaggtgatgttttctgtatgttgggtctaattggtgtgaatgggacccattctcattgttgacaaggcaagcttgttcagaaaacatgaacacagaggtacacatttagctttacaagttcatgctaaaatttctgataatgaaatttattttctcttctttcctttttaaacttcaagaaaaggcatatactattttatattttgtggtggctagtacctaaaaataccacgatttttaatcccgttttatacattgtgttatttctgtttatttatgtcttattttacatatttctcttatttaacaaactaagaaatcttgtgtactataaacctcaaggagaatgtcatgatctccatggattgggatgcactgttgcaggattacactttcagtgccaagaagcttcataaactggccctaacccacctgtcccctcccccactcactctgtacatgaggcacaccagatatgccccacgttcaagactttactcatgcacatactgcccttcctttcctggaaagcctgaaaatggtcatgaacgtattctttaaggccccacctctgtgttgcttcgtgtackccctccttcgggtagcgttaccggcttcctctgctaaacaccacgtctcagttgtttgccttttcttccctcaactgtgatgtcttcatctttggatattagtcccctctcccaaacaccacctgtcacctatcacagkgccttgtaacagtcacattgagcacagataattacatgttgtactgaatgcacctatgtagaaaaaggaagacactggtcattgtacaccaattaatcatgtgttttttttcctctttctttgttttatctttaggcattctggaagttttacactgtgttttagtagaaagtccagaagctctaaatattattaaagaaggacatattaaatctattatctcacttttagacaaacatggaagaaatcacaaggtaaatgaactattttatttccctgaatgaattctcaaatccttttagatatatttttaaatacaataacttttaaaaagtgtgtcaaatttttcatgagtgtttttaatctcttaattattttttgagatgcagtcgagctctktcgcccaggctggagtgcagtggcgcgatctcagcccactgcaacctccgcctctagggttcaagcattctcctgtctcagcctctcaagtagctgggactacaggtgcatgccaccatgcccggctaatttttgtatttttagtagagacagggttttaccatattggtcaggctggtcttgagctcctgacctcaggtgatccacctgccttggcctcccaaaattctgggattacaggcatgagccaccgcgcctgggcttcatctcttaatcatgatcaagtaatattttttagtgtttattcatagcatcagtgggaacatgaacagttctcaatttatatatgaagaaaagttggaaaattagtgggaaactactgtaatgtttaaataactgagtcaaatgtaactggaggaatgcatttgctttgtaaaaaagtgctgctgatgcttgattctgaagggggaattcgaatcagctgacagtgactgcacccagtggctcatgcctgtcattgcagtaattggggaagccaagatgggagggttgcttgaggccaggagtttgagaccagcctgggtaatatagcaataccctgtctttacaaaaaaagaaaattagccagatgtggtggcatgcacctacagaggctgaggtaggaggattctttgtgcccaggagttcaagtctgcagtgagctatgatcgcatcactgcacttcagcctgggtgacagagtgagatgctgtctgaaaggaaggaaggaaggaaggaaggaaggaaggaaggaaggaaggaagaagggaaggaaggaagggagggagggagggagggaaagcagggagggagggaggatcagctgaaagtaatttctcttttcaggttctggatgtcttgtgctcactctgtgtttgccacggggttgcagtccgttctaaccagcatctcatctgtgacaatctcctaccaggaagagacttgttattgcagacacgtcttgtgaaccatgtcagcaggtaaattcagacagacaatgtcacctgacaggtaccataataaaagaattaatgttcttgccctgtagctgatactatatggtctgttttttaaattagaccatatagtattattttctgtatttttgcagtgaataatatgtctttttctctaacaatcagatgggctaataataaatgaacctagcaaaatatggatttgccgcaaacacatgtataagagcttttattcacattcctatgtagatacataaccattggcatcttcaggaccaccctgacaactgtataggtatatggttgtatataattgtactttacatcttcttagaatgtaactaaaaacactatccttcaatatcattgtttttttctttttttttaagacagagtctcgctctgtcgcccaggctggagtgcagtggcacgatctcggctcactgcaagctccacctcccgggttcaggccattgtcctgcctcagcctcccgagtagctgggactacaggtgcccgccaccacgcctggctaattttttgtatttttagtagagacagggtttcaccgtgttagccaggatggtctcgaactcctgacctcgtgatctgcccgccttggcctcccaaaatgctgggattacaggcgtgagccactgcgcccagccccttcaatatcattttgaggtacctgctatgtgcaatcaaaaatagaatgtccaaaatgtaataaattatgcaaataaccaataaaactacatcttcagttagatctgccttccaaggcacctaacgttcattgaataccatgtgccagctgtggcgctaagggctttacgtgtattctctactgtttgtgtctgtgctttcctaggaaccatgatgattcacattttatagacgaaaaaactggaactggaagtggaacttagatctaaatccagagactgagcttataaccaccgcgccacactgcctttcttatcccctgtattagtcaggcttctctagaggcacagggcgaataggatagctgtatatatgaaagggagtttattaaggagcattgactcacatgatcaccaggtgaagtcccacaaaaagccgtctgcaagctgaggaacaaggacgcccgtctgagtcccaaaacctcaaaagtagggaggccagaagtgcagccttcagcctgtggctgaaggcccgagagcccctggcaaaccactgctaagtccaagagtccaaaagctgaagaacttgggagtccaatgttcaagggcagaaagcacccagcacgggagaaagatgaaggatggaaaactcaaccagtctagtctttctgcgtccctctgtctgcttttattctagctgtgctggcagctgattagatggtgcccacccagattgaggatgggtcggcctctcccagcccactgactcaaatgttaatctcgtttggcaaccccctcacagacacacccaggaacaatactttgcatccttcaatccaatcaagttgacactcagtatgaaccatcacatccctcaaatgaacacataaataaatgataagaaataacggcttacaatcaacaaaacgctgtgtgtgatagtagtaacattgacatactgtatctagcagctagcctggagaaactgataacttcctcctgttttaaacagaaatgtggggtttgttgtgtatttctatgatgtgttttgttttttgagacagagtcttgctctgtcacccaggctggagtgaagtggcatggtctcagctcactgcaatctctgcctcctgggttcaagccattctcctgcctcagcctcctgagtagctgggattacaggtgcacaccaccacacccagctaatttttgtatttttagtagagacggggtttcaccatgttggcaagcctggtctcgaactcctgaccttgtgatccgcccgccttagcctcccaaagtgctgggattacaggtgtgagccactgcacccagctaatgtgttttttaaaaatatataatatacatatatacttattgcatattcactctagggcaaagactttacatttattctattattcaatcctcayaagatgcttaaatttatagatgtttaccagtccattttccaggaggataaatggaggatgagcaaggtttcataactagtgccgggtcacagagctagcaaatggatgctcaaattttctctcttgactcrgaaacccatggtcttccaactgyrcttccaaccacactgtgctggaaaaatggaaattgttaggaaatggatacagctggtttttttctttcgctccttttgaggagctcctttttaaaataaatcaattacatattaaattatgttacctctgctgagctaggaagcaaagtccaagcaccttctatgtttttgtttgtttgtttgttttacagtattgatttaagatttccttcatgattctttatataacagacctgccgtttatgagtgatatgttctgagaccttcattcatttctacctagtattaccatagggtatatgtccactcctaaaatggaattaaatacaacttactgttgtattttttctgttcacagtgaggcataatgaacaacaaagcttattaatcaccttggttccttcataaacaacatgacctacctcagccccatgccccatgtgacacaaagcttagcttaggaaaatttctccatgtccggaattcccaataactccattaattctaaaagtctgctctgagtgtctcagtttatgacataaatatgattaatgatacacaacatgctgaagaggaattaagacaaaataacattagttccttgggtgacactgccaagaaatctcagaagcaaaactgctgatggaatgttcacagtgaagctggctttctctgtgtactacctcagtggtagttttaataattttttagtaattaaggaaatatatatttaatatgtggcatcttagagaagcatgactaatgtttaaaatagtgagatgtggctgggcacggtggctcatgcctgttattccagcacttgggaggtcgaggcaggaggatcacttgagctcagaagtttgataccatcctgggcaacatagcaagatctcatctctactaaaaataaaaaagaaaattagttgggcgtggtggcactcgcctttagtgccagttattcaggaggctgaggtgggaggattccttgagcctgggagatggtggctgcaataaactatgattgcactactgcgcttcagcctaggcaacagagcaagactctgtctcaataaaattaaatgaaatacacaagtgaaattgtgagatgtaaatgaaaacaatgaaaggtttttttggactttccttacatgtgattcccgtctctttaaagcatgagacccartatttttctgggcgtcagtgaaggttctgctcagtataagaaatggtactatgaattgatggtggaccacacagagccctttgtgacagctgaagcaactcacctgcgagtgggctgggcttccactgaaggatattctccctaccctggagggggcgaagagtggggtggaaatggtgttggagatgatctcttctcctatggatttgatggccttcatctctggtcaggtacgtactatccattttctttcaccgtgttccagaagatcttttgctgggcatttctgaaagctattggtgctgcttccattaggtacttctatagggtattaattattcagaaatttagcattgagatgatgagtaagagtgttgaggaacaagcagtatttcactaggggaaaaagaaaatacttaaaattatagtacatttccaagggactgccgagcttgtgaacaatgctgtgtatttaaagagtagatttaaataagagtgtattgcttaggaacaatactgtgtatttaaagagtgcattccgaagcatgaatgaactgcaagaaacttgtgagttttctgctttaattggtatgtttaaagctttagttgccaacataaaagaacaaaaaacaaatcttggaaaataatgggaagaaatagactaagttcagccttctgttagataatgtaatggtgggaaatcaataatttgtaaagtgtggtatgaggactcagatcataacaaatgacactttgtttcagaagtataaaatggtttaaaaataaaggaataggtcatttcaccagctaccaactcttagctttgatggttgagtatatattaaaaatgaatactttatattaaaaaataatattcttttctctgattcatgaagaagtagagtttggttagctccatttaaaagcttagctcttgattatgtagaytttttagatgttaaaattcatctggattctgcagacataagcttatattaataaagctgcatttggaatatagtcctggtatgatcttggcatagtttataaattatttagcatatggaagatgcagaaagttaccttaagttataaagctgaactttgcctcatgtggagtacaaatgatagacatttatgaatgctttatgggcctaaaacttatgaaaaataagaaataagttgaactacacytaagattttatgctaatgagtttatatctaaaagcattccatgtagttgtatctaacaatgatacttactgaattctttcttcattgagtgccaatagctcagttgtctagacgagaggaagctgtattttgattttttgtgaatttttaatttttttttttcgagacagagtcttgctctgttgcccaggctggagtgcagtggtgcaatcttggctcattgcagcctctgcctcccgggttcaagcgattctcatgcctcagcctcctgagtagctgagactaacaggcttgcaccaccatgcccggctaatttttatatatattttagtagagtcggggtttcaccatgctggccaggctcatcttgaattcctggtctcaagtgatctgcctgcctccgcttcccaaagtgctgggattacaagtgtgagccaccgtacccagcctcaatttttaatttttgtgagtacataaaaggtatatatatatttatggggttgaagctgtgttttgcatatttcatctaacctctgaggaatgtggttggagtcctcacagtactgtagactgctttgtacaaaggcgacctgtgccagccagaccatagtcacagtgccttgttcccacaggaaaattgtcctgctgaccaagcagagagaaagagccctaacttcagaagacctattaaacacaaaatagggctaaagtccatgttataaaacatttgaactataatcctttagatactattaccccctctctccctagctcctagtattgctctgcaggaaataagtactcaaatgaataaatgaagcacgtggacttgttttcccattacacagagattagatgaaaaaaaaaaaacattgatcgacaatgccaagttgctttcatttagtctctccatacaataacatattttactatttttgttttgtattcaatttgaagctttttctttcgatacattaaaagtacctggttcttatggaattgaattgtatgcgttataccttttattacaaagtatctgttcagtagaacaataagaacaacaaaaaaaaatttagtgaatctgtggacatgtaccagaaaggacgataggcagtggaatttcaggagaaaagcatcttgaaattttattcattttttttaaatggcaagaaaatacgtatcatatcaggcctacagttgaaaagtattttctcttaagccactgggagtctattaaatgctttgctgattttagattcgtaattaatgaagacaaatctaaattagttggaatgtgagttatgaagctcgaattcatagtaacagataaccttcttgggggtcgttctcctgttttcttcttaatggttgatgtacaatttgaagtatcaaatatcagtgatttccaggatagagcaccttctctgccacttaacattttgtaattggagagtggcagtatttctcggaacaaggattgggctcataagcaaaagtttttagctatgtcttcatttcttctcttcaatttaaactttgcggtgttgctacacttyctctctgtcaatgcagaactggattttgggaatccaggtcccaggtgtttgagaggaccaaaagtataaaaaaatcttggtgctttgagagaatttaaatatagaagtagtgtggaggaatgtrcaggaaagatgggtacaggtttctaatagagggtctataaagctatcgtatccctccaagtgaaaaatatatttgattataatagatatcgtgtaaataacatcgctattagctacagatcatggtacaaacaagaaactagacctttttctgcattgcttttatatgacttttttaaaaagctgcctttattatattcagggaattctagaagagacacttgatagtgaatttattgcctgtggatttgaatattggtaaaatagaaagtgtccacattaaaaaaaaataggtattctctactactggcatttcagatatgtccttggtagagatattggcatgctagaaataaaaagaattattaaaaatacaaagcatgtatcacaaagtctatttttgtctttgctcaagttgaaggttttgtttatgtttatgagcatgtgtgtttgggagaaccttaccttcttttctttcattgtgcagtgagaagcagatgctctcgggacgaattagcaaaggagttcttcgaatcaggaatgggcttagaccataggttggtcttgccggggcaataaataacatttatccaatatcattttcacacctccagttatatcctgctttacttaagaagccaaccaagatcttgtgtgaaataaatgaaaaactataggccaattggcctatagttgtctcacaataagcaacgtgctgcaggaatgaatgatcatattttctgctttcgttatctttatgtatttttattttaaattgatagaatgaagggagtttagcatttgaaaaagggactgacatgaagtacctgctgtgcctgagactctgttacttgtaaaacattaatcgtcaaaataactaaacaaggtgatggtacttggtgttctgtttataagacatccaaattaagagaggttaagtaatttggttatggtcttacaagtagtagatggtaaggtagctatttgaagtccctggagatgttcctttgacatcattatataatctgctcatagataatttctggatcagttgccatccgtctacatgcagaagtttctgtgtatcagaaggtccattttacaacataagtagcagcctgactcctgaaataatctttttatttttttgacaaagagtttaacatgtaacatgcgtttacattcaagatttattccttctgatgttgtgcattggtttgtcactacttattcaaatcttttgactttggctctgaagctgattctctgagataaaaaaatacatgaccttccttaatgttttccccccaataggttgtattgctcgtactgtaagctcaccaaaccaacatctgttaagaactgatgatgtcatcagttgctgtttagatctgagtgccccaagcatctcgttccgaattaatggacaacctgttcaaggaatgtttgagaatttcaacatcgatggcctcttctttccagtcgttagtttctctgcaggaataaagttagtatgtctatgttttttggtctctttcctttctcatttctcatacctccacagaagactctgcactgccattgcccttcttctctaaccattgtttgtctctcctgggcacctgtcctctgcgcattttgcctgtgccttgaaggaggaggtaagcctcacctaagatgggcatcctgcaaggctgaatgctttgtttacggatcccacagtgtttagatgtgggcagtctccctcaaaccagggtcctgaactatttcaaggtgtttttttttttttttttagttcatttatttagatgaaatgagcaaggctgttttaaaaaatactgcttattttcttatattttcattcattttccttttttaagacatagttcctcaccccattgcacaccctcttatttcaatagaaattaaatatcctttttgttgatgaggcccagatggctttcttcagtgttcctctccacctttattctctttattcctttattctctgcccatggtcaatggtgccaagatggtttcctcacactctttccttttttgctattaccagagggaaacaaattaaagtgataatccattgtagttctgcaaatgaaactttaataaatgatggtctgttataataagtaactactctgtcacttatttttatacacacacacacctgtacacttagaaggactccatttgtttcagttattcttttagttataattctcccaggaataattcctagttacaaaagcatcatattgaagaagaaacagagtaatcatgaatattagctatccacgtaccagttactttttctgatgtatttatacaaattatgtttctataagcttctggaatgttttaacatttttatttttcctcacttttctttgcttttctttatttttttggactggacctgatacacaaattagaaaaagaattatggacaggtgcagtagtttgcacctgtaatcccagcactttgggaggccgaggtggaaggattgcttaaggtcaggagtttgtgaccagcctggtcaacacagtgagaccctatctctgcaaaagttttgttttgttttgttttgtttctttagttagcacctagttttgtatgcctgtagtcttagctacccgggaggctgagttgggaggatcacttgaacccaggagctggaggctgtagtaacctgtgactgtgtcactgcacccctgcctgaacaacagagtgagaccttgacacacacaaaaaaagaattacraggaaaatgaaaaatttaaatttatttttgtaaacccgagggccccaggaaatatatatcatttaactgtttcaaaaagtgtttttcaatggaactcagattaaaatagttttgcttaaatgagcagaatgtataaaagattttagtaagttctttttcrttgttgagattgataaacaattagcgataaggttacctgctttcttcaagttgaagtgacatcagaatctcctttaaagcagcagtccccaacctttttggccttaggcaccgcttttgtggaagacaatttttctacgggccagggctggggttgaaggtggggatggtttcaggatgaaactgttccagctcagatcatcaggccttagttcgattctcayagggaatgagcaacccagatccctcacagacacagttcacaatagggttcgcactcctatgaaaatctaaggccactgctgatctcacagggggcagagctcaggcggtaatgctctcttgcccacacagctcacctcctcccttgtgcagcctggttcctaacaggccgcggactggtacctgtcgtggcctgggggttggggcccctgcttcagagaatttcattaggaaattggacattgaaaagtgaccaagaaagtgaaaaaagaatctaaaaaaaaaaaaagaaaagaaaagtgactggtttttcccctcattccttgttaaatcctgtaattttaagcatatagatatttagatcaggtcttttctttatctttcggtactttgggactttaagtgaccagttattacggacatgcacttcattccsgtaagaatgtggtgcatgtgcttttggttacttctccagcaggtgatgtcttcactgacccattaattaacttaagcaggttttctcttttgatgaatatgatgtcctcatgttttaccttttacaattagaggcccttgaattctaaggtgatcacattatgatggtacgtaggggaaaatgtggcttctgataaaatacttttgtactaacaatttttccctaagattttgtgaattagaaaactttaatgtacaccagagataaaattgactctaacgtgcatcctctttagagtacgctttctgcttggagggcgacatggagaattcaaatttcttcctccacctgggtatgctccttgttatgaagctgttctgccaaaagaaaagttgaaagtggaacacagccgagagtacaagcaagaaagaacttacacacgcgacctgctgggccccacagtttccctgacgcaagctgccttcacacccatccctgtggataccagccaggtaccaagatccactcgaatggcaatcactggtattgcagtcatgctgatacacagtggctttacacttggaccacaacccataggaacgaatttcacagtaatacagttgtacagttgacatgtaggactgaaatgagtctcataaaataacacttacctttaccatgtccactcactcattttctattctattctatgtttttgttgtcgttgttgttgtgatggagtcgtgctctgttgtccaggctggagtgcagtggtgcaatctcggctcgctgcaacctctgcctcctgggttcaagcgattctcctgtctcagcctcccaagtagctgggattacaggcgcccaccaccacacctggctaatttttgtatttttagtagagatggggtttcatcacgttggccaggctggtcttgaactcctgatctcaggtgatccacccgctttggcctcccaaagtgttgggattataggcattagccactgtgcctggcctctattctatgttttaagtagttttcccaacccaataaactgattccctaatgtacgaacagattacaacctgaggtgttaaaaacactgttcaaggttgtctttaaagttttattaaaataattaatattacttagtttataaagtgcatattatacttttcatgcacgtctgtgtgaagagactactaaacaggctttgtgtgagcaataaagcttttaatcacctgggtgcaggcgggctgagtccgaaaagagagtcagcaaagggtggtggattatcattagctcttataggttttgggataggcagtgaagttaagagcaatattttgcgggcaggggtggatctcacaaagtacattctcaagggtggggagaattacaaagaaccttcttaagggtgggggagattacaaagtacattgatcagttcgggtggggcagaaacaaatcacaatggtggaatgtcatcagttaaggctatttttacttcttttgtggatcttcagttacttcaggccatctggatgtatacatgcaagtcacaggggatgcgaaggcttggcttgggctcagaggcctgacaatacttttaaaaataggcaataatagcaacaggtggaacttagtgacaaaaatcgtgcaagaaattttaaggtataatagtgttaagatgatttaatatctggggtaatgtactgcacttgaagtaatatcatacagatgtgacacacaccgatcttagagtgtagttcttaagcccccaacctttttggcactaggtaccggtttcctggaagacaatttttccacgagccggtgggctggggttgaaggtggggatggctttgggatgaaactgttctctctcacatcatcaggcattagttagagtctcataaggagtgcgcagttcacaatagggttcacactcctatgagactctaaggagaatatagagaaagatgaggatgccgtataggaaacatggagttttcaatttcttctcatttccttcttcgatacgcttatttggaagatatttagctgacttttatcttgggtatagattaagatcatgaactctagagtcaaagtgcctggcatcaagtactcttcccttaggggagctgctcaccttctttactgggatgcttagagtatgtttgtcatagttaatagataccatattacttggcaaatagtcacccaacaaatgttagctgttgttcctctttttctgtttcatagatgtaatggtgttctgaggttggctatgaattcaatatcgacttatattgatggtgaagtagcttcagtgaggttgtttagatattcaaagtttgtttcttagtttttaaagatcaaagacattgcttccaaagtctgaacttgaattaataccatgcctccaaagcttcagttgcttagcaatcagatttttagctcctcaaatcgtatttcttgttccccctttttatatcatgttgttaaaataaacatgcaaacattgttcatggccaaaattcagtttgcattgcccattgctaaaaggtgggaggatatgtatagtgcaacctaagtttataggaaaaaagatttgggagactagaaatgaacaactagatgatatcatggtagaaacttaaggattacctgagacccagataacctctatcagggaaaggaaacagttatcacctgcttctcttgggaatgccacctcgtcgttgggcattgtggtcatttgcccactctatgtgttgcgagactagctgtggggtcacacagaagtgcttaatcaagacgtaaacaaccagtcccttaccttgggttttttatgaacattcaatttcttccttttaatgggaacatataaagattttgtttcttttctgtgaagcttatatttagaaaccactaacagtaacagagtagagtgtaggggaagatatcaatcactagtcagacatttatacgctcaaagatccgatggactataatgtgggcactgaattgcctttaccctggctaatgaatgctggcccagttggtgtargagcttggggatgatttctcattttaaattatacattccttggtagtagccccatatccattaaacatcttttggttgtccccaccaacactcctttttttttttttctggtggctcataaattgatttggaaacctaagttgtcaaaaaaaaaaggtaccaaaatttatttaaagaatatcatgaaggctgggcgcagtggctcacgcctgtaatcccagcactttgggaggccgaggcgggcggatcacgaggtcaggagatcgaaaccatcctggctaacacggtgaaaccccgtctctactaaaaatacaaaaaaattagccgggcgtagtggtgggcacctgcattcccagctactcgggaggctgaggcaggagaatggtgtgaacccgagaggcggagcttgcagtgagcagagatcgcgccactgcactccagcctgggcgacagagtgagactccgtctcaaggggaaaaaaaaaaaaaaagaatgtcgtgaaatagatggcttagaactttgttctatgattactggtttatgaggcagttttatttagttcaatttgcagtgaagactgttggcactgcatcttattgcatttgtttctgatgtgtcttttttctttttgtaaattttagatcgtgttgcctcctcatctagaaagaataagagaaaaactggcagagaatatccatgaactctgggttatgaataaaattgagcttggctggcagtatggtccggtatgtaattttgaaatttattttcagattctgtgaatacatctttctgaaaacataactttttctgccttttcccgctatggggtgacatcaatcagttagttggattgatttttttccccctacacattagtttttgtgcagttttgccttactacgttattgtagttaatggggctgacaggcattattggcaggttcactgaaggatggtctagctgcctagacaatggaaagttatcagtgtctgggctgaaagttatattttcaaatcaaggttaacatatacagataataggcattgatttttaagccacttaaaagatctcagtgaaattgaaagtgaaaactgaaaatgaaaagaaggcaatttacttttctctcgctcatgtttcttttctttcagttccaattgtgtgtaaaagcggaaacctgtgggcaartgttcctagttggtttcacaggtagaatgaagactgagaaaccatgattgcacatgcttctaaatgatactttgctaaagagcttagtttacaacttaatacaatttagatttaaaacaaacaactacctgtgtaatcctagtgtatatcatatacttgtttgtgtcaaaaccatggtaatactttcatttgtatgatatattctaagtgtcccaaaggccataacactttcttatacctgactgaatatggaaattaatgtatttacccttcatagtttattgcattgagctctgaataaagaatacttaatataacgttagtagtagtatcatgtgatactccacactactcagtaatatttatatatttattcagtgttttgcattcttgcatacagattattaggtcaaattgtcattacagtgaactgggttgtgttgttatttcagttgtactggtgatgacctagcggagagttcttgcagttgctaaatgccttggcaggcatcacatagctagtgagtagcagctccaagactggaatcaaggttttctamgacagaatttagaaagtgactgcaagtcactgtaaggcttgctgaagcatgaccagaaaatgggatgcttttattaactaaatgatagttagacatttgttacaccaacaaacacttgggtacctagttttgtgctacgttcatcaattttttttatttttttgctatagagtttcgctcttgttacccagcctggagtgcagtggtgtgatcttggctcactgcaacctccacctacccggtttaagcgattctcctgcttcagcctcccaagtagctggttttacaggcatgcaccaccacacgtggctaattttgtatttttagtagagaccagtttcaccatgtggccaggctggtctcgaactcctgacctcaggtgatctgcccacctcagcctcccaaagtgctgggattacaggctggattacaggcatgcccggcctcatcaattcttaaaattgaaggacatgtataaatgctaaataaaagactggaccatctattagtcagtaggaagagagatgctacaaatgtgtaagtaatcaattgccagaggaattacaggcaacattctccagaagtttcaaaaataggaagagatgattagaggccaggaagattttttaaaaagttcccattaaaaaaaaaaaaacaaacaaaatgtaaaacaaacagcaaaaccccatattataatagcaaatatttcaacgggcttctaagatgatctccactgcaaactcctagtaagttcacctaagtggttatgttttgcagtggaaccttaggtgtgtttcttctttaagaactgactaaaatataaagtctcactattattgattcttccagttacatttagttctggttgataccatacatcacattcctgccatgttcaagacactcttcgggttttcttttttttttttttttttttttttgagacggagtcttgctctgtcgcccaggctggagtgcagtggcgggatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccagggttttcaaatattaaaggataatacagtaccgtggggccttcttgcccgcaactgactcaagttatcctttgctgggtctgaggccagttgaggcaacactgggcttgatgtacctctgggggaaacactgagcccttggtctgctgctgttgtgttagcacccgcacctttcctggtgcaggaggtgttctctcatctaatgtatgatttgcagtctgcttcttttccaagaccttccctgaaactcctttttgtgtagtagttagaatccttgaccttgtgatgtcaattattctagattaagatatgtgcctgttactatgctaatttcataaattcattaacattttaaatgaggttttgaagtattcaagtatatttttctttggagcaatttatacttagctacccagcatgctggattttttgaagaagaggaagttatcgttactttgggatatatttcccaggagtatggtgcaagggccctattttgtggaataacaaggcagatctgtctatcatttattcgtccctttaacatttattgtatgtctactatttgcctggtgtgtttagtactggggacccaattttgaaaagaccttgacttttaaggtattatgtttgccttcttggcgcttcctctttagttgaatgattggtaggcaaacaattacagagtaaagaagtaatatttagctcttcccagggaaatcagggaaggcttccaggaggaggtaaatatttgatccaagactgagggatgtgtacaagatagctggcaatcagaaagcatgaccgtgtagtaggcagaggacctggcatgtgtaaaagcgaggaggcagaagagacaggacattagccatgacctttcagtagygcagtgttgcaagaggacacctctgctgtggtgtggagaagaggtgagaagccaggccatgtatgcaggaagtgtgtcacaaaaggcttggaaagaagatgattttattctgtagggggctaaagagcattgaaaaatgcttagcaggaaggtgacagacttatgtctgctttcaaaagaagctctgctgtgaatgtggaaaagcagagagcctggaggcaggaagagagacagggagagggcacaggtacctcaggtgagaggcgactcagagccccgcagtggggatagagagacgtgattacaggagatgttttggtgttcacgtatgggatgtagcaggagaaggaagggaatctgcgcagatttctggtttcattgagacacttgagaagatgatggtgttggttattctggtatagagagtagagacaaagtggagatgacctaaatagggagattatttgtgggttcaacacattcatttttacaaatgctcattttatgtttcgtttgtagggttagagatttagagtttagaataaaattacataactcaatttcattttcaaagttctgcaatcaaataagtatatctaatatatgattctatataagtcttgttcattcataatgatgaccagaaagaaaggaataaatacatcatttctaacttggtgactgctgaagacttaaaaaaaaagctcactcatgtttctgtccttctcatgtggcatttttaggatctggtaatgatgctcatgaactaatttgttccctgacagcatatggctgccatctaggtgctgccacggcgttaatgccgatgcgatttaggtctctgagaagataacaaacctaattactaatgcaaggagagagaacatctttctcattaattcattcctaaaaccttgcatttagtttaatgtgattgctaatatgcagtttcaagaattaatataaaaaccacctgcatatgatgctaatggattttgcgaaggtagtagggtgatttgtgagatcaggaggtaacatgcagggggtaaaagaaacagctagaaccacctcaaagtgtttatgtcagtcagtcctgtcgttaattgatgtctgtaatcagtttggttctatacaggaaaatcactatgaattaaaactaagtcattgccacacccttcttacacaggatttatttcaatttataaaaygtgtcaagtgcctaggacataccaggcatgtttaaggtgtttgggacacatcaaagaacaaaagagaccaaaatctttgcatttttgatcttctaattcacggagacagacaatagcccaataactcaataaatccaatctgttagaaggtgtatggaccaaaaaaaaaaaaaaaaaaagagtaagctgggcaggcagactgtcctaattagacaagtgggcagggtaaacctcactgagaaaataagatataagcaaatgctgcaaggagctgactgagtgagcctgtgggaatctggggtagaagtctgcatggcgggggttcatggaagctctgtcaaacagaagggaaggaacgaagataatgccagcttttaccagtgacctcagatactcactgcgcctgagaggttgtgggggcagctttgcaggggtaatgatctgggtgtttcttcttgccttctgcctccactttctaccacacagttgaattccattgctagtgcctggcattggagactattttatgtcaatttcctgtcctgtttcaggttagagatgacaacaagagacaacacccatgcctggtggagttctccaagctgcctgaacaggagcgcaattacaacttacaaatgtcgcttgagaccctgaagtgagtttcttaactttttctattttccaacctgccttccctgaaaaaaaaaaaaaaaaaaaaaaaaacaggtattgatgctatatgttaattgagctgtgaagtgatttttaattccagctagaactttttataatgcataagtggattggatcagtatttgttgagaataagactttgaccctgttaatttatgtcctcttgttctacatcagtattttgcaaagggtgtcctacaggtgtatatgggtattatggatgatgaggattttgtgacctgataggatacaggtccacagaatgtgggctgtggaccgggactgtgtcagtcacaaattgttactggtttgtgactaaataagatattaagagcaagtgtttataaacttctataccaatttagggaagcaattttacatatattgaatctaatgatttaagaaatgtgaggtcatagcctgtatgtcttcattttgaaaattcagttttctctaacaattttattgtattatatcaggaaaaaccacaatagaccaaatattaaaagaaaattagttcttcaccataggtaatttgagaagcactgatttaatatatttaaaagatgctaaattcaaagagttgaataatttaaaattttttgctgatggacttttcagaactttggggtgaagtctgtttatggtatttcctaaactgatttcaccatagcagcctgttttcagagcatacctatgaggactatttatctgagcaccatatctttggttttgttttagttttttaaggagccaaagtcagctgggcatagtgactcgtgcttataatcccagcccttcggaaggccaaggccagtagatggcttgagcccaggagtttgagaccatcctgggctacatagtgagaccccatgtcaacaaaaaatatgaaacttatctgggcataatggcgcacacctgagtcccagctacttggaggctgaggtgggaggatggattgagcctgggagattgaggctccagtgagctgtgatcacgccactgcactccagcctggatgacagagcaggaccctgtctcaaaaatgatagtaataaaaataaatttaaaaggagccagagtcttactgtgttgcccaggctggcgagcaacggcaattcacaggctggatcatggcgcactgcagcctgcaactcctgggttcaggtgattctctggcccagtctgggtatctaggactacaggagcttgccactgcatccagcctgagcacatattttgagaaaagctactgtagagtattttatatcacccagtaaaggcaaatttgctttttagtgattgctgccagttgacctcttgactttgccccttacctttgcagacggaataatgggactgaaatggaataaaggaaggaatataatttcgaattttgatatagaaaagtaaagagaatatttttgcaaagccagtaactttactcttgtcctccttccatccttgatgtcctacagaactggatttgytccaataggtcacttatcctaatatgtttttatattaygtacaaaactctagtcctttttgtttgtttcagttttgttaagagtagtaaggagttatttccactgaaattattttaccagggacccggaacataaaatttaaaccgcatttcaaattctagaatttggactcgggtatatagtcatgagctgcctaacagtgtttgactcaatgatggactgcatatatgatggtggccatgagattataatggagctgaaaaattcctataacttatgacatcacagttgtcataacatcctagtgcaacgcactaccttttctatatttagatacccaaatacttaccattgtgttacagttgtctacagtatttggtgaagtaacatgtacaagtttgtagcctagcagcaataggctatatcgtatagcttaggtgtgtagtaggctctacgatctaggtttgtacgaatatactctataatgttcacataatgatgaaaacacctaaagacccatttctcagagtatatccccattgttaagtgatgtataactctatatcctcaaggatgcagattatcatgtaaataaacacattaggcataagattgagcttagggtctactaggaacttaaaagaaaaagcaatatatacacatcaagtaaattgagaacctaaaggttaaaaatgacaaggtttgcttgtaataaagaatgcataaygagccctgtgtcctgagtacgtggattcagcatctctgatcttcctttgcgctcttgacatgaggcttgtatatttagcttagtaattcatagcagctcattatttcttcatcttttacaacagaatgttttattgaaaggtcaaggtctaacataatttaaatttgcagtgcattccctattattttagcaattgacagctaagccagctatagcagagagtaaattctggactgtagaaatctctgtatttgcatttagcatgttgtgcctttgactattacatgtaatccagtgtcatacctaccagctgctggtggctgatttggttaatcttcagactgcgtgtactgtggttttattctctctgatgaatgtaaatcaccctcttcacaagcaaatgcttaacatttctttgttgattttcttatagctagtttatatggttttatgatggactgatttttatttatttatttacaaattgaattaggggaaaacatctgtacttctctaagattcataccatgcccaattccaagggtttagagaaagtacagtactttcttcctatatttcctttattcacttatttaattggcaggccccagagcagcgtagctaagaacacagactctggagttgggtcatctggacttaagggcttggtccaccgaggaaatgttgctggagtcactcaactcctctgaaccctaggttttcttctccttagtagaatgaggatcataatgtatttgcttcatggaattattatagggactaactaataggatattgataaaggctttaacaccatatgtctgagagggagcatagtctaggttttttgtttgtttaataaatatatcatgggagggatgaacagcttcatttgtttacatctttagaagttccaagtaacaaataagcaagaaattattccagaatatcccttattttgggttgaggagcaatttaatgaaatatgaattttgggtgctgtttctgtgatttttttcttatgtaaattgttgacagtgacaacttactttagacttccatcgtcatctgtgtatcgtacggtactgcgaaattgtgacactctcagaacagcacagcttggcagatcatgcctgccagatgaccctcaaatgtgaccagtgttaccaaaggttcagtttctggtttagtttttactattttccgaattccagatcttaatttctgaataaacagctcacgttttagaaataattgatataaggatttttaatcgacatgtaatacacattcatagaatttatttctttggaagttaacaaaaatatagtgacactacaatgatatttttcctcctagccaagtatttttcctgaaaattatttttagatgatgtagtgtgcttgtgcacgtatgtggtgaaggatgggaggaatagtagggacccaggacacagggatggagaggaaagcagtatggaagggagacaaataactgataaggggagaggtggaatttttgtccaagagagcaagttagtttctcatacctcttttcctcctcctcctccccctccctcccctccctccatcacccaccccttccctccccttcccctccctttttttccttccttccttccttccttccctcccctccttctccttcttctcttcctcctctctttctccttccccttcttcctcgtcttctcctcctccttcctcttctccttcccctacttcctcttctcctccttctcctcctcctccctcttctcttcctccctcttctcctcctccctcttcttctcttctctcttcttttccttcctcttctcctcctccctcttctccttctccctcttctccctctccctcttctccttcttcctcttctccttgctcttctccttctcgctcttctccttcttctcctccctcttcttttttctcttcttcttcttctctttatctttctcctcctttttctgtctcttcctcctcctcctcctcttcttttttctctttggtttcttgctggcaacaatcttcccaacttacttacttatttatttgtttgtttgaaggagtctcgctctgttgcctaggctggagtgcagttacgcgatctcagctcactgcaacctctgcctcccagattcaagtgattctcctgcctcagcctcccgagtagctgggattacaggcacctgccaccacctctggttaatttttctttcgtatttttttttgtagagatggggtttcgccatcttggccaggctggtctcaaacccctggcctcaggtgatccacccgcctcagcctctcagaatgctgggattgcaggcgtgagccactgtgcctggccaatcttcccaagttctaaatgttgtgaatctttatgttcagtcctgggccatttcttctcagtgtgcaagctctctgaaggtattctcaccactccactccgtgacttaattaccacacaggtgctgatacctccccaaatatccatctctaccccagacatctgctctgagtgacggaattgtttgtcctatcattccattgacattttcccctggatgcatcagaagtgacctagacctatatagctttatgtcccctgtatttgcatttagggtgttgagtctttcaacatgccaggctattcatcctgctacacatgccaggaacctgggaatcacctttgactcttccctttgtttcattcctacttctagcccattatcaggtccccccaagtatacgtcactcttcctccatcctgcctttccacagcagtcagtctggtccaagccaccatcatctgtcacccagactaccatagccatctcctaactggtcctcccacttgccgtctttattctgcacacagcagcctgagttcatacacacacgtgcattcattcatattttgcttaaaactgttcaatggcttcccatggaacttggagtctgatatcttcacaagtgtgtgcatggcccagacaatctgacacccctmctgtttgtcatcatgccttgcaccactctttgccttgttccttatgttccagccctcatggtctcttcctgataatgagttaaactttttcctgcctcactattctgttccctttgcctggaaaattcttcatttcacccttaaaggatctcctccctactcatccctcaggccttcatttaaatatcacttccctgataagaatttcctcaccacttccttcacttcctttataacacctgatagtgtgtttataactcaccacaatttgtaatatcactttctgaggttatttaatatttgcctttccttctagaccaggggtgtccaatctttttgcttccctgggccacattggaagaattatcttgggccacacacaaaatacactaacactaatgatagctgatgaactaaaacacaaatcacaaaaagatctcataatgttttaggaaagtttatgaatttgtgttgggccacattcaaagccatcctgggctgtgggctggaaaagcttgttctagactgtaagctccatgaagccaggaactataattaaaaaaaaaaaaggttttattttttagagcagatttaggttctcagcaaagttaaaagaaagatacagagacttttcttatgccccctgtttccacaggcaactgccctcaacagagtggtacatttataacaattgataaacstacattgacacatcattatcacccaaagtccacagcatgattttttttttaaattcacaatcatgtacctagtcctcaaaaggtatccagcgcataacattctcagatgccaacttgcttagatattgcaaatgtacctcaaactttgtgacttttttataccttcaaatctcaggctcctttcagtgtccttctcttgttgtgttaagtgcccctcagaacacaactcagatatctgggagtcatcctggacacatcccttcccttcacccatggctttctattgatatgttaatctatcgacttctttattttcttccattattaatgttactatcaccacatcatcaactccaacatgattgccaccctatgctaacctagtctaagctaccattgtttcccacctgaaattataatatcctcccaacagatccaattgaaatacaccctagatactytcttttctattgtttttttttgcctttttaaaaattgtacaaatttacagggtacatgtgcaattttgttacatgcataaagtaacaaaagtcaagactttgagggtatccatcacccagttaatgtatattgcacccattacgtaatttctcatcatctactcccttccaatcccctcactcttccaagtctccatgaattgtcattctactctctatgtccatgtgtgcacatttttttaacacccacttgtgaatgagaacatgggtatttgcctttctgggtctagcttatttcagttaaaataatgaccccagttctaatcatgttgctacaaaatacatgatttcattcttctttactgctgaataatagtccattatgtatatatgccacattttctttatccattcatccattgatggacacttaggttccttccatttctttgctgatgtgaatagtgccgcaataaacatgcaagtgcagatgtctttttgatatatggatttcttttccttcgggtagatatccaatagtaggattactggatcgaatggtagttttatttttagttccttgacaagtttctatactattttttcatagaggctgtactaatttacattcccaccaacagtgcataagagttcccttttctctgcatcctcgccaacatctgtttttttgtttgtttgtttgcatttttaagaatagccattctgactggtgtaggatgacatcccacctgggttttagtttgcatttctctgatgattagtgatgttcagcattttctcatatacctgttagccatttgtatgtcttattttgaaaaatgtctattcatttcctttgcccagtttttaaggagactatttgatgcttttcttgttgttgaattgtttgtttcttgcatattctggatgaatgagtagtttgatgtcagatgaattctttgcaaatattttcttgcattctgcaggtagtctcttcactctgttgattctttctctcactgtgcagaagcttattagtttaaataggtcttgtttgtctatttttgtttttgttgcctgggtttttgacgtcttagtcataaattctttgcctagacaaatgttcagaagagttttccctagattttcttctagtatttttataattttgagtcttttgtttaagtcttaacccatcttgagttgatttttgtacatggtgagagataggggaccagttttactcttctgcatatggccatccagttttcccagcaacatgtattgaagagtgtatcctttctccaatgtatgctcttgttggctttgtgaaagccaacaaatatggctgtaartatgtagctttatttctgggttctctattctgttccattgatctattcatctgtttttctaccagtaccatgctgtgttggttactatagccttataatagaatttgaagtcaggtaatatgatgcctccttttatttacccctcaggattgctttggctatttggactctttcttgttccatttgaattttaggattgtttttccctaattctgtgaaaaatgacattggcattttgatatgagttgcattgaatttatggattgctttgggcaatattgtcattttaacaatactgattcttcagatttttgatcatgggctgtttttgtgtwtgtttgcatcatctataatttctttcatcattgttttatagtttctcttgtacagatcttgtacacctccttggttaaatatattttaattaggtattttaggtatttcaatgaggtattttaatttttatgtggatattgtaaataggattgcctccttgatttgtttcttagttagattgttactggtctatagatatgctaccaatttttgtacattgattttacatgctgcaactttactgaattccatttatcaaataagagttttttgtggcatctttaggttttccttgacataagatcaaattgtcagcaaacaaggataattagacttcattttttccagtttagatgccatttatttctttccattgcctaatttctctcactaggcctttcagtactgtaatgaataggagtggtaaaagtaaatatccttgttttgttccagttcttacagggaaagttttcaactttccccattcagcataatgttagctgtgagattgttgtatatggcctttattattttgaggtatgctccttctatcccttgtttatggagagttcttattatgaagcgatgctgaattttatcaaatgctttttctgcacctattgagatgctcatatggtatttgttgttggttcagtttttgcgacgtatcacatttattgatttgcagatgttgaaccatccttgtgtccctgataaaaacccacttaactcctgaaaacatgcagcctccctcccaagactgaaccaggaagaaattgaaaacctgaacagagcaataacaagtagcaagactgaatcagtggccaggtgcggtggctcatgcctgtaatcccagcactttgggaggccaaggtgggtggatcacttgaggtcaggagttccagaccagcctggccaacatggtgaaaccccaactttattaaaaatacaaaaattagctgggtgtgatggtgcacaccagtaatcccagctwctcaaggaggctgaggcaggagaattgctttaacctgggagacagagtttgcsataagccgggattgtgccactgcactctagcctaggtgacagagtgagactctgtctccaaaaaaaaggattgaatcagtaataaaaattgtcccaacaatgaaaagcccaggatcagatggatttacagatgaattatacctaacatacatagaactaatatcaatcctcctgaaactgtttcaaaaaartcaaggagcaggaaattctccctaaccgctctatgaagccagtatcaccctggtaccaaaaccagacaaagacacaacaacaaagaaaactacagaccaatatccctgattaacatagacacaacagtcctcaacaaaaataccagcaaacaaaatgcaatagcacctctagctattctgtactttgtagccagtgtgttcatttcaaacattaaggtgaccatgtcaatctttctatttaaaatcccttaatggggccaggcacggtgggtcacctgaggtcaggtgagcctgtaatctcagcactttgggaggccaaagcaggtggatcatctgaggtcaggagttcaagagcagcctggccaacatggtgaaaccctgtctctactaaaattataaaaattagccaagcgtcatggcaggtgcctgtaatcccagctgctcgggaggctgaggcaggagaattgcttgaacccaggaggcagaggttgcagcgagccgagatcatgctgctgcactccagcctgggtgacagagcragactccatctcaaaaagaaaaaaaaaattaaatacataaaaaaataaaataaaatcccttaatggcttttcattgcttttaagctaaatatggtgctttaatttgccaaagtatcccaaaatctggggcctcccctctcaccagcctcattataagtgaggctgcccttgtactcttgcttgcagtcacactgacctttgtgttgcttgcctgtccgcacattccattccaccacaagatcttccacacatcctcttcttggaatgctcttttctttttttattatactttaagttttagggtacatgtgtacaacgtgcaggttaaatatgtatacatgtgccatgttggtgtgctgcacccattaactcgtcatttaacattarctatatctcctaatgctatccctccccgctcccccyaccccacaacaggccccrgggtgtgatgtggaatgctgttttctatgcctggctctcatcctttggatcaggrctgtccaatcttctggcttccctgggccatagcagaaaaagaattgtcttgggccacacataaaatacactataatactaacaatagctgatgagctaaattttaaaaatcacacaaagaaatctcataatattttaagaaagtttatgaatttgtgttgggccacattcaaagagctgtcctaggccgcatgtagcccgcaggctgcgtgttggacaagcttgccagatctaaggtcaggttcacttctttcgaacatgttgtctgagttccttgactcaacarttttacttctataggtactcatcctttctgtactcccagtatagaagctttccctgtgtgtgggaattacatggttgcctctgtactccacygaccatatgtttcatgacagcaggcatctcacttgatttttgttaccatttttcaaattttacttagagctcagtaaatattcatcaaatgaatgaattaataaataaatgataaatctcagtcagtaactgggtttttacataccaaatgcctacctacagggtgcctcacatttgcttcctaacagtctgtttacttttctgcagctatatagtttaagtactaaaatgctacattaccaatccctgctgcttaatctagtagtaaatatttactgaatgcatgtaaggccaagaacctgctcccaactaatcctttcttgcttcccttattttgtgcatttctagcctttctatcagctttgcagttccaacttatagtgtgctgtttctctcaccacccttcagcagacttaaaaaaaatgagttaaacaatgttaaatcatcaaataaagtggttcaataaagatgatacagaaaccaaacacttcattcaaacaaagaacttgatatggttgtagtgttaataaatatattttaaatataatccattgctcccattttaaaacctcctcggattaggcaaagagtacttagatacaacatccaaaacatgacctattaaagaaaacagtccatccattggagttaattaaaagtaaaactttctgtacttcaaaagaagccattaagaaaatgaagagacaggccaccagctgggagagaatatttgtgaatcaagcacaattgtattaataggatttgtagtaaatcataccaatcctaacaaaggacttgtatccagaatatatatagaaatcttataactcaataataagaatacacaaaacctgatttaaaaattggcaaaacagctgggcatggtggctcacgcctataattccagcactttgggagactgagttgggtggctcacttgaggtctgaagttagaaaccagcctggccaacatggtgaaactccatctctactaaaaatacaaaaaaattagctgcacgtggtggcaggcgcctgtaatcccagctaccagggagactgaggcaggagaattgcttgaacctgggaggaagtggttgccgtgagccgagattgtgccactgccctcctgcctgggtggcagagcaagattccgtctcaaaaaaaaaaaggcaaaaattggcaaaatactttaccaaagaagatacacagatggctaataaagtgcaatcaaggatgttacacatcatcagtcagaaaaatacaaattaaaaccataagaagatactaccttacacacaataaaatggctataatttttagacagacataccaagtgttggtgaagctataggaaaactgaaacccacatgtattactgcaggcaatgtaaaatggtgccaccactttggaaaatagtttggaagtttcttaaaaagttaaacataaacttaccatagcctagcaattctactcctatgtatctacccaagagaaataaaagcttatgtccctgcaaagatttacacataaatgttcacagaagcattattcataagagccaaaaactggaaactgtgcaaatgttcatcaactaaggaatagataaaatgtgatccagtattacaatggcatattattcagcaataaaaggaaacaaactactgccacatactccaacatggatcaacctgaaaaactttatgccaggtggaaggagccaaacacagaagactccatattgtgtaattctattcctatgaaatgcccaaaacaggcatattgatagagacataaagtagcttaggggctgtctggaggtgagagtgagaaacgcctgcagcaggcatgggggacctcatgggctcgtggaaatggtgcaaagctagattgtgctgatagtcatgcaactctataaatttaataaaaatgaaaataatcagcctctaaaaagtacattttctacctgatgacttctaactttgctattctgcagaataacctttagcagctcctagtccattcacataagtgtaattccctcagcatagcatatgaggccctcayttaatrtcttaatcagggttcttgagataaacagaaccaacagggtgtatgtatgtgtgtgtgtgtatatatacatatatatatagacatatatgtatatacagatatatatagagagagattccttaaagaattggcagggtgctggcaaaattcccttttgctcagaaggtcagtctcttttttctgttgagacctttcactgattagttgaggcccagtcacattatggaaggtagtctgatttacttaaagtgcactatacttttttaaaaagtttagtatttaattttagaatcagagggtacatgtgcgtgtttgtaacataggtatattgctatgtacagagatacataggaatttacctatgtrcgttgttacataggtataatggtgggaatttagattctaatgaacccattacctaaatagtcaacattgtacttgacaggtaatttttcaacactagctcccctcctgctctccttgctttgaagtccctactatctattatttctgtctttatatctgtgtgtatccactttgcttggcccccacttacaagtgagagtatgaagtatttaattttcttttaaatgatgaggataatggcctccaactttatccatgttgctgcaagaaggacatgatttcattctttttcgtggctgtatagttttccatggtgtatatgtaccatattttctttttgcagtcaacagttgacagacacttaagttgattccgtgactttgctattgtaaatagtgccgcaatgaacatgtgagtgcaggtgttttttttgtttgtttgttttttgtttttttgacagagtcttgctctgttgcctaggttggagtgcagtggcatgatctcggctgactgaaacttctgcttcccaggttcaagcaattctcctgccacagcctcccaagtagctgggattacaggtgtccaccaccacgcctggctaatttttgtagttttagtagagacggggtttcaccatgttgttcaggctggtctcaaacgcgtgacctgataatgatttcttggacagatgcggtggctcactcctgtaatcccagcactgtgggaggccaaggccggtgaatcacctgaggtcagatgtttgagaccagcctggccaacatggtgcaaacccatctctactaaaaatacaaaaattagctgggtatggtggtgagcacctgtaacctcagctactttggagactggggcagtagaattgcttgaacccgggaggcggaggttgcagtgagccgagattgcaccattgcactccagcctgggtgacaagagcaaaactcctcaaaawaataataataataataataaatataatgatttcttttcctttgggtasgtatccagttgtgggattgcagggctgaatggtagttctatttttagtttttggagaaatattcatgctgtttcccaaaggggttgaactaatttatgttcctactaacagtgtataagctacatcctcacccacatcttttattttttgactttttaataataaccattctgactggtgtgagatggtatctcattgtggttttagtttacatttttctgatgattggtaattcagatcattttttaatgtgtttatttggctgcttgtatttcctcttttgagaaatgtctgtttatgtccttttttctttcttttcttttcttttttttttcaggaccagagtctcactctgtagcccaggctggagtgcagtggtggatcataggtcactgcagccttgatttccgagactcaggcaaaatttctgcctcagcctttagagtagctggggccacagatgtgtgccaccatgcctgattaaactttgaattatgtgtagagacagagtctccctatgttacccagactggtcttgaactcctgggctcaagcagtcctcctgcctyggcctcccaaagtactggaattataggcatgaaccaccatgcctgaccctttggccggtttttaatacagttgtttgtttttttcctgttgagttgtttaagttctgtgtggattctggatattagtccttcattgggggcataatttgaagatactttctcccattctgtaggttgtctatttactctgtagattattttgctgtgcagatgctttttagtttgattaagtcccatttgtctatttttgtttttgatgcatttgcttctgggatctttatcataaactctacctaggccaatgtccagaagagttttttctaggttttcttctaggtcttacatttatatctttaatccatcttgagttaatttttgtacatggtgagagatagaggtgcaatttcattcttccgcatatggctagccattttttccagcaccatttattgaagaggttgtcatttctccagtgtttatttttgttaactgtgtcaaagatcagttggttgtaggtatgtggctttatttttgggttctgtattccattccattgatctatgtgtctaattttgtaccattaccatgctgttatagttactatatccttatatataagtcaggcaatgtgatgcctctggatttgttcattttgcttaggattgccttggctattcgggctcttttttgattccatgtgaactcaaagtgtagcaatttaaatgttaatctcacccaaaaacagcttcacagaaacatctggaataatgtctgactaaatatgttggcactatgccccagccaagttgatacataaaattagccatcacacataatgagaaatatttatgaagcatatagtgcaccccaaacttaccccagtatttctttttacccttaacctatagtacacggtcaratcttaatactccagtcaacccttctctgcccctcccacacagacccacgatctcctgcttctgtaggttgtctgtcttattcacctacctgaaatatttgcctcytcatctctttatcctttattcccacatgtcttcatctttgaaatgtttaattatccttcttggaatatcttaaagatgcttctaaaacatgtaactttttaaaatgtggaaccctacttggttttattataattcttcagtcatcatcttttctcctatcagactgtaaacactgtcaagagaaacatgtgcagtagtactcctgaaaatatcaaatggaaaactttagaaataaacaatgtataagttttagattgcatgccattttgagcagtgtgatgaaatctcacgccctgctactttgtcctgcccaggatgcgaatcatcgctttgtccccctggyccatgctgtataggctgyctacctgttagtcacttagcaaccatcttggttatcagcttgattgtcatgacactgtagtgcttttgttcaagtaacccttattttatttaataatggccccaacgcacaaaattaaagatgctggcaatttgaatatgtcaaagagaagccataaagtgcttcttttaagtgaaaaggtgaatattctcaacttaataagggaagaaaaatactgtatactgaagttgctaagatctataaaaacaacaattcttctgtctgtgaaattgtgagcagtatgttgttataatagttctattttctattagttactagttttaatcccttactgtgtctaattcatatgttaaattttagtatgtatcatagtatgtatggataggaaaaagtatagggtttggtactatctgtggggttcaggcatccactgggagtcctggaacatatcagccatggataagggaggactactgtactacagagtaccttagatatggtggtaactcaataaatatttatggacttatatatttatgcacatgtggtctattatgttcactgtccgtgtgagttgaattcatacttttctaggtagtttgcattgggaagaagattatgaggctgaattaattagttatgagaagattatagtattgatggcataaaacactggctctctctcagaagcccttaaggatgaattaactaattacattttctatggctcaggcttacttttgatgtcagtacaccatgtgactttstctctcggtctggactcacattaactacattcctggcatgtcacactgaggtactratttgcagtgataataactgtcttataatccaaaatattcatttttacagatcagcttgggaagacacattatcatcagaagatttcttggtgggcatgtgctcaaaggtttaattgcctgagtttatggtaaatcctaatattatgatcaatcttgagttctctcagagctgggttggacatccctctttgatacttttacagccttrtgattacctcattgccctgaagatactatcataattgcctgttgtctgtagcacagggccttgcacatgatagcactcagtagatatttactgaatgaataaataaaggaatggagggtgctggtaaaatcttcctgtcctctggatagtgtctgaataagtgtaatctatatttgttcctgtgagttcgttttttattttattgctgatcaatccctttcaacgtgcacattctttattcagcttattttgtaccttcaatcagctcttggtcttcccatagttttgcaatttaacgctagaaagataatttcatggggttattttaattttttcatatataacaaaatttaactgataattgtgtgtgtatagatggatagatacccatatgtataagcttatatgtatctgtctaaatggttaagcttatacatatagatacttgtctatatggaaatacatatatataatgtacgtatatgtatatacatataaccatcaacctatccacacattattaaaatattatagagataagtattatgggtttgagataattcccacattcttactagaactgatcagaccttagaaattctgtaatcccaaaatattatgccgttatttcttactctatcaaggcaggagaaaccactcagtgccgtgggtactaaagacaaattgtctcaaaatgtctcctgtatatacgcatttctataaaaggtaaaacaataatatcatacacacacacacacacacacacacacacacacacacacaccacgtatatctgctttagtaggtacatagactccccagcaggatatcgaakaattggtaacaattgatgcctttagaggaaggaaacagaactagaagaagttggagggagacttacttttcagtgtattcctttttgtgccatttcagttygcagtgtcttatcccttactcagaaatgaataattagcaaatcagtaaatgttcctttcaccttaaaaacaagacttctgactgggcrcggtggctcacacctgtaatcccagcactttgggaggccgagatgggtggatcacgaggtcaggagatcgagaccatcctggctaacacrgtgaaaccccgtctctactaaaaatacaaaaaattagccgggcgtggtggtgggcacctgtagtcctggctacttgggaggttgaggcaggagaatggcgtgaatccgggaggcggagcttgcagtgagccgagatcgcgccactgcactccagcctgggcgacagagcgagactccgtctcaaaaaaaaaaaaaaaattgtgctttcaaggttgtatctcattgctactgctgctgtcttgggttattctggacatagagaagaaatgatcacacttatctctggttttgttttccaggactttgttggcattaggatgtcatgtgggtatatcagatgaacatgctgaagacaaggtgaaaaaaatgaagctacccaagaagtaagttgaatgactaagcaatattaaataatctgtgtagagatttagtgcaaccaaataactcttgatggacacacagatgccttgcttttactgaagctttaaaattcggattcaaggctgggtgcggtggctcacaccttaatcccagcactttgggaggccaaggcaggtggatcacctgaggtcaggagttcaagaccagcctggccaacatggtgaaaccctrtctccattaaaaatacaaaaattagctgggcgtggtggcaagtgcctgtaatcccagctactcgggaggctgagacaggagaatcgcttgaacttgggaggcagaggctgcagtgagtcaagatcgtgccactgcactccagcctgggcaacagagtgagactccatctcaaaaaaaaaaaaaattcagattcaaaaatttaaactaactgaatgaccctaggggttacattaagtatctggtgaaacaatagtttctatcacattgctgagtgatgaaacaaagctcagaatatatttgggagtgtgttataaaaattgtgttattttcccagtgtgtgtttatatgttaacagaggtatccatatttctaaatgattacatatagctttctactttctgcccaaaaatctttataattttatttacttttacaataaaaatatattcgaggattaattatgaagtcagcattattatccacattttaagatgagaaaattgaggtagatagatgctgtagtactggtttggcctgctgttctatgacctatgtttgtgatcctggttcacttaagacctcacctttctcatctgcctgtgggcattagtaatacctacttaacagggaagttttaggtattaaagaaatattcaataaatgatagctgtttcatattactttcttatttatttaaacttaagtattcaagctgcttttctgatgygcaggacttgtaagtagcaggcctgtagatgtattaaataatagcatcgagatataatcaaagtagccaccccataatctctatcagtcacctcaggcctcatgttaccccagaaaaacataaaatccaagtagaaattgtgcttttgctgtgcaaatgcagatttaagcaagtctctagttcaacagtctatgaacatttttactcaggtgctccataagtgagtttataaaaactgtattgttacctcgtgcagttttaggttctaaaatttttcttgaaaatttaaatagttccaaaagatgtgttttatgggtacattttgcatatttacatttcaaaatgacactttttcatcaactttgagtgtatcttatgagcacagaccacagtgttcagatatctgccatcatctgtgtaaaaatgatataaaaatgttgataatggagaattttacattatttcattttcctttttcaactgtattttcaaattatttctcctactgtatattatgctaataatcaatgttttatgcttggcagtctttgagtactctatcctacattataagtaagatatgtatctaaattgaatttttaattgtttttgttttctgcgatcatagtcattaagttaaaattttcctcctgagttatcattatattattttagtacacaggtgctcaaaacaacataaattgtttttaataaaaagtcatagaaaataggatgttattggaaatagctcatagtaagatggatttaggtattctttatccaattacattatgtattcacgtacaaataatatttattgatagagtcaagttggcagagtggttgcattcttcgttcacataaataatttttgttattaaaaagatcattgagttaagtgaaccaaaaaccataattgtttattatgaaaaatcatatttaatgatttttttcagggtgacagctcaattatgcctttgttcagtttcttgaaagccaaaaattggaatctacctaacttccaaaagaattcattatcctctcattttcattatcctcatcctttccaaaccactctcaggttttttggaaagtatccaaaaaaggcattattaaggctaaaacagaacaaaaccaaaaaccaaaaaacaacaacctagtaattatacctgttactcttttactcagaagaataagaaagtagaaatgttaatttcacattatctttgacagcataatacatttaatcaattgtatcaaatgctatgcgtgagtgtgtgtgcatgtgtgtgtatgtatttgggatacaattcaacttatttcatgtatagattctatctgttataaaatctaattgataaaggcagttttcactgacaaaacaatcagctaaaacagaattatcttttgtcaaaaatatctggttgtatttttctgttgaaacaaatgggttaatacatgtccccatgacaatcatctcaattccaatttctaactttaagataggtagatgatagattgatagctagatgatagacagatagatggatggggcacagggtttaaaaataagtttgtctcattgaggaactaatgtcctctgccttgagtatttattaatgcatattccttgtgttgctctcacaacgcaacacagcaattatttgagagtgggtgaagatatggaaaagctgagacccttaaatgaaaactatacttggatctgctgacagtctatatactgtctctaaattttccatgagatatcattttattctttctctattgacaaaaatcttcataataactggtattgatatgtatgcagatcagcgcgagcctaaaatgttggggttttttaacaaccattttgcaagcaatttggcatcattgtgtaaaattgaacatttgcacgtcttggtacccaacagttccactcatagagatataccctagagacagttcgcaccgacragcaggcaaactatcattcatagcaatgttatttggaatagctaaagaataagggggtagttataggaggtggaagaaatattcttcaataagaaaatgaatcaagttggctatagtctaataataaaatcacggaattataaatgacaccatagatgaacctaaaaaataataagggtgtaaaaaacattctacaagggtgatgcaatgtaaaaccatctttgaggctcaaaagcaagtaaaactaaaaaataaaaactaaatacatattttggagatacatacttcgataaggactgacttttaaaaatcaatgaaattataattctagatagtaattatctttggtataaatataggcagggatgtaagatggggagcaacacacagatagatgtaatgttagtaatgttctaattgttaacttcgtggtggattaatgaagttaattttattataatgctttgaagcatatacttttgtagttattttataatgattttttaaaataaaaatctgatgacagatgtaaatccagatacaccattagtcataacaaatgtacatgggttaaattctccatgtgcgtaacagaaattgtcagattggattcaaaaagataatttatgatatacagctataagaggtacatcaataactttagaacatagaaaagttgaaaatagtaagaatgacacactaggcaatactgctcaaaatgaaactgatgtactctccttttatcagtttctaaataaaattgaccttaaacaaaattaatattaagaaaagaaggccactatatggagaattgagaaaacaagcatcatgctataactactcatgtatacaccaagtaaaacagcttcaaaaatcaatgaagaaaaatactagtagattttcaaaaagaaatagacaaatatgcaatcacagtgatagacctaacacaaatctcagaaactgatatgtgtaacagataaatgttaacaaagattaataaaaatataaacacacaccaattaaaagcttgacatatatagagtgctgcatgcatgaaacatttataaaatttagtatcctttaggacattagacactgatatcgtaaagatcatatccactggatcacaaagaataacagcaaaaataacaaatcatgacacacttagacatttaaaaatatacttctaaataggttatggatcaagcatatcatctggaaaattatttacttatttaccactctgcctttgtttatttctagttaaaaagataacccatatttcttgatcttgctaaatgaacctatccttttttcatgcctttatactcttataaatggatgattcaaaaccagatttttaaaaagctttttaatattttggtttcatttattttattttttaggttgatgaatatgaattgcctatatttatggtataccacatgatactttgaaatatgtatatgctgtggaatggctaaaccaagccaattaatgtatttattacctcacataatcccttttttttttgtgagaacacttaaaatcaaatctcttggcaagttcaatatataatacctcattattaactatattaaccatgctgtacaatagatctcttggatttatacatcatggaaattgtaaaacaataatggaaaaggaaaatatttcatattaaaacatgaattgcatatattaagtattacttggagaaagtaaaagaaaataaattataataagagcaatattaatgaatttggtgggggcgggatgaaatataaacaccaatgatgccaagagcctgttttaaaaacctactaagcaggggaaaaagactctgaaaagattgacaaaggaaaaagaaaaaacaattttgttagcaaacttaggaatattttgaaaaatgtaacaaatgtacattaaaactttctaaaggtaaaagtatggacaattgtatagaataatatcaaaactgatccaataagaaagaaaatacgaatagagctataactattaaaggaattgaatcaaacacacatacacacacacacacacacacacacacacacacgtcccaaacaacttttctattgatttctaccaaatacaatctcacataaagaggaagaaacacttcacagtttattttctgatgatatgattttcatatcaaagcccagatcaagacagtatggaaaagggaagttatagtccattgctattatgagcatagatgcaaaaatgmtaaggaacatactggcaaacaactcagtagtgtattaacaaagtataatatgaccaagctgagtttatcctagtagtgaaaagataggttaacattagaaaatgtatccattaaattgatgcttaataaagacgaaaattcatatgatcatcccaatgtatttagaaataaataattcataagatttttttatttataagcatataaactcttagaaggcaatactctgagagatttctttaacctaacaaggggcaacagaaaccaataatctataaggtaaaatctcaaatttttcctttaaggtttaggaatgagacaatataagtcactactacttgatgtattcaataaggccagtgcagtgagacaagaaaaaaatcatgaggcttggaaaggaaaaacaccaaattgtcatcaatagcaggtaatattgcatagaaaactcaggagaatttacagaattatttctaacaataataggacgcttgaccatttccttaaccttgctttatttctttttaagtgtgcttctgcacttgatgttatttatgtttcatgtcctctaatctgaaatatgcacttgctaaaggaaaaaaatctgtgcatcaaaagcatctgttaatcccagcactttgggaggccgaggcaggcggatcacaaggtcaggagattgagaccatcctggctaacacggtgtaaccccgtctctactaaaaaatacaaaaaattagccgggtggccgggcgtggtggctcacgcctgtaaccccagcactttgggaggccgaggcgggcggatcacgaggtcaggagatcgagaccatcctggctaacatggtgaaaccccgtctctaataaaaatacaaaaaaattagccgggcgtggtggcgggcgcctgtagtccctgctactggggagactgaggcaggagaatggcgtgaatccgggaggcggaggttgcagtgagccgcgatagtgccactgcactccagcccggacgacagagcgagactccgtctcaaaaaaaaaaaaaaaaaaaaaaattagccgggcatggtggtgggcgcctgtagtcccagctactagggaggctgaggcaggagaatggcgtgaacccgggaggcggagcttgcagtgagccgagatcgcgccactgcactccagcctgggcgacagagcgagactccatctcaaaaaaaaaagacttgcagaacaatatcaagaactcctaaaaattaataaaaagatgcccaaatagaaaaatgagcaaaggatatgaacataattcataaaaaacccctgcagatccaataagcatatgaaagacactcaacttcagtactaatcaaggaaatgtaaattaaaatcacaatgaaaagctatttcacccccaccaagtgagaaaaaatggaagactatgtaaattagtacaaccactatggagatcaatttagcctaatcttataagacccatttcttttccagaaataaactttagagatacttttgtactcatgcaaaacaaacctgaaaagaatattcattgcagcatagattgcaatagcactgaattggaaacaatttaaatttccaccaaattcccatcaatccctatacagttgtttttttgtttgttttgttttgtttttagatggagtcttgctctgtcacccaggctggagtgcagtagcacaatcttggctcgctgcaacctccgcctcccgggttcaagcaattctcctgcctcagcctccctagtacaggcgcccgccaccacgcccagctaatttttgtattttttagtagagacgggatttcaccatgttggtcaggctggtcttgagctcctgacctcaggtgatccgcctgccttggcctcccaaattgctgggattacaggtgtgagccaccgtgcccggcctaaatatagtttttatagattcatctaatggcatactatagagcagttaaaatgaattaactatagctagatagattcaaaggacaaatctcaaaaatactccttagagccaaaaaacaaaaaaagcatgttaccaaaaagatgatacagtgtaatactgtttaaagtttaagaacataaaatataattctacagataattcatagagccagatatatggaagaacactataaaaatcatgtctaggaatagtcaacttcaaattcagagtaataattctctctggggataaggaggggattggaattgaggtgtaacagaaggagagcttcaagtgtattcactatttttgatacttttgcataggcctggaatttttcatagtaataacaaagaggtgattgataacagaaaccaggttttaatctacttaaaaaaaatgttggtggaaaagaggagataggaggaatataactagtctttaggaagttcaggccaggagcagtggcttacgcctgtaatcccagcactttgggaagtcgaggtgggcagatcatcagaggtcaggagttcgagaccagcctgggcaacatggtgaaaccccgtctctactaaaaataaaaaaaaaaaattagccaggcatggtggtgaacacctgtaatcccagccactcgggaggctgaggcaggagaattgcttgaacccaggaggcggaactttcagtgagccgagatcgtgccactgcactccagcctgggtgacagagcaagactctgtctcaaaaaaaaaaaaaaaaaaaaaaaaaaaaagtgaagatggtattgatggtattcgtttcagaaggaaatggtgtttaaagaagttttttttttggccaggcctggtggctcacagctgtaatcccagcactttgggaggccaacgcaggcggatcacttgaggtcaggagttccagaccagcctggccaacatggtgaaaccctgtctctactaaaaatacaaaaattagctgggcgtggtggcacaacctgtaatcccagctacttggtaggctgagccaggaaaattgcttgaacctgagaggcggaggttgctgtgagccaagatcataccactgcactccagcctgggtgacagagtgagactccgtcacaataaaaaaattaaaaaaaataaaaatctgataaagcataggagacacatgagcatgtttatgtaaatagtgggaagaaaccagggggacgagttttaaaggagagaggtggtgattgagagcaaggtttcttatttccatccttgtcctggtgtcttgaattctacatttcaagggacttagtactgactggattagggagaacaagacataggcataacctagcggatgactttaaaggtccattcttctgaacattctgtatggatgcacaggccatataacctagatacaacctagatacactgataaaagtcatagattagaaattgtcttagctttcctcaaaatgtattatttaagcaaaatataatgttcacaagaagattaattttgggttaaaatcttgataagaaccagtattgttttctaccaggtttacctctgtcatttctgagtttgactctcacttccccttgctgaaagcatgtatttcctgagtgccagggtttcatatgacacacatatgcattttaagttgcttttgtgtaactattagaaatatggtcgattcctacacgcaacccttgggctatggtctatgaaagagcagtgtcatagcagaataaccttttcatagcccacaatatttctactgctgtctcttttgcatatattttagagacattttgataatcggtcaagttcaatatatcaactggaattaaatgctatattccctattaaaaatagctaatttttgtactgtgcagccagtggagccggaaatcattatcctcaataaactaatgcaggaacagaaaaccaaacactgcatgttctcacttataagtgggagctcaacaatgagaacacatggacacagggagagggacaatacacactggagcctgtagggagtggggcatggggagggagagcattaggaaaaagagttaatgcatgctgggcttcacacgtagttgatgggttgataggtgcagcaaaccaccatggcacacgtttacctacgtaacctgcacatcctgcacatttaccccagaacttaataaaaataaaatctttttttaaaatagccaatttttgtgtacatcctgcacatgtaccccagaacttagaaataatttttttttaaatagccaatttctgatatataatagacacaatttaatggaaaattcttaagaaattttgaagaatggatgattcgttgtagtttttgtctttcctcctgtgcctctttttctccttcctctcaaaacaaacaagcaaacagtgaagagcacaacacattatcatctattcttagtttcacgcatcttccctcatttattgcagctaaactcttgacacactgcatagtttgatgagcctagagttaaattattatagcaataaagaaatacgcaactgaaaaacagtccactcactccaagagcttgtggtcctcactatctcatatgcctaattgagtgtttgagattgttcgaaaagctgtagatttaaatgaaaataaaatcctgtctgaatattaatggcattcatttaaactttcatttagcacttatctattatgaaatcaacacaaaacacagtaactcaaaggctgcttgagtgtttaaaagcctattagggctgagcacggtggctcatgcctgtaatcccaacactttgggaggccgaggcggtcagatcacctgaggtcaggggttcgagaccagcctggccaacatggtgaaactctgtctctactaaaagtacaaaaattagccacgcatggtggcaggtgcctgtaatcccagctacttgggaggctgaggcgggagaatcacttgagcctgggaggcagaagttgcagtgagctgagatcgcatcattgtaatccagcctggacaacaaaagtgaaactccgtttcaaaatattaaaaaaaaaaaaaaaagcatactaggatcatctgagaggtttctaaaactactgctaggttttctgctcttcccaacacagccttagccctaatgctgtgaagctactacatgtgacaggaaacaaggtgatatctctgaggcatagtagggcagataaaaggctgagaatgatatggttgatgcatgtgtgtgygtatatatatatatatatatgtatgcacacacacacacacatttaaaatgactttctgaaatgaatgtattagatactgaatgtgtacccgtatgtatactgtttacatagacacaagcacatgtacaaaattcactttggtaaatatttacctcagtgaaaaatggtttagaaatacagttggatttttctgtaaagatgaggcactgtaattatgaagaaaagaaaaacccttagatactctttttgtgtgtagtgggtaaatttcacagaccagaaatttaaaaatgcaccaatgtgccgtgttcttcattttctctgattgggcttaatttaggatttaaatccaatgagccttgtagccagaatgcagcctgacagtgataaattaattctagtttgtttagggcactaattctagtttgcttagggcaaacataattatatcaatattttctgtgtctagtctcacctttargtcttgattccaatgtcatcttctcaagtggtctccctcaacgtctttaaaattgtgctctatttaaaaacgtgcttcctcctatccccctttcctactttatttttcttcatagcatttaaatcttctaacatactatcatattatactttatttggtttcgtacttgattcctcattggaacattttcatgcgcgtccgtgtgaagagaccaccaaacaggctttgtgtgagcattaaagcttttaatcacctgggtgcaggtgggctgagtccgaaaagagagtcagcgaagggagataagggtggtgccattttataggatttgggtagataaaggaaaattacagtcaaaggggatttgttctctggtgggcaggagtgggggtcacaaggtgttcagtgggggagctttttgagccaggatgagccaggaaaaggactttcacaagatartgtcatcacttaagacaaggaccggccattttcacttcttttgtggtggaatgtcatcagttaaggcggggcagggcattttcacttcttttgtgattcttcagttacttcaggccacctgggcatataggtgcaagtcacaggggatgcgatggcttggcttaggctcagaggcctgacaaacataatttctataaaggtatacatttttgtctatatttatttatttatttatttatttattttgagacagagtttcactcttgttgcccaggctggagtgcgatggcgccatctcggctcaccgcaagctccgcctcccgggttcaagcgattctcctgcctcagcctcccaagcagctgggattggaggcatgcaccaccacacccagctaattttgtatttttagtagagatggggtttctccatgttggtcaggctggtctcaaactcccgacctcaggtgatccgcccgcctcagcctcccatgtattattagttcctagaatagcacctgaaagcattctactgctgaatgaatatttgacggtgaaattgaatacaagatttatgcccctcttattaccagggctgcttatgttctgggtactcacctgatagggaggtcttgttcagtcgttggccattctcatctgactttgctgtcttcgactgaattgtcttcattcatctctgctggcattttacaggatgtttgtgttctgcactgatttgatattgggttcacattgggtgccctcctcccctstgtgagtcactgttccttctcgtgcctcatccgggcctctttaggagtgctggaaagctaagaatgctctctctggccgcttggagattgcagcctattggtggagggagaaggaagggttgccacagccccatcagcctggaattagtttgtcaccatatctgtactgttcatgggtttggatctgtgaaattatgagaccctgccatttggctgagtacaatataggaagcaagatagaagctcactttggctctgcgatctatctggtcctcacttgggcagaaggctggggagaacttgcctcctctgactctcccctcctgtaggctctggaattttcagcctatcttagactggaggccctgggttctttatctgttcttttctgtcctaaggcataagggctttgttcctttggtattcaaaagcagagattttaatatcacaaggccctgctataaagatctttgtctctgcattgaatattcaaagacattttaaaatccaaaagccaagtatagctttttttyccctctctctctcttgaaatgcctccttcttgagagcagtggatacttcatggtcttgtttcaaaggggctgaggggtgtaggaagcccttcaagtaaaaaggagtttggggtcaggggagtagggcacatcttcatattacatgtttttatttaaaaacaaacaaaagtaaaaaagtagaagaaatataacccttgttttctcccttctggaaattaatccttctgtatttgttttctggagaatgattctgaatattctctatatgttttctgtgaaaatgtcagcctagtattcgtttctagtagatgtgctttcagcaaaacttgctcttaatgtctctggtgtgcagtcatctgagatttctcatttgttccaaggtacttgaagggctgatttggctttgaaatttacagctaacactccctgaacttggctgtagcctttacatatttactgtacatctttcacaatataatgatttccaagcttcatttaacttgatccatattaaacaagtaagcttgggaggtgggggtggcttaaaaaaaacaaaaggttggtgcttactgtttttggtattctgccttgtttttgttaaatcactttaattggccctttaattacattacactgagcccttgtttcaaagactcatctggaatacctgcttaggaaaaatgtgggtcagatgggaatgaagcacaaaactgagctgcaacttaacatgaaaattccccagtggagccaaacactgtcaattttttgtttatatctttggtgacttgatgcaaatagaatcgacagttggccaggatctttgttgttttgttttgttttcagaggtatttaaaaaaaattttgctatcgggaaagcaaagcctaaactgttaggtatttgattactgtcaatgttgttgttttattcttttttattttattttattaaattatgtagttgccaaaataaaactaagagctaataactataaaagtattttgatactttgtaaagtgagcatattaaatcatttgtttaatttcatatatattcctcataagctaattttataggatgattgatggcacagagaatgtgcatgttaaagaaagggggtaaaagctacatatacctgttcagtaaataaattggaggagagaaaagtctgtcggctgattctggcagaagtttctcatgatgtttgagaaagtagaatgtaatacagagacatcttaatatgagctatatgttttttgtatgaatataataataataggagtttttcccattttggtggctataaaattttactttccaagagttattttagtattttttcttttatttactttaactctttggaaatcaatctgaaattttacttgaaagtgttcagtttctggttcatgtcaattacatttgattcaaaggctttgttcatttttaaccacaagaagataatcattcatattagcagttggttgtcctctgtgtacctaattaaattgtattaataaggtgaaatgaacattgtcaaactgtacttatttacttttaaatatatctcattttgatataacaatttgattcttagctcctttgtcagaatgtactacaaacagaaaaatcgtttcataaattattgctgttaccattaattcatactggtgaaacattcatgatgtcaatagtgttatccattataattggttaaagtccatgaatttcatagatgttcatgtttatttttactgtacaaatgatttgttgttcaaaataggtggaaataaaaaggttcaggtgaagtgagagtttgtaactataatttggatgggattattagccatttaaaaaaacaattctaagcttcaaatcctttctcgtacaaggttatagaggaaagaaggttaaaaaagtgtagtttacatctgaagatgaatgtgaacaaattattgggctacttaaacagatgcaaatgcatctccataagttttcattgagatcacagattaaagcaattctagaagaaatctgtatgggaagaaaacaatgtagaaaataaagaggaatgattttgtcaatattatccagcttcgcacattagcataacttgtctataagtttttattgggaaagacctccttcccaccttccacctttcaaaagtacttcctcattccatgagatattgctagaaagtctaccattaaaaattggtttccagaaagtatcactcctctttgggaatgcatgtatccctcattagggtagcaatggctccgatcagtgattcacaggtggatatcgaaacttcatcatctgtgtggcctctgtggctgctagatgggatcaaggctgctgaaaagtgaaagaagattgtgtgctggcttgtgctgggtgaccatgggccagttgtggggagtgagaagtagttgtgaggaagcaaggaagtacagaagactgggctcttcatcatgtaccctgaggctgcctccagcaaactgttaaacttggaagttagactatgctagcttgattacctgttggtgcatttgaaatgcagtgggagctttttcttgaaaaataaaaaaaaaaaaaaatactttccaggccaggagtggtggctcatgcctgtaatcccagcaatttgggaggctgaggcaggaggactgcttgaggccaggggttgaagagcggcctgggcaacaaagtgagaccttgcctcaaaaaagaacaaaaataaaacccaaaaccataaatatataatatgtaaaatatatatattaatgttttgggttttttttaatttaaatacataaatatatctatatctatatattctaaaataaaagaaaatacttttcaaataagaacttatatcttcagctgtgattacagtttatagatttgcctatttaaatgtcagaagtctgtcgaatacaatgatttatagaagttgttaaaaaaaattcccacatggcttctttattaaaaaacaaaagctacagttaattgcccatacaaacagagtttttatttaaaatggaacaaaatttaatgtccataaatttaacttatgaatgtaaattgaatgacatagatcagtaatttgtcctaattgttataatctactcaaaacaaaacattggtaaagcttttgtctacagaaaaattacttttttgtgtctatagataaattacttttttgttgttgttgttgttgttttgagacagagtctcgccgtgtcacccaggccagagtgcagtggcacaatctcggctcactgcaacctctgcctcccagattcaagcgattctcatgcctcagcctccgaagtagctgtgattacagttgggcgccaccatgcccagctaattgttttgtattttttagtagagatggggttttgccatatcagccaggcttgtcttgaactcctgacctcaagcgatccacctgcctcggcctcccaaagtgctgggattacagaagtgagctaccaagcccagcctatacataaattacttacaatatatgggatgtattatagtaaaatagaagtaactaagctaaagccatctgtattcaaccttaaaaaagttatttattgctgtaatatattgattcattcaacaaatttttactgaatgcctaccatgtattggtcactattctaggtgctggggggtcactgtgaataaaatggacaaactccctgctttcaaggagcttgccttgtaatgatgccagtcatagcccagattagtagtctatttttaagagaatttgtagtttattttcaaaagcatatatatatatatatatatatatatatatatatatatatttatttatttatttatttatttatttagagatggagtcttgctctgtcacccaggctggagagcagtggcgtgatctctcctcactgcaatctctgcctcttgggtttaagcgattctcctgcctcagtctctcgaatagctgggattacaggcacccgccaccacacctggctaatcattgtatttttaatagagactgggtttcaccgtgttggccaggctggtctcgaactcctggcctcatgtgatccacccacgttggcctcccaaagtgctgggattacaggtgtgagccactgtgcccggccttttctcacatttatttttaaaagcattttctcatgttttaataattaattttgtaacttagcataattacctagtgaacgttcttgagttgaagatgcatttatgtttatattaatttggtaaatgaaattaattatttcaacaactgtatatgaaaaggctgttatctgctgggaactgttttaaggataatggcagttagaaaaatgaatcagaaacagatcctgacctcaaggtatagtcaataatggagaatacaacagtgacagaagaatggaagaaaagcagttataaaataggctttgtgccaatctcagtagttaaatagaatgaagcgctgtgtgtctgtgtggagcagggcagtactattgcccttatatgtgtgcgttgaaaagttaatattttcaactttgtatttcttccaacgattacaacttatacctgttttattacgataataccttctctctccagcctagaatgtagaagcagtctctgctaagagatccttgaactctagggaaataaaatgcaatcagattttagatggttatatagctgtgattttctttactttctagtctctatcttatttagtcttcctaaataacgtaactaggaatgacagtaaggaaataagttacaaatgcatttaaatttccctgtggaataagaaataggtagtatctgaaggatacactgatttatgaaataaatattacattaatctaacatttaacaattgaagaaaaatgacttcacaggaagagaaatctctaaaatatttcaataaataaccaatattttgatttagactatacaaaagcctcagctattaggaacacaaacagtgacaggtccttttcatctctgagagacaggtaagttgtctcatttctgtcttattggtgtaaaaacaaaaacacaaagattatgtggcttttcattctgatcagttattagctaaagtgaaaggaacctaggcttgctgtctggtacttcaccactggttaccactgtggtttatggaagaacagcaatgaggtagggccagaaaatgatatttacagagatttttatgaaaaggccaattatacacaaatttctttgtctctgatttgtagttaccagctgacaagtggatacaagcctgcccctatggacctgagctttatcaaactcaccccatcgcaagaagcaatggtggacaagttggcagaaaatgcacataatgtgtgggcgcgggatcgaatccggcagggctggacttatggcatccaacaggtacatgggaattagcatttggtctgagacttacttaagtgggaattagcataatttgtaacaggaaggattacataatgactattttaaaacttgtatcatatagatcacatatagtgcacatttggactaaaacagctgtttaatgctagactcaagaatttacatgaccttagttctggctgtgatcgtgaacacatgtgaggcacacaatgaataatactacactggtgacttataatatggttttgtggtatttctctctctgagactgtattttaggagaaacttttgaaatgtaagaagactgggataaagtgataataaaacgggttcaccatcccttattcacaacccctggggccacataaatttcagaattcagtctttttatttggttttcagaatggtgatttgaggatatattacatgtgtatacataacaaccttggtagggcaagtgacttcaaattgcaattcattccgcacaagggaggcatggtcataccaaagaggggtaaaggccataaacagcctcgcatcagttcaggtttcaccactgagttactgttgcagatcattttgctctaggcatcagtagatattcaggtatttgggtattaaggtattcaggattaggtattcagtacaaatttgcctgaaagagggaaggaagaaaagacaagacaaaacagtatttctggctgggcggggtggctcacacttgtaatcccagcactttgggaggctaaggtgggaggactgcttgagcctgggagtttgagaccagcctgggcaacatagtgagagaccgtctctacaaaaaattaaaaaattagctgggcatggggcacatgcctgtagtcccagctactcagggggctgaggtgggaggatcacttgagcccaggaggttgaggctgcagtgagactctgtttcaaaacaacaacaaaaacaacaaaacaacaacaacacagtatttacagtatttattctctggtttaccagaacaacccctgtgtgattccatagctttcctttttttttttttttttttttttttttaactcttgggagatgtggtgggaacatccacagcctcccaattcctgcttatcttaaagtattgagaattgattatgcttcttgaaatgtggagacttgagcaaatactgcagcaggtctcagggagtgaatggaaagaagtaatttccaaagtggcattgccctacacacttgtaggagtagatgcatctccccgatcccatggaattcagttctgtactctaatattaagcatccttttgccaagatagtaagatagcctgttcactctctctgtgtcaacacattttaaccacagtttaacattggagcctctcgtacaatagacaagttatgggtttcatagtcattttagtgcccctggcattgccgggtttcactggttggtggattcaacccaatgcatatttttcagttagggacatagaagggtggtccataacacgctggaattttttgaagaagggaaagcagccttaagttcttcattgcctgaaaaccactgagggagaaccagcactaatttggctgttcttggaataaaaccctgtccatgaactgtactcagaagttatatgttctctaagtttgtcctttgccatgtgaacgtggcagatggaagtggttagagatcactgaagttgttttttgttattgttgyttttccttctcatggagagggtctgctttccatagatgcgcttattcatttgattgaatcctgtatattgatagtgttttggtaactttgcagcctgggaagacgcatggattgtggaagggtcacgtttttctcatggaatttaaagtttgatgtatttggtagctacttatttctaaaagcccttggtattgctttgacggctgcaccctgtgttttcctgcaggacgtaaagaacagaagaaatcctcgccttgttccctacactcttctggatgaccgaaccaagaaatccaacaaggacagcctccgcgaggctgtgcgcacgctgctggggtacggctacaacttggaagcaccagatcaagatcatggtattttggttttactttcctcttcttcggttgcaagatgatgtagtagttctttaaagccaaataaatgaataaaagggggagtactggatagagtcctctagtctaggtrtggaatttcagccaagtggattttcttccctgaaaaacacctgagggattagacccatctctcagtgggatggctcaggatgctgatgattctttgggcggagaaaatgggcctgtcttcctcaagcctctgagatcagtaggtacctccctgattatgatattgggctcctcccctagcccaccagccctcctccagaacagctgatttttgctgatttggggaataagcttgtagtggaggctagtgttttacaaaatcccaccttcatcatttacacacacgtacaggcaacattgaattaattaatgtgatattctgctttaagggaaacacattacaatagatactcaataactaactatgtgttgaacacaatggatttttaaaggttctgcaaagaatacattttccttaaataatacctttgaagaatgtagtttaggccgggcatggtggctcacgcctgtaatcccagcagtttgggaggctgaggcaggcggatcacaaggtcaggagatcgagaccatcctggctaacacagtgaaaccccatttctactaaaaaatacaaaaaaattagctgggcatggtggcggacacctgtagtcccagctactcgggaggctgaggcaggagaatggtgtgaacccgggaggcggagcttgcagtgagccgagatggcgccactgcactccagcctgggcgacagagcaagactccgtctcaaaaaaaaaaaaaaaaaaaaagaatgtagtttagaatgatccactctttaatcctttgctcctgcagtttgagttagtttaatacccattttcaaaaaattggcaaaaaacaaattacggttgtgtgcttcgtcacagggcctataatttttgatggaaagttttaaaaatgtattccaaatgtattctagtggctcatattttcagtgcattacctgtacataaaagtggatcttaaataataatgatagtttatatattcactgtgtaagtgtttctaagacttttacaattattatktaatcctcacagtaactcttatgaggatgatgcttgtattacgctcattttacagataaggaaactgagattcagggacttctgtgtcttcccatttaaagtggcaggtgtaggatcctaatcataggcatcctgacatattttagtcctttgaattgagtaaagacatacttggcatcttgacagatcttatcagttactggattcttatatttgctgcaaattaaatgacgtatctacttgttaacagtaatatccataatgctaacataatatctatcttgaggttagctttctaacaacagagatgtggtacacgcattatgaatcagttgctgttaggtgtgcagataccaagaagattcctgtctcaaagagtgtacagtccctgtaaccactgggaagaaagtaaacaataaaaggcttgtaagccaaaaaatggcaatcaaagagacttctgtaattctctgatatagaataaaccctcaaagctaattagttctatataattatgtttttaaattgaaatagaaattgttttaaaaacaatttaaaaaatagtttttaaattgaatagaaatttgtatacaataaaatgtacacatctgaagtgttcagtctggtaaattttgacagttgtagaaacaaaaggaaccactaccgaaaacacctccaatattttcttcattccagaaagtttgtgttcccaacaaagtaaccactttgtaagttctatcattacagattaatttatagcaaatagacatataaatgtaacctataaatgtagattttataatcattatcacgtgtattttttatatgtagtttcttttgttcatcatgatgcttttatgatcttgcatgttttatgtatatcacaaaatctattgctcagtggcattccttaaataataatagtaataatttactgtttgtttatccattctcctatagatggatgatgtgggttgtttccaattttaggtgattatggataaggctgctatgaatattcatatacaaatcttggtatataattaatataattaatctttcatttctcttagactaaatatttaggagtataattaccgaggcatattttctaatttttgttggcctttttactgaattgtgtttctaaaagtatattttggatagaagaaccatgtcaggtatggaaggattttcttctgtttgtaagttgctttttcattttcttaatgaggtctttcaaagagcagacattcttaatttgaagtccatttatgatttttttcctttatagttgtgggttcctaggacatctttgcctatgcaaaaacaaaaatattgtctcttatgtttccttccagagttttattattctagcttttacttgtaggtgtgtgatctaaagtgagttagcttttgtgtatgatgtaagcttaagatcaagkttcatttgttgcacagatgaatatccaactgtcccagcaccatttgttggaacaattatccttaccaaattaaattaccttggcgtcttagtcaaaacctattgaacacataagtcagtctatttctggactgtatattctgttccattgatctgtatgtctgtccttaagttaatattccattctcttcatttttatcacatagtaaatttaaaatcaggtagggcaagtcttccaacttctttcatattttataaaggttttttgttcttcttttgcatttccatatacatttagattcaacttgttaatttgatttggatgggattacagttgaattcgtaggtcagtttgggaagaattgatattttagccatatttagtcaaccaattcatgaacatggtacatttgtccatttattttcatcctctttagtttctcttagcattgctttgcagttttcagactagaggtcttatacattatttgtttgatttatctatatttttgatactattaaatgaaattagtttaaagttcatttcattttccaactgtacacgaatatgagatatataattgatatttacatattgatcttatatcctgtgatttggctaaatttatatgtcagttctatttttttgtaaattcagtgggattgtctatatacataatcatgaggtctgcaaaaactaaacctcactttttcttttacaattggtatagcttttttgcttcttgatttattgaactggtaaagaattcagaacactattgaatagaaatggtaagagagtttattctgccttatagggggaaagttgtgatgtttcaccattaagtatgatgttaagtatagctttttatagctgtcctttatcacattgaagagattcccttctgttcttagtttgtgggtgattttatcataaatagggtcttgaattttgtccagtgcttttttccccatttattgaacagattatgtatttttctcctgtattctgtggatatcacgactatcaagtgattttcaaatgttaaaccaactttctagttctaggataactctcttcagtcatgatgcattgtccttttttacacagagctgtattctatttgttaatattttgcttaggacttttgtagctaagtttatgggcaatacactggtatatatttttttcttataatgtctttgttagattttgrtatcaatgtaaatctagcttcctaagtaggaaattttctcttctgttttctgaaagaatttgtgttaattctacrttgtttctttttcaaatatttgatagaatttatcattgaaaccacgagcctagagttttatmctataggaaaggtattttgttatgaattcaatgtatttgatagcttgagagctatttagattttctatttatttgtgtgtcarctttgataaattatgtttttctgtaaattagttcatttaatttaggttgccatatataggcataaaattgcactaatgtgctcttattattcttttaatgtctgtaggatctttaatgatatctctcttttcattcctggtaatgatagttgmtgttttctctctttttatcttgatcacttctctaagggattaattgattttatraatcttttcaaaggttaattgaacttaaatgtacttttgttttggttaaactttcagacatttatttatttctccatatcaccaatcgtggattattatgagtgatmtgctgtggttatgtgtgactatgtcttacattaccttaggaaagcatggcattattgagtaggactatggcatcctatggagaacgttaatgttcaatcacagtatcaagagatmctggtttcacagctttgaaatgacctattaaatgtactttctaatcaacaaatgtatatatcaggcatacaaatattcactaacattgccttatgataatatagtatttccaatagtgtttttgcatattttcaaatatttgattcaactactctctttaggcaaaagaagggtgtaataatcaaagagttcttgagcttccctctaactttataattctttaacatttgtgcatccctagaggatgtaggtagcagtgatgacagtcaatatatttttaggttrgaaagatacttatataatgataaagataaaattttggggaaaaaactcacacctggttttatagtctgacacatcaaccatttgatttccccaggttttcattactttacacatgaatatttatattttggtatctatagtcttaatagagatataattacctgttttccttccgctcccccactctgcttaatatcaaacattttgaaagttacttactctacatttagaaggaactctgacaacattgctttcctgatactcactgaaaattgcaaagagagaatgcctaagtctggttgactcaattttaaacttatagataataacttaataataaatgtctaaagttatagataataactaaaaataagggaaaacactacagctcagagaatttataaccttgagtcttcaaggaaagagttaattatggtcagtatccaggaaaaggagtacattttcccctgcacatagaaatatgcattgcaatgccagacagaaaaaaatcaatgatggttatattttaaagatattgtcacttaagggcataaactatattcagtgacacatgatacatttgcttttagagataactttactccagaatggtgccagataagtaaaatgttaagaagttattctgatgacatacagtgttttatactatttgtagctaatacgtattaataatttcatcttcgtaacaccgttgtggacaacatattgctaccttatgggtacctactttcttctgaattatgtgaattttaagaagaaagaaaaggagcttatatttataaaacatatgctccacttcattttacttccatatttgcaattctcatttccattttttaaaatattattattattattattattattattagttgagatagaatctcgctctgtcccccaggctggagtgcagtggtgcaatctcagttcactgcaacctctgcctccctggttcaggtgattttccctgcctcagcctcccgagtagctgggactacatgcgcctgccacgaggcccggctaatttttttttttttttgtatttttagtagaggcggggtttcaccatattggccaggctggtcttgaactcctgatgttgtgatccacccaccttggcctcccaaagtgctgggattacaggcatgagccactgcacctggccactctattttattttaacacatagatatggaacacctactgtgcctagttctgggaattcaaagatgaataagagtttttgtcttatgtagctctcagtgtagacagggaaaatagactaaattgctaccactaccatacaatgaaagtgttaagctgaagagtcataacacagggggtttaaatcagcttggtgatatgagggaaatctttaaagaggaggtatattagttatctattcctgtacagcaaactacccctttccctcccaccaaaaaaaaaaaaaaaaaaaaaaaaaaaaaccctctcagtggctaaaaataacaaaatttgttatctcaaagtttctgtgggttatgaatgtgagtgataggtggttctggatcatagtctctctgagattgctattaagttggccagggcttaagtcatctgaagacttcactggagctggagcactggatactaagacagctcacttgcataactgttggctaaagaactcgcttcctctctggctgttggcagaagacacagccagatgggtacagccttgccacacagagctcttcatagagatgctcgagtgccttcacatggaagctgacttcccccagaatgaaaaatcgaagagtgagtacaaggatgctgtaatgcttgttacaattacttctattatattctgtttgttagaagtgaaccactaaatgaagcccacactttttgaatggaggtgtactcaagtatttgtggacatattttaaaaccaccaaagtaggtacagctaagtcaatcgggttcatgcatttcaggcagagagaatagtatatgtaaaggcttagagacacaaggaggattgcaaatgggaatttcagagagctttgtacgaccagatgtagagtggagtttgaaaagtggcagtagrtcaaatagaggaggcaggagttgaaacagttttttttttttttwaaattaaagaatgattctagtggctctttaggaaaaaggctgaatgtaaacaaaactggagatgaggacagcagtttggtgacaaaaaagaagtatagatgaggagtgttggagaccttgtctttggcaatactgtgaacagaaaaaattatttggcatttagaagtagaatcagcagaaggacaaaggaggcatctgagatagtttctggattgatagatgtcaagtacatacgcactggttgggaacacaggaattggagcagatggacatggggtagtgggaagattctgagttttattgtaaacatcttcagtttgaggtgcatgtgagacaactcaacacatataccaggattcaattacatatataagtacaaacgtgagactattgctagagagaaacagagggttaaaaatttaattttttaaatgaaagaaatgtggacatttttacactaagggagagagagaggttgaaagtacagtaagaggagcttgatgagctgtggtctctgagaaggttgaagggaatgaaattcagagcatgggtaaagggattggcctcctgtaaaaggaacaacaacacttattcccctaaggttagtaggaaagaagtaaagattgaagacgctgcaaaaacctgtgtacagggaaaatcaggaggaagctgagggcagtctactgtayaattattgtcttcaggttgaaatagaaaatgagtttattttcctaaggagtagaagttagggcaggctggactggattagaagccttgaagagagcagtaaagatgtgttgggtatagaattctcagctgacaattattttttcttttagtactcagatatatcatcccgctgccttctggcctttatgttttctgataaggcattgacattaatcttttggagggtcccttgtatgtgatgagttgcttctctcttgctgttttcaggattctctctctgtttttggatttgaacagtttgattatgatgtgtctagttttaatttctttgagtttatccccaaagtttactgtacttcttagatgtgtaaatgaatgtttttcatcaaatttgggaagcttctggccattatttattcatkctttcttctcttttctgtctctccttacagtctgtgatttccattatgtgtatgttggtatggttgagtgtatcccccaggcctctgaagctctgcttgtctttcttcatttcttcttcagtttttcatacttgactaacggacttatcttcaagttcattgattcttgtcagtgcaaatctgttgttgagccctctgatgtatgtttaatttcaggtactgtgcttatcaactccagaaatttttattcttttttataatttacctctttattgatattcactatttggtgaagcatcatttttgtacttttttttttttttgagatggagttttgctcttgttgcccaggctggagtgcaatggcgtgatctcggctcactgcaaccttcacctcccaggttcaagtgactgtcctgcctcagcctcccaagtagctgggataataagaatactggcaaaaaattatgcaaatcaaatttttcatagttctggaaattaactaaaggctggccaaaatccagggagtgtttatttgattaaaatgtccaaatgttgctaagaacagcaactagtgatgttttaacttgctcctgccccatcaccctctctctaattctatggcatattgaaaaccaacggcccctcaatcatagtgaaaatcagccacccacaagccgctggagtgggcagaacagagttggaccaccaccatgcccggctaattttgtatttttagtagatatggggtttcactgtgttgatcaggctggtctcgaactcctgacctcaggtgatccacctgcctcggcctcccaaagtgctaggattacaggcatgagacgctgtgcccagcctcatacttttatttagttmattacacatggttttatttagttctttgaacagatttaaaatacctaacttaaagtctttgtctaataagcccaacatctcggcctcctgaggaataatttctattgactgctttttacccctttatgtatgggacatactgtcttgtctttttgcatgtctcacaatttttgtgaaaaattgaacatttaaagtaatgtaatttggtaactctgtattcgcccctatttcagattttgttgttgtgcttattgtcattgttgtttgctttcttggtaatttttctaaactagtttagtagagactgtgttgcctgtcatgtgtggccactgaagtctcagtttcattagcttcatggtcagctgatggtaggacagagacttctttaaatgcctaggactgataagtctcccagtctttaccaaaggagaggcaatgtaatgtgagcatattggcacatgccttcaacactcaaccaggcaatttataatttcacattagccttctcttactgcatgtgcagagcctcaaggtctttcagaggtgtaagctttctcaggtttttcctgaatacatgcacagccctgggcatgagcatggccttctagagtcccaggaatatgttggagcttctcacatcccactatggatatttcactccccagcttttcctttcaaactttttggtcagttgctgtttgcctcagctgttatygctgcctcacaaagctgcaaggctaacaaattgcctcagatgattttcaacaaatgtccttggagaaacaactatttgcactgggcaagctctaagtcaagtggaataaagacaagtcttaccgatggaattttccagaaaagggaacataatgacagttatctgggaactgggctttggaggaactccagctctgttctgcccactacaagggcttatgggtggctgattttcactatgattgagggkcctttggttttcaatatgctgtggaattagagagagggtgatgcagcaggagcaaattaaaacatcactagtttgctgttcttaccaacatttggacatttttatcaaataaacactccctggcttttgccagcctttagttaatttccagagctatgaaaaatttcatttgcatagttttttgccagtgttctcattaattctgtggagaagaggatttttggagattctttctctaccatttctactgatgtcactcagcaataaagattaaaaattgctgttttgtgggatggaacagagagcagactgcaaacagataaaaacattgtggagaaacattgatggtcccgttgaggttagagactctgagttagtggtgccaatctgttcggtgcatgtgttttctggcgaactcagcagagcaggtatagatgttgagagtgaaggtagtgaaattggacagtaattggggttaagagagcaagtaggggaaaagctaataagggcaagaargtatggaaagttatatagggaagggaagaatgaaggaatctaatgagtttgaagagtgagtgtataagaaaatgagaaaacrgrgagaaaaaatggtgatcacacaatctctgtattttaagaatttagagatagagccactgacagttgtttgacaaggtttgattttaccgaagttatgtgaacagtgagcaatgagaatagagtggcatattctacagtagaagctgagattatgtttagtgtttactrygtgccaggatataacagcatgcttcatagtagggatgcaagtgatctgtatggaaaagacataagaagaaagattaattttccaatgggaggaatcagtaaagggagaaatatcttcagagttagatgttgaaaggatcaggaatcagtaaagggagaaaatgtcttcagaattagaygttgaaaggaycaaaatttcaacaagtagagattagtgtcagaaaggccatcgctactagaaagaaagtacatctgatgtgattaagtgtagaaagagttgaggaagggtagatggtccacttaggataaaatatagggtacagatgggsagagagaacagrcatagatgaaggtagaaagattaggrcaaaatatggaatatcttgcaaactcagctaagaaatgtggataaatttgtataaggagtaccagccccaggaagttttaaagcaagagcttgatgtgtgatcacagtttacaatagcaatataactacggcaacagtgggaagggacagattggagggggcagtgcttggaggtagaccagttgggaggctttagaaaaattgtttttttgaacaaggatggtgggaataaaaattaaaagatagatgttgagagattttatagcataaagcaaaatcagtctgattatcactaagaggagattcaaaacattcatttataatagtctatactgctgttgctgacatttaaaaaaaagtcaagggcataaaaagtttaataaaattgartcaagccttatgtaattaatcagaattataatttattttctcttaggagaatgcttacatattccagataaaacatgaactctgtatttgagttgtagtatctttggagtactgttgtcaataatattttaaagcatttgaaaatggaatttattcttatttactacaaggtttaatcaagatttgaattgytttatccaaaataataccagaaggttgaaaggatggctgattaataccaataattttaaaaagtattatcattagacctaaaagattctagatatgtataaaattttagcttttccttatagcttcttgtaacttaagattttaatgtatagttagatcttgactgccctctagtggcrtayattttcttagctatattgtttggagagcagagtgtatggttactttaggcctttytaggccctagttaggtgattggtggtgtgtcatgcctgggaggtacggggagcacagtctttgctcagtccttggccttaatcttgaggtagttcattaataatataattcctgaattgtttctgctttgaataccaacagacttgataatrtatgacaggaatatgtctcccaactattcatttttaaatgtccattattattatattcattataacagtataaaaatcacttatataacatacttacatgagttataattgcctatcaaacacataaatatatcntgtttaaaatcgagcaaagcataaggatgttcgggggagagttctgtgcctttgacaggatgctacccattagctatttgtctgggctgctatatccggagcccggaagagtcttcgtttctagatacagtttggcaggtatatatggagcacttactttgtggctcaggtgcttgatactacaaggtatgcaaaataagtttgttacggattgcttggatctttttaaaaaactcctacaaacccagatttyactttgtattagtattttagcaagaggtataatgttgaactgttgcttctttaaaacgtagttgcaaactaccctaaactaacttaataaatatatactatggggcagggcacagtggctcacacctgtaatcccagcactttgggaggctgaggctggtggatcacctgaggctcgragttcgagaccagcctgacaatggtgaaaccccgtctctactgaaaatacaaaaaaattagctgggcttggatggtggcacatgcctgtaaccccagctactcaggaagccgaggcaggggaattgcttgaacccaggaggcggaagttgcaatgagctgagatggtgccatcgcactccagcctgggcaacaagagcaaaactccatctcaaaaaaaaaaaaaacacaaacaaataggaaaatccacagagattaaaaaagaaaaagaagagtcctttttttttgtgaagtcccttgcatgatagtatctgtgaaccacatgtttgtttcaaattcaggttaagtatcatcaatgagcataagaatagcatagcattagggccaggaagaagaatattaggactcagcaactctgcattgtttctactgcaatatattctccatgtagtaccccctatttttattccctatagtaataaaggggattagtggtatgttttaattccaagagaattgtgtagggggcttttgggggaaattattacatttttataccaaatttgccttctaaaatatttgatttgcgctaatattaaaattagtttgcattatttgagtgcactatacatatttgtgaagtcttgatatattagaaaccaaacacagaaaagagaacctggtatttttcagtagtttagttttccaaaaaaactgtagtatagttttcatggtatataatgactatagtatatactaattctatatttagaaaattaggagttacatctattaatgcatactagaatgtaatgtaatattttatttgcaaatatcaacrtaattaaaaataaggataactacctgatcattytttcttccctgaaaataatctccaaatttttgtgtaatttatagctcatatttatctcttagattcatttagggaagattacaggcatgttttaaggaaacaatttatcggtaatctgttttttgaggaaatactaactctgagtaaaaatttgactttcctgtttgtttagtattgcagcactgagaackastttctttctttctttctttttttaaacacagagtcttgctctgttgcccaggctagartgtagtggcatggtatcggctcactgcatcctctgcttcccgggctcaagcagttctcctgctcagcctcccaagtagctgggattacaggcatatgccaccaggccctgatgatttttgtattttttgtagagatgggatttcaccatgttggccagactggtctcgaattcctgacctcaagtgatttgcctgcctcagcctcccacagtgttgggataacaggtgtgagccaccgcgacccgccaagaactagtttcttaatagcacaaactacctttaaatatcataaaatctgatagaatttttttctctcaaaacaacgtttacgatcctatttttcaaaayatatttacttaccaagtaataggcatgagaatttacccttaaccatagaaatgtttctctgattcagagacttaagctagtttctgaagggttagccagcagattcagttagttctacattcagtaagcactaccaccattatcaaaaaagcagttattgatcgtttcattaattaagcccatgtgatagggagccatctcatgctacagccatggtgtctccactgctttacttcatctcattttaaattgttacatatgacctagctgtatgtttattggcaacctttagtgcttatatagattatttttatagttctaatttgatcataccaagtcattgattgaactgttattaaatttttattatgcataaagtctttcccaaatcttaaggagaaacaaataggaacttccttcttctcttttcttttctttctttctttctttttctttctttctttcttyttctttctttctttctctttctttctttctttcttcctttctttctttctttctttctttctttcttttgtctttctttctttctctctctctctttctttctctttgtttgtttgttttgttttgagacaggatctcactctatcacccaggctggaatgcagtagaacgaccatagctcactgcaacctcgaccttctaggctcaagtgatccttctgtatcagcctcttgagaagcttggacttacaggcatgcactaccatgtctggctgaatttttaaactctttgtagagacagggtacyactatgttgccygggygcgatcctcccgccttggccttccaaagtgttgagactacagctgtgagccaccacacctggctgaaaactagcatttaaccagtawctagtaactctgtgcgagctattggaggcaaagtaggaagaagaggggctataacatgaagcagctcccaagttccaccatttttagttgtgcgatgttggtcaagtctgaaatttcctcctctgcatctaactcagatgttagctgggtgrccaccttctttgagatatcaattcaatgaacactcattcctctcctctgtggtttcagaaggacttaccttctcatcgtcgttctggctctgggttcctcattctgagacttccccctctcgtctctctcaatctcacctgcatctcatttcctagggatacttttccyccttttgcatcacactggtcctaatgttggatgctgacctttttatttttcccccagatcttttaaatacagcatttgtatgtatagcagatcacagtgaagatgtatgcgagaatggaaaaattttgcatcacatttgagttccttagccatcaccatcctgtagggaaatttttactattgatgctattgttacttttctccactgtttacaactttcccttatttctgtttctcttctcttccttgcttcgtcttccctcttctctctcacccgtacatgtctactcatttcttatgcagagcagttcggatcttttttcttattgtcttctttccatctcatcctccacaaccaaagcaccaaggcacttgggttttgttctacagaaaggtcgttccctcctgaaaatgaggctgacggagactcattccccagtctctccagcgcaagccctggtgctttccacttcacccagctggtctgacagtggctgatcctagatcagaaagcacttggtaaaatgggaaagaagataagaaggtatcattatcatcatcgctctaggttgaattactaaagtcrtgatttatctttccttcttttatttatgatatctttccttctctttcacctccccatccaatgaccaccagaaatctctgtccatttcccagcagccagagccgaagtgtgcagcggcaccggggaaaggttccgaatcttccgtgccgagaagacctatgcagtgaaggccggacggtggtattttgaatttgagacggtcactgctggagacatgagggttggttggagtcgtcctggttgtcaaccggatcaggagcttggctcagatgaacgtgcctttgcctttgatggcttcaaggtgagtggactttgtcctgtgccagtcatctgtacgtgctggaggctcgtctcctctgctgttcctcttggtagcttcacagtaccagtgttttccacagcacaaacgtggaaaaatatttcacaggaaagcttttgtcctygtagtctcaaaacccttccctacaacccatgaatgcagtgaaattcaccaagtaagacattgcttttccatggttatcaaaaagataaatcatctttgtctatcaaaatgttaaagatacatatgtagaggaaaaatgcatatacattgacgcagcgattccgtatcaggagtttatctttaagctataattagtggtatgtttgtatraacatttaatagctacaatgcttaatgtagtgttgtttataatcacaaacggttttcattttcaacattattggtaatttctattaagttggatggaagctggtcaggtgtttattttgttatttatatactaataaatgtttaaagattcttttacatgtgtaaaatattttgatcagtaatatgggcgaggtgcctgtaatcccagcactttgagaggctgagatggagggatcacttggggctaggagtgcaagaccagcctgggcaacaaagtaagatcctgtctctacaaaaaaaaaaaaaaaaaaaaattaaaattagccaagcatggtggtgtgcacttgtggtcccagctacatacgaggctgaggtgagaggattgcttgagctcgggaggtcgaggctgcaatgagccatgatcacaccactgcactccagcctgggcaacagagtgagaccttgtctcaaaacaaacaaaaaaataataataacaacaaggtatatatgcttatagccacaataggataataatagtcacttttgattggtaaaatcatagatttttttaaagtcttcttttttttttattttttaagtgaatttattttccttttcacatgagggggaaaaagctactttttaaccaagaaaaataaaattagaataaataagcaatcatgaagagatttgacgtttggatatttcttggagtgaaatgtcctgtgtaggaaagcatttctaggcttgaaattagggcagttgacccacttagttttgaaacatcacatttcctgaatccagttttttaaaaatttcaaatagaaaaatttaacacttttttgggggggtggggggcggtcaaaattagcaaactttaaacttcaaaaaataaaataacagataaaaggcagctttaggtttatacctcctgaagatcagatgtaatgaaccagagtgggaagtaacctgaggaagttaaaataacctttactcccagtcaaatgataggcaagaaaggatactcccgatttgggaacaggcatggggtgggtggggtaggaaggagaacaccacagccaggtaagtcggttgggcattttatgccttttgatacctgatgtaaacttttttaaaaagacagtgtgttatattaagaagaattatgtcattgctttgcattggcgactctgtctggtaacgtaccgattcacaatgaaggtgaggyttaagaaaaagtcaaaagatttatctgacaaaaaaattcacataactcaggtgtgcctatgaatcaacggaatatacttgtagatgcaaaagtcacrtttatcaaaactatgtttcaaatgtacttacaatatgagayttcactttaygtatatatataaaaaggttggcatctatattcaatttttggcttgttacttcagcagatatcctaaggatatttttaggtttgatttgaagcttttttacttttagtatgtaactgaaatgcttctagatttccattttgttaaagtatctgtgccatcggttctaaggaatgaaatttcattttgaaatagatgaaaattacactatcattttcaatgacagatgcccagcttgattccctagctcataattatttgtatttgtgggagtagagaaaaacaaacygtattctgggaaacattcattgtcgcagaaaaatratatattctaaaggcatataagttttctttcagtagaaagtatgtgaggttcgatttttaaaataataagctctcaaaatcatgacatagattttggatttttttcccaagattcgataatataccatgttaatattaggtagggatttagaattcccagacagctccattttgcttaggacattgcagtagaccgatatgccagctggagtttttcctactgttgtgttgatagaagggactgctgttaggtcgtgacagagtggtgggtgggtgcaattttcctggcttagtctgtgacaagggacttttctgtcctctgtataggcccagcggtggcatcagggcaatgaacactatgggcgctcttggcaagcaggcgatgtcgtggggtgtatggttgacatgaacgaacacaccatgatgttcacactgaatggtgaaatccttcttgatgattcaggctcagaactggctttcaaggactttgatgttggcgatggtaagtctactatgttttgtgttttttttaagtttgcagcacaaggaagctttcatcctgaggcttcctaaccgggcgtttctgtttcagggtgagtgagcagatgagttgcagctgtaaatcgtgagggtgccttgtgactgacttgatcagatgcccttgaaataacattattagaaatgctatctatacgacttagctaggatttctagaaggctgaaatggcttttatgagtatgaataagaaaataaatagcagataaaagaataggtttccatcattgttaaattttcatttagaacttccctgcttcatcagctgcctagagcctctttctgtttattcatctcataaaagtgaaatgaggacccacaatggatcaggtactttgctggatgctgaggtgacaaagatgaatgaaacactgtcctatctttgtatagattacagattacctgccaggggaggttgacacttgtacagtttctgtttagtggctaagttctaagacagaaaaatgcagaaagctctgtggaagcaccatgcagggagcacgtgctgctgcctgtggggccccgagatggcctttgagcagagttgtaaagatggagggtgggccgggtkcagtggctcaagcctgtaatcccagcactttgggaggccgaggtggatggatcacaaggtcaggagttcgagaccagcctgaccaacatagtgaaaccccatgtctactraaaaatacaaaaaattagctgggcatggtggcatgcacctgtaatcccagctatttgagaggctgaggcaggagaattgctcgaacccaggaggcagaggttgcagtgagcagagatcacgccatggcactccagcctgggcaacagtgcaagactgcatctcaaaaaaaaaaaaaaaagatggaaggtgttggtgaagcaaggaagacatttactcttcagacatgcactcccaatttggtggccttggccacacagggctgtttatatttaagttagtttgaattttttttttttttttgagtcagagttttgctcttgtcgcccgggctggagttcagtggcgcaatctcagctcactacaacctctgcctcctggattcaagtgattctcctgcctcagcttcccaagtagctgggattacaggtgcttaccaccatgcccagctaatttttgtatttttagtagagacggggtttcaccttgttggccaggctggtctctaattgctgacctcaggtgatccacccacctcagtcctccaaagtgctgagattacaggcctgagccaccatgcccggcctaaattttaaaaagttaagaattgagtttcttagtcacattggccaccatttaaagggctcaattcccacaggtggttagggatgcccctgctggacagtgcaggtagcgaatatttctctcatcacagaaagttctattggatagtgttactctagagcatataaacaagacagtatctgataaaaattatataattatcttatttcagccaggcatggtgattcatgcctgtaatcccagcactttgggaagctaaggcggaggatagctgagcccaggagtttgcgaccagcctgggcaacatagcaagactctgtttctacaaaaattaaaaaaattagccagttgtggtggcatgttcctgtagctccagctgctcaggtggctgaggtgggaggatcactcgagtccagggaggtcgagactgcagtgagctgtgattgtgccactgtactccagcctgggtgacagagtgagaccttgtctcaaaataataataataaccttatttcaaagataagccaacacttcttttcaaaatggcttttgaatatatcctgttatatgtttgcatatggatttgcatataaaaatgtatatatatttgcatatatatagtcttggattttaagatacatacctacctcaaccagtatttctttttcttttcttttctttttttttttttttaagacagagtttcactcttgttgcccaggctggagtgcaatggcgcgatcttgactcactgcaacytccgcctcccaggttcaagcaattctcctgcctcagcctcccaagtagctgggattacaggggtgtgccaccacgcctcgctaatttttgtatttttagtagagacggggttttatcatgttggtgaggctggtctcgaactcctgacctcaggtgatccacccgcctcggcctcccaaagtgctgggaatataggcgtgagccactgcaccaggcctatttctaatagtctatataaatttgtcactgatcttcaaaatgttagccagttcrttgcttgtatgaagttttatattcattcatttagctagcttttgagcaggtatgaacatcatttccctaacacagatttgcaaagataataggaattttacatttgtgtaactcaatatctatgtttaaaatttttaatttttactttttggagatacatggtaagtctaatatgtatgaggtacatgagaagttttgatacaggcatgcaatgggtagtaattgcatcatggaaaatggggtatccatcccctcaagcattaatcctttgtgttacaaacaatccaattatacttctagttattttaaaatgtatgattgaattaytactgaccatagtcaccctgttgtgctatcaaatattaggtcttattcattttttctaactatttttatacccttaatatctattttgaacacttatctccgggtggtgaaattagtgctctaaccctcccctacctgtctccctttctctgatattggttttagggatgtcaaagtattagtgggaaggtaggaggaaggctttttattggtgttatctatctgtctacactggctgctactatggatgtgacttaggtttcatttttttaattggctttttaaaaaatacttgactgctgtgcttcctttctttggatgttaaaaaaaatttaaatgcatgtgtgagttctgtttgtatggtacgtggttcacatgatacacatagatttgcagaatgctcatccgtactatttaagcacgtaacaaatgttcatggtaccacacagtcacatagaccaatcaccattgcaawaatgagatagactctgaagtgtgtcaccgtggcacatggttttgaacaattttggcttttgactttgtatttcataggatttttaaaatttaaaaactgacttgaactttgtattggtatctctatcatagagttaacacaggattttgatgaattgtctgaaattttgtggttgaggttgctgggcttttattagaggttttgggaggacctgcgttttggtcttcaaggcagrttataagctttatgtagcaataatcattaagtagtaactttgtaggggtcagtcatgaatctaaattttctactatagaaaggctttcagagtttatccatgcctatgatttttgaatgctttttggtactggaatatctcttccccatccctcctctcccaaattgactttatatagcttcccaaaaaagctccttaatttacctgtcactactgggagctagcattgaggtagctagagctcaaaggatccagtttgaaaaactatttatttagggttttctagcacagaaacatactatggttgctaaagtactaaaatggatttataagtggtctattttaaatttttcttacacctagcctgtctttatgtctgtatcatgttcgatttgccatttttaactatcttcataatctcttcttattgctacagagaaagctcagtcatttatacactgactattaaagtatgtggtaagatggataaatgtagaaattattatctatggagatatacacatacacacacacacacacacacgcatacatatgtatatgtgtgtatgcgcacacatacacacagacacatgctgtagatccctgtctggtcagcttagtagacaacatggccaagtatattttgacctttctatctattgcatagtttatacaactgaaatgatttgctgaccagtataagttgtttctatataccgtcaaaaagaaaatcacaaacatctttgaaagactgatatggccatccagttaaatccaggggggagctatggctatcccagttctggaagaggatagggttgttctataaaggtactgctaggaacaaccctatcctcttccagaactagatggcggatcacaagatcaggagatcaagaccatcctggctaacacggtgaaaccctgtctctactaaaaatacaaaaaattagcccagcatggtggcgggcacttgtagttccagctactcgggaggctgaggcaggagaattgcttgaacctgggaggtggaggttgcagtgagctgagatcacgccacctcactccagcctggtgacagaggagtgagactccgtctgaaaaaaaatraaaataaaaagatkctgttaggtctcttctaaggggctgcagacctcttcctcaaatagggactgcagcagccctcaggaaactcatctgttaactggataaaaaccaaatgacagaaacactggtctctggtagaaggagcaagrctctcattccctcaactcctcctcaaaaccayrcttacatggtcaagatcaagagcattgttgaactagagtgaaattccactagaatttcagggtttaaaggccgcattgtctatgtggcagatcctctgttaggattctcccttctctttggctttttaaaaatctcttcagagtatctttggggaaggcaaaaggattccttcaatcatcacttttaaaagaccccttggactgtaatgtcacaaaggaatagtgaggggcatgtgtggaagcagtttttagatgagcttaagtttttccatgaattcttgtctcttctcaccattggactgataaccattcaaaatcaggattggggaagcccagggaaagaggttgcagtgttcactcttatggacagaatcctaagattgcttctaggaatctttctgtgtggtgttcacaccattttatataaccctctcctcttgagtgtcagcagaacttgtgaatatgatgggatatcactcatgattaggtcactaaatcagtttactttgagttagtcaaatagagattatacaggtgggcctgacccaaccagatgagcccttagggattgggtccttcctgaagtcagagagatacaaaatatgagataaattttcctgctggacttgaagaagcagactgctgtggtatggagagagcaacatggtggtaacctgcaggctgcttctgagaactgagaacagccccaagttcatagctggcaaaaaaacaaacaaaaactgagaaatctcagttctacagcccaaggaaccaaattccatcaataaccagggagcttggaagatgactccaaccctcagatgagaatgtagcccacgttaccatcttgattatatccttgtgaaaccctgagcagagaacccagccctaccatgctggacctctgacctacagaactatgagataagaaatgagtattgctttaaatggctaagtttgtggtagtgtgttccatagcaatagaaaaccggtatgttgatcaaggggctttcttaggttcaaccgaaccttcagactcacaagactatcaaagaccacccatgacaccagtctgtttagagagagaacaggaatcatggcttgccagcagggcagtcccaaggattcctcttccaacaggagtgtttttagatgtacgtataattctctgagttcatacgcggttacctcatcagaagccatttttattataagccatgctgcctaataacttagttgacacttcagcttttacccacagaggtatagtagctaatcaagctgtgatactcctccataccaagaacctaggaggagctctcctgacacatctatggtctactgcattttaccaaaaccagagattattccacatcatgttttgggaccaaggctttttatattaaagccatgatttttatatggagcatccctttatgtacacattcctcaagagcctagtggaggtgatcctcatcacattagttgggggacaagaacaagggtaatagaggcctgagatctctcttctttccccccacccccrgcgtacctatataaatttccatccatcttaccacataattattttcattactagccaatgtaacaataagaaggaattatgaagatggcaaaacatgccatatcaagcatgacacagacacagagacagggtagttatatgagaaatgtaattacagagcacttataaaacctttcagtactttagcaaccacaacttattgctgtgctaaaagattttttctaaattgtttttcaaacttgtaatatgacaagaaaaagaaattggagatgataagaattggagtaaaagggacgaatttatcatcattcgaagacaatataagtatttacagagaaaaccctaaagaatctatacacattactaggaacaattggagtgtttcacaaggtagaatttctattctagcagcagttaagaaaagtaaattaaagataccatttacagtagcatcagagactagcagtagctaggtatctctctaacagaaggtatataatacctttactgagaaaattattaaaacttattgagagatggttgactttattaaaagacttattaccaaataaatgagaggtgtgttatgttcatggagaagacaaaagcctgaagatattaattcttccaaaagtgatctatagcttcaatccgtcgatcagacttttcaaataaaaatcccaacaagtgtttttatggaagtcgatgtgatgactctaaaatgtatatggaattgtaaagggctaaaatatcttctgtctaaaagcagtgaggggatgcatgtcctaccagatagcaggatttattgtgaagctatagtcattaaaatagagtggtattgttgtagggatagacaaattgacaaatggcataaagtagagatgccagaaacatagaactgatatagaaacagatgccatagaacatgatgaggtagtgtgtcagtatgttggagaaaagaggcctgtgacaaatggggatctgtagtgaaaatatgagatggtcacttcttcacaccctatatgataacgaactccaaatggtcttaaatgtcaacagcaaaactttgaaaccactggtggagtatatagacaaatttaagaacattcatttaaaaaaatgaatgttctgcttccttaaaggaagcagaaaaacagtcaggtattaatggggagaagctattcacaatgtgtacaactgaaaaaaatgttagtgctaagaaaatataatttctgaaatcaagcaaaatgatgaaaaggtatgaacaggtatttcatagaagcagcaactcagagggacaataaacgtgtgaagagatgttcattattattgatcagggaaatgcaaattcataattaaatgctattttacatccattctgttggcaaacatttgtaaagacctgacaatactcagtattggagagcagtacacccataggacctcttttacgttgctcttaggagcgcaaattggtctctccactttggaaaactgtgtgacaggatctctgaaaatggaatattcacatacccatgacccagaaattctactccagttttttagctacactaatgtgtctcaacagcaggagatatgtacaagaatggttgtaggagcactattcacaattgccaaagccaggatacaaccgaaagcacacaggatggatgaattaactggaaactacggtaataaatgacaacatggatatttaagggaaagaagtcccaaaagataactatggtaggccgaataatgtcctccaaagatgttgattgatggcctactcttggaaatctgtgaatatgttactttacatagcaaaagagattttgttgatgtgattaagatagtgatcttgaaatgaggagattaattaacctggattatctgggaagccaatgtcatcacaaggatccttataagaaggaagtaggagtgtgtgtttctgtgtgtgtgtgtgtgtgtgtgtgtgtgtgtgtgtgtgtgtgtgtgtgtttgagagagagagagaaagagagagatcgatctgggagtcagggaaagccagagacctctagaaatgacaggaaagtcaggaagtgggttcactgcagrgcctccagaaggaactcagccctgttgagcaataggttggtagatacttaagagtatttttaaaagaaccaactaaataaataaaaacaggtgatgatgagagtgtgtcacaaacaaaagkttatcagtaatccacggtccacttctgtgtattttgaaattcttcttttgagacagagtcttactctgtcacccaggctggagtgcagtggcacgatctcagctcactgcaacctctacctcccgggttcaagcarttctcctccctcaacctcccaagtaacttggattccaggcacatgccaccatgcctggctaatttttgtatttttaatagagatggggtttcaccatgttagccaggctggtggctggtcttgagctcctgacctaaggtgatctgcctgctgtggcctcccaaagtgctgggattacaggcgtgagccaccacacctgttctgaaattcctmaagaagaaacaggattgtgtctgtagagcttttgggactgatctagtaagaagaggagaaattratgataaaggtatragtatgagaggagataattactcatgttcctgataaggtgaaggggggtgtgatctcaagcacaagtggatgaaatgagacaattttttcattttagcacagaaaaaaaaatggctcaggtacaggtcatagtagtatcctctcttttatgagcagggtgcctyrtatgtgtaggggaactccccaagcaaaatgaacggctttgaatgaatggcttctctgtatttctttatcttctccaactccctagtgtttgattgcctcatatcctacatagtcctttggtgcttcccattgccgccttctctggaagcctatttccaaagggaagtctcccttccatcttctaacataagcctacacaagagaatttctttcaaaagatttctgaactagagttgatgcaatgccccttttggaggtattatttttttggagacttattttgcaatgcctcttttgggggtaattttggagatttgttaaggtctctcacccattctgcagttttgataaggtggtgggagtgggggcatgtacgctccctcagtgtctctcgcccattctgcagttttgataaggtggtgggagtgggggcatgtacgctccctcagtgtctcttcctgcctgcatctttgggataagtctgtgacctctgggaacagaagagtcctgcagtgaatggcttaagatgctcctggccacatggagaaatggtctcttccttgatgacctcttgggttgggtttatctctccctgttcttttgtaccattagaatagtaacatcttaaggactgagaatcagatatcagcttagaggggaaaaaaaagaaacaaaacacaactaagaaggccaaccagtgcctttyattctaagtctctggagaaacagaagcaaatcttctagttcatttatgatctaagcccagctcaccaatttaaaaaatcagaacttgagtcccaaataccagctaataataaattgtactttttctttgccttgtgctctcttccttgccacgtgaggataatttacttcttcttcttcttyttytttttttttttttttttgagacagagtttcactcttgttgcccaggctggactgcagtggcgtgatcttggctcactgcaacccccgcctcctgagttcaagcgattctcctgtctcagcctccagagtagctgggattacaggcatgcgccaccatgccyggctaattttgtatttttagtacagacagggtttcaccatttggtgaggctggtctcgaactcctgacctcaggtgatccacctgcctcggcctcccaaagtgctgggattacaggcgtgagctgctgcactgggggaaaatttacttcttaaagcacactcatagggcaaatttccatgggtcaaaaaactattattaatttaataggaaaaaagtgcattcttgagctcctatattaaacctaatttgtattaaaattatactaaatctccctaaaatgaagtcagtaattaattaacatgtcatatgctcacctaaatgtattcccttcttcacttgttcttcagtttggttgttaacctgttctaccaaagcttgttcttaactatcacatagtataaactccagattcccttacrgaatatatcataccgaatatgtacataattcaaacttcagtgtaagraaagcaaaacaaaaccagcaacaataaagttggaaaaaaacaataaagacaaaggaatgtcagtgaagaaacgcagatgatatctgatttacccagcatattgacggcatagggaaaaccatgcacagagtcttctctgatgtgaagcgtgtgcttgtctgctgaaagaacttaggcgctatgggctaattcttacgactgtgaggaagactgcacgtctcactctgcttctgcttggctcctccagagccacgtgaaatcacaacaattctttttttttttttttttgagayggagttttgctctcgttgcccaggcttgagtgcaatggtgtgatcgcagctcactggaacctccacctcccaggttcaagggattctcctgcttcaacctcctgagtagctgggattacaggcacacaccacgacgcctggctaattttttgtattttttgtagagayggggttttaccatgttggccaggctggtctcraactcctgacctcagatgatccgcctgcctcagcctccaaaggtgttgggattacaggcgtgagccactgcgccaggccccaacaatgctttaaaaaaaaaaaaatgaagaaatgccttaaggggtaatgaaatgaatttcccataaagtagaattcaaattcttctaatgagggatgatttccgggttccttggggctccacacacatggctttggwggacatgtgtctgcyggcagatacagcrttctgaatacaaaccgtgtctccattctacctgttatggactgagttgcatagctctaaccctcaatgtggctgtatttagagatggggcctttaaaggggtaattcaggttaaatgaggtaatagtgtggggccttaatccagtatggctggtgtcctcataagaagaggaraagacaccagggttgactgtgctcagagaaaagrccatgtgaggatacagccagaaggctgcyrtctacacaccatggagagagacctcaggagaaacgaagcctgctgacaccttaatcttggccttccagcctccagactgtgagatcacacatttctgtggtttaagtcactcagtctgtgatcatttcttatggcagtctgagctgaccaatacaccaccccttctactcttgcatcccctactaagctagtactattctcaatttattcttacgggaacagccttatattatcagtagtttgaagagctaaccatatccttaattaaaaataagtgrgagagtcacttaaaatcttgatgtatagtttatggtaaaagaacrgttatttatgtttggrgattaccacattctacagtgtctgctgtggatacgtatcttgtgttgtccatttcaagcttctcagctattctgcaagtaaagatcatctcagaggcccatgatggttataatcaaatccagaaacaatacttttgagtctgtatttgccacctgaaaggagtgtgagtaaaattgaattcctggtcctctcagaactcatggaattcctttcctcgggagaaaaccagattatttttgtaattaaaatagctgtatagctgtagacagaaaagaaaatraaaaagagaggcagggaaaactttccattattgattttatcatgctgctgttttagaaaaaaaaaagaagccaggatatagaactrctagtttgttcctacagtatgctttgtaccctcagttgaaatattgcagcagttagattatttgatggaaatgggtggcttattcagaagtctggttttcaacatrgtgtgaattaaggttagtaggtctgtaccatccccaaacccacctgcctggctttaccataacagctgaagttcctgtcaccagcatcctctgtgcaacctgctatcatgatacagacctgggagagtaacttattattgggaatctccttaattaaaaatcaacacttgtcagaggaaggaagaaatcaggactgtgaggccaacttctatagcagaggaatccaagtacaacccaattctgaaatgattcttgtgtggccttgggcaaatagcctgttttcatttccttaaaataaaaacacaaattagagatgatctcttcttgtctagttcagttctaagattccagaaatcaaaggcaagtgtttttctgtttgtttgtgttttaccttccctctcagagttctttattttttatttttattttattttwattttattttttgagacagagtgttgctcttgttgcccaggctggagtgcagtggcatgagctcagctcactgcaaccttcacctcctgggttcaagcgattctcctgcttcagcttcctgagtagctgggattacaggcactggccaccacacccagataattttttttttttgtatttttagtagagacggagtttcaccacaatggccaggctggtctcaaactcctaacctcagatgatctgcccaccttggcctcccaaaatgttgggattgcaggagtgagccattgtgcctggctagcattctttaaaaaaaaaaaaaaaaatcaactttgattttagattcagaagctatatgttcaggtttgttgyctgggtatatagygttatgctgaggtttgtagtacaattgatactttcacccaaatactgaatatggcacccaataattktgcaacccttgtccccccaccacagttgtccccagtttctgtttttgccatccatctttatgtccatgagtacccagtgttcagctctcacttgtaagtgagaatacacagtgtttggctttctgttcctgggtgctaagatatggcctctggctgcatctatgtagctgcagaggacatgatttcatttttttatagctgcatagtatttcatgatgtatgtgtaccacattttctttatccagttcactgttgatgggcactgaggttgattccatgtttttactattctgaatcgtgctgggatgaaacctatgagtgcgtgtttctgtttttggtaggatgatctattttcttttggatatatatatatatatatatatatatacccagtaatgggattgctaggttgaatggtagttctgttttaagttctttgagaaatctccaaactgctttccacagtggctcaacttatttacattcccaccaacagcgtataagcattctcttttctccacagcctcgtcagcatctgttcttttttgactttttaataatagccattctgactgtgtgagatggtagctctttgtggttttgatttgcatttctctgatgattagcaatgggaacattttttcatgtttgttggctgcttgtatgtcttcttttgaaaagtatctgttcatgtttttttgcccattttttaaatgggggtgatttgttttttacttgttgggttatttaagtcccttatagattctggatattaggacytttgtcagaaacatagtttgcaaatactttctcccattttgtagattgtccttctcagcattcttgattcaaattctagcatccatttaactacctatagaaacttagacaaatgayttaacatcttagttgtttcctcatctgaaaaaatgggattaatattaaataatataggcaaaagtrcttatgtattatatggcacatagtaggccacaagcagctagctgttaccttttcttctgatcaaaaaatgtgaatttacatcttcatataatattggtcatttttatctgctttttggccatttggtttgggttatatatttaatacatggattcttaactgtatttcagaaatgttaaaatttgaaataatttattcttaggaaaagctggtacgcttgtgatctgctttatcttccttttattgtagccccaaacagagatttcaagcctgtattttgcccctacatctttgggactgctagctccttggctggatttgcatgctcatcaccctcccctctgctctggagcagggaggctcatcagcacagaaagttaaaatttgctgaagccatctgtcttttgttggaggaagcagcttagccataagttgtagctactgttttaacagatttgcaaatagttagggtgggtctggctcaggcccaagtaactgattgggctcatatgcactaatttaagatccactgccagaatgaaaacttcccttatatatcatcaggctctgttatttgcagggtgtcaattaaggtaactggatagaagatcaagaacacaaaggacaggaaggtgggacccatattttacatgtgctgggggagaggcatgattttgtggaaatctgttttattgtgttgaaatacttgtgtgtgttctgcctacttcatgctaataaagaattgaaccccagttatgtttagctatggagtgatgattaagagtgatgtcatttaccaacctgttttgttcaatttatgccaaacattccatcttaatatcatttatcattttctgacactrtatgatgtagacagtggtatacaatggtaactagttttttatttacctgttacctgtcttttgtattcaaagttgtgctccagaaagtcaggggttatttttgattttgttcacagctatattcccagtgtgtagaacagttsctggcacatggtaggtgttcattaaatatttgctgaatggagacacctgatactctatgaagacaatgtagaacagtaacttagaaaagggattgccaaactaaggcccaaatccagctcaccacctgtttttttttttttttttttttttttttgagacagggtctygccttgctctgtcacctagtctagagtagtgtggagtgatcatagttcaytgcagtcttcaactcctgggctcaggtgatcctcccatctcggcttcccaagtagttgggaccacaggcacatgccaccatgcccagctaatttttaattttttaaaatagctctttgaaaaacaaagctaactcctaagcagtgtgcccagagtcaacctaatttgttaatttttttttttcttgtagaatcagggtctcgccatgttgcccaggctggtctcaaattcctgggctcaagcsagcctcctgcctcagcctctsagatacagatacaggcatgaaccactgccttggccctgctgttttaagtaaacttttattggaacaccaccacgcttgtttgtttacmtactgtctatggctgcttttgcactatagctcagagttgagtcgttgcaacagaggccatatgatccatgaaacctaaaatgtcttctctgtagtcatttatagagtttgctgagccccaggataaagcatgggcattgggatccaccagacttggatttattttctggtcacttagtarctgtgagggcaagtgatttaaactaagattttggtttcctcatgtggaaaatggtaataacgattcctatctcattggatggttgtaagggttcaccaagatgaaacatcaggaaacattaactactaatatggagccatgtgtgctgggaatttcatttattggcgacctcttcattacgcaggatactttgtcatgtactgaacaaagggaggtgacggaggcctggccctttctctgtgtggcagctgaacagtacctgtagtttttctccactctgtcttctttgatcccattgccacatagttgtccttgctgtgtataggctaatttttaaaagtaaatgtagtttctagaaatattggttgttttgttataatagattattaaaaccataatttcagaagtaagaatatgatttgatttttcctgttaagttctgcttcacttaaaatgagaaaaaaatatgctagtttctacctgtggaggtacttgcataaatacattcctttaaaggggaccaaaacagtaaagcaataaatagaaataccatctactggtataattgctataaactaatgcaaaaatggggtgtatttaattatttattttaaaagttttatattgcttttgaatatttggaaaatacacaggaatataatgaaagtgattaaaaattacaaacattcccactacacagagaaaaaattgacttttaatacatctctcctacttaaagaactgagatgatagtgtaaaaataattttccatcacctccttttkaacttaatattacatatttgtccaaaggcttagaaacattttaaacatacttttttggtttttttaaaatcaactttttrttttgaggaatatctgccctgcagaaaagtgcaaaaaaatgctttggtaacacctgtatattcttcaatcgtcaattatttttatttgccatattaattttatctctctctayagtttattttgttgagccctaaagatracttttaatggctgcacgtatttactcctgtgtatgtatcatagttaattattctcaggaatagattatttctctttttacctttttttaccatttaaaattcagttcactgagcattcgtgctaagcattatacatacaagatctaactttaaaactataaccctaaggggcaggagttacagaagataggattaaagcttagagaatttaagtaacttgccaaaggtcaaatagctaacaagtggaggggctaagacatgaatcctggtttactggacttagaactctgtgtttttaatcacttcatagtaatatctgtctgccatcttcttagatgttaactcttctacaaaaccttcctgactcccatctctccatacttcctttgctcctagaaccctggctgcttagatggatggtacgctatttcagtataacaacttcttttttttttcttttttttgagacggagtcttgctctgtcgcccaggctggtgtgtggtggtgcaatctaggctcactgcaatgtccacttcccaggttcaagagattctcctgcctcagcctcccaagtaactgggactacaggtgcccaccaccacgcccggctaatttttatatttttagtaaagaagggtttcaccatattggccaggctggtcttgaacttctggcctcargtgatccacctgcctcagcctcccaaagtgctgggattacaagtgtcactgggcccagccagtataacttctttacttttctttgtatgttattagaccacgagcacgttttgccctggatctgtgttagtcatcttttactcctactttctgacacatggtagttgcttagtgagtaattatcgaataagtaaatgaatggttgaaagcttcttaacacatattaccaaattgctctacataaatcttrtactagtttaagtygatttggaggatttctgttactgaattcaccacctgccaacattgagtgttaggactcaaacagtatgttgtttgggccattttatgtccacaccactcttacaaatttctttatgggaaagaaatttttgtcccattttgttaaataaaattttaaaaatgaaagcttgttttttaataaaatatatatacattgaagaaaatttgttaaattgggagycatagagaacaaaattaccaggaattccactattctgaagcttttaaataaaaaccctgctgctgttttcctatttaaaaataaaccatatgttatctttctttctttcaataataattacttggagtattttcctatgcattagtgggcctttgaaaaccaaaatgtcaaaggctgaataatgttcgtctcacgaaaaaaagtatatttattatcaaaacagtattctagaattgtaaacatagctatggggaacagtttaggacataaatatttgtgcatattactagacactgaatattttaaatgaaagtatttcaaatacacagaaaagtttaggtattagtgaaacaaatagccaaaggtcaactatacagatatttacagctatccaataactttccatgtaggctaggaactccttctacaaataaagtgrtcagaaagaaatagatgtttaccatttgaggaaatgtttctatcttggtagctcctagtttatgttaaatgggtgctagatttactaatttctgttaatgcagttcaagctgtctgagatctattgtatttacacaatacaatagattttttatttgatttgatttctttttatttgatttctttggggacactcatttaaaacaacttttcttgactatagctttaagagctgtcacagctgcagatacagctgcaattttttttagttttaactagaaactcatcatttactcttccttgaacacagctggatatgttcttttttcctggttggtggcactgttatacagctattcatatgactatatgttgctgcatacaaactgggtaaaatcattatgaattattggatgtaatttttatcatcttatgctattttgggggttatatattgctttcactgccactaatttcagtaagagaaaagtgtgtaaatcataatgacagagctaactacaattcttgtcaaaattgttggcttattcttaggatccattggttttatgctctacaaattagaggatctaatttgtagtctgcattccaatactgacgtttttagtgtgctgcctacttgaacattcatgtaaaacattacaggaagaaatgaaggctgggcacagtggcccacacctgtaatcccrgcacttcgggaggccaaggcaggcagatcacctgaggtcaggagtttgagaccagcctrgccaacatggtgaaaccctatctctactaaaaatacaaaaattagccggacgcagtggcgtgcacctgtagtctcagctactcgggaggctgtggctggagaatcacttgaacttgggaggcrgaggttgcagtgagccaagatcacagcattgtactccagcctgggtgacagaacgagactccgtctcaaaaaaaaaaagagtacataaacacccatccctgaagaatatcatctcatccccttgtgaaaaaaaaaatctcatctcctttccaaaaaataccatctcattgtcttgccaatcaattcsaaagagctcaaaaaaacaattaacaaagttagtatagttcccctttttgttcaaaagaggaaagatttgctaactctgacacacatgggaagagcttatgaaatattttattggtttttgctctattgttcattgctattgcatayaaacataagattatatatataatttgtgcattataaatrtacctcattcatgcataaatacatgcttcatacattaaacatgtatttttcccccatgcttagatccagtttattccagaaaaaaagcaaaattttcttcaaagatcaaaagcaactatcagtagatggaaaacttttaaatttttgcctccaattcttttttttcttgagctatgtatgaggaaatctatagctcagactgtgtctggtgttagtatgtatcaagctctttagccagaaggaggagcaaggcaartgaaccacatcccttggcacttagttccttcttactttccctatatgagagagtacatgcactcctgagcaaggagactgcagggcggggatctctagaatccccggaggaccaggggctgcatagcatttacttcatcttacagagttaagtctgagatgacagaagggattcatctagggcccacagctagtaaattataatgtcaagatcaaatcctggttttctcacccttatgggtaatatttaatgtcattgttccctttattacactacttttttcaccctagggtgacagctctcacaaagttcggtcctggaacaatatgtttgataattctatactaacaggatcatatactaatggtactaaaacttgatttttttttcttcccaggattcatacctgtgtgtagccttggagtggctcaagtgggtaggatgaactttggaaaggatgtcagcaccttgaaatatttcaccatctgtggcttacaagagggctatgaaccatttgccgttaatacaaacagggatattaccatgtggctgagcaagaggcttcctcagtttcttcaagttccatcaaaccatgaacatatagaggtttgctttttctttaaaaatcaggccatttctaaaaagcaggaaaagaatatctttatacaaaggaacttctgcttagacaattattatgacttacttaaaatgatgaccttgatgtgttatatagtagtggaatctaagcaaagatggtactttctaccagctatcagtggatgggaaacttttaaatttttgctttcaattcttttttttttttccttgagctatgtgtgaagaagtctatagctcagactatgtctggggtttgtgcgcatcaagctctttagctagaagaaagatcaaggcaaagggaaccacatccattctcatattagttacgttacaagtagcttgttagaatgatgaaaaatactttcctttttatgtgtgggcaatgtcaggctgaatctgaatatatagaattataagataaatttccgaaaccgtctttagaaacagaagcagaactctatgactatatccatagcacagtaatctgtttaatcatctcttacaaaatgatgccatgtgtggaccgcatttgggattctgaaaacgtgatgtgccttagtcatctttagaatcaggaaattgacaatggtgattggaatgtgaactatcgcttcttcgtttgctaggtgaccagaatagacggcaccatagacagttccccatgtttaaaggtcactcagaagtcttttggttctcagaacagcaacactgatatcatgttttatcgcctgagcatgccgatcgagtgcgcggaggtcttctccaagacggtggctggagggctccctggggctggcctttttgggcccaagaatgacttggaagattatgatgctgattctgactttgaggttctgatgaagacagctcatggccatctagtgcccgatcgtgttgacaaagacaaagaagctactaaaccagagtttaacaaccacaaagattatgcccaggaaaagccctctcgtctgaaacaaaggttactaatttatacgctgtgattttaaatttgtagttatgtgaggarggttacagtccagagtaaagggtctcctagtgtaaattttttcctccttctcctcctcctcctcctcctcctcttcccccttctcctcctcccccttctcctcctcccccttctcctcctcccccttctcctcctcctctttgtgcaaaggatgctgtagggaaaaattaagcaacctgttagtcatctaatttgttagcgtagrtgcaatctatctcaagagttacttttwaagatgtctgtgtttacattcttgcctgaaacttgcagagcattttctccaaatagtattttttatgataaaggcggcaagttattttaacatcctttcttatactaaatcagagtttctcagtctcagcactattgacactttaggccagacaattctttgttgaggacacaccttggacattgaaggatgctgagcagcatcctgacctccacccactagatgccagtagcactccatcccccaaactgtgagaaccaaaaacatgtattttcagatattcccagatgtcccccagggagcaaaatcgcccaggtttaaggcaactcaattgattatatgctcatatttgaagtagacagaacattttaatgttgcttattgttagtcctctgaaatatttcagatttttgcttagaagaacaaagccagattacagcacaagccattctgcaagactcaccgaagatgtccttgctgatgatcgggatgactatgatttcttgatgcaaacgtccacggtatgaggttgcagcttttgtcgtttatttctatytgtcactcattatgytttacatctccagtaatacataccgattcatcatacttagtaacattatttttaaaatgtctgtttctgtttttggatatattttggggactgaaagtttgaaaaaagtttacgtattatgatggatattatgcaatacaagagctattttagaaaaaatatttgtaatggcatgcataatcttaattttgctctgttkcttgacaaaattttaaattgcccttgaatttttcaactacatttgattttcttcatcttactgaattgtctgaagatcaatcatcataatttgtgagaggtcaagctttgctcccttccattttaaattctcaaagctacttctcctaaaatgctacattgaaaaagtatttagttgtgttcattgtagagtgatcccatatttgagtttgatgttcacatgttctgaactatttcaaaatgagtttaggccrggtgcagtggcttaaacctgtaatcccagtactttgggagttagaggtggatggatcatctgaggtcaagagttcaagaccagcctggccaacatggtgaaacgctgtctctattaaaaatataaacattagtggagtgtggwggtgggcacctgtaatcccagctactagggaggctgaggcaggagaattgcttgaacccaggagacagaggttgcagtgagccgacacggtgtcactgcactccagcctgggtgacagagtaagactctgtctcaaaaaaaaaaaaagtgagcttaaagttcaaaatgttatgtgtcagagaaaggaaaggccaagaacatgcaaaaaaggtgggtgacragtataaaaacccaaacattggccaggtgcrgtgactcgcgcctgtaatcccagaactttgggaggcygaggcaggtggatcacctgaggtcaggagttcgagaacagcctggctaacatggtgaaaccccgtctttactaaaaatataaaaattaactgggtgtcgttgtgcacacctgtagtcccagctactcgggaggctgaggcaggagaatctcttgaacctgggaggcagaggcttcagtgagctgagatcacaccactacaccccagcctgggtgacagagtgagagtctatctcaaaaaaaaaaaaaaaaaagtgaacatagatttgcatacrtgtataagcttgaagaatttgaagcttccytatgcttaatggrttcgtggttttattacatacatacactgtatatgtgcacatatatatgtatgtgtgtatattacacacatctagcacacacatatatgctgaccagcataaaaagacttaaatcatttagcatgtttgctcagatcacatcttttctctctttcctgttatttcttatttaattcaggatctctggtaaaagacgtttcttagtttgtagtgttagtcctttgtgcctacaatattttcattcacccaaacggttttaaaccaagaagtgaattcttaagtcattcacagacttagacacagttaggattgcaaatccaagttttgttttgtttagttttactttgccaatatttggttctgctatcttcacagtactattactcagtgagaatctttcctggacaagaacctgctaatgtctgggtgggctggattacatcagatttccatcagtatgacacaggctttgacttggacagagttcgcacagtaacagttactctaggagatgaaaaaggaaaagtgcatgaaaggttagttttcctcaattttttgcaagaatgacatgtgaaaaaaatattggtgaacctagctattccttttccttgtattttgtgaccaagrtatttctatttataggaagaatataatcaagccattaatgtcaatgtcgtttttgttattcatacaaaccagttaaggaatctaaatgtgttaaatgtgcaaacattgtacagtaagagcagtgcagccttttggggtaatgatcatatattccttcaggtaacatgactaacagcttgggttaccaatacttagcctttgttttagggttgagagatgggtgaatgtgcggcttttaaccaatgacttgatatagatttcgggaactggctatgtggtggggagaaaactgtgaagacaatgtgggctggtagtttagaccaggtggacgcatttgaactcrgactgaggagaagtgggttctttcctcagctttgccattgactcgctgtgtggctttgggtaagtcagttacactttctgtgccatctttttttcatttgtaaaacaaaccaaactcaaaccaaaccttcaaaaaagtgaagaaggctatsttccttgcagaataagacaagagaagatctgaccattggcttctaccttttgtgcccatgcatcctctctgatctgctgtgacaggtctccgaaagagtcctttataacgttgcttttcttctatacttgcaccatcattttttgggaaactcactttcctgccctcgggttgtaacatatgaagcataatggacttagcattttcaatgggagcccagcaaaaatctctaatgaagagctctttacataagtttggaacaaaaaaaccacatgtctccaggaatattttttgggggccatgcttaattttcagggatggcaacagtataagtaaagaactcaatatagggatgggataactgaaagatgattttgttggaggaaatggaagatagggaagggtcattggattttatgtagatagtgtgaagaaatgcagcctacatttgattactcaaaaactgatttatcccagcctttttgttctttcccttctgcttgcctggctttagccttttttgctggttttgttaatatgtttactgtacagtggcaaagaaagagaatgctgataaggctcaaattacttaactttgttaccatctctagtaaaagctttagggaaggtgaaaatcaggtggcatttgtggttaatatcactgggttttttttttttttttttttttttgcatattctagttaartctgtctctcagatcactgggaattgtccagaaaggggcaaaattttagccaaattttaagtatatcaaatcactgaaggcttatgtagaatttgcctaaggactttgatagtgtctggaaataaatgcttctyatttcaraacaagtggtaaaacaaaacaaaacaaaaaaaagctaaaaaaaatccatgagatgaaaattacaaatttggatgatttttaaatagttaaacttttttgaacccagaaaaaggtctagtttggtttgagtttttggagagaaggtgcaggtcagttcttacttggttccaacttgttgacctgtcttcattaggtgtgaaatgtagagacttataagacctgattcagaacgtccactgcagtcaatggagttttgctcagaatcacagaatcgggcctattgtgcacctctcccattacagcatgagcttgttgcttgcgcagcataatttagttagtttgcaagatatacctgctttctcttttatctgtggttgtacaaagataaaaatgttcttttgaaattcagcatcaaacgcagcaactgctatatggtatgtgcgggtgagagcatgagccccgggcaaggacgcaacaataatggactggagattggctgtgtggtggatgctgccagcgggctgctcacattcattgccaatggcaaggaactgagcacatactatcaggtacgcggtcagtgatgatatcagtcttctagggaggaagacttctttcccccattaaaggaaaacacagtttgtaagatcaaaaagtaaaatagacacatgtacatgtgcccctggtctgaaaatcagccgagcagacctgcccctagcaagccctcctcatagctgtcccagccactgcactcctgtgacctgagaaacaggtctcaccccaacaaagctgcacaatcaccaccacaaatgcctgtagcgagaccactgaggcacttgcagatgctgctgacataaattacagctgaagaatctgcacagatactacactaccgcatccacccagaaccaaaaccagtgtatcctacccaaccggtaccctagaacccatctacaggaaaagctatttcctacaaaagctacttcataaagttggaagaagctactgttttaccagatgaacagatatcaaaggaacacaagaaacacgcgaatggaaggaaacatgactcctccaaaggaacacaataattctctagtaacagatccccctccccaaaataaatttataggatgcctgaaaagaaattcaaaataatgatcttaagggaactcagtgagatacaataaaatgcagatacttcaacaagattaggaaaccaattcatgatctgaatgagatattcaatgaagaaatacatatagtagaaaagaactaaacagaaatcttgtaactcaagaattcaataaatgaaataaaatatacaactgagggtttcaacaacagactagatcaagcataagaaagactttatgaacttgaagacaggtcttttgaaataacccatccagagggagaaaaagaaataaaaataagaaagaaggaaaaaagcctatakaacttatgggatgccactgagcaatggagaaaggcacagaaaacgtttaacaaaataatgactaataactttccacatctttggaaagatatggacatccagatccaggaagctcaaaggatctcaagagaatcaacccagaaaagtcctttccaaggcacattataatcaaactgtcaaatatcaaagaaaaagaatcctaagagtaatgagagaatagaaccaagtcatatatgcttggatttccatttgactatcagcaagtttctcagcagaaaccttgaaggctagggaaatgagatatattcaatgtgctgaaagaacaactgtcagccaagaatactatgtctagcaaagctatccttcagaaatgaaggaaaaatagagtactccacagataagcaaaagcagaatgaattcaccacctctggacctgccttagaagaaatgcgtaaggcagtgctaaagctggaagcaaaaggatggtaattactatcatgaaaacatgtaaaagtataaaacccattcgtagaagtaaattttaaatcaaactcagaatactgcagtactgaaatggtgctatgccaaatctttcagacctctagtactctagtatgaaggttaaaagtcaaaattgtcaaaagtaactacagctacaagtagttgttaaggaacatacaatatagagagatgtaaattaaggcatcagaaatataaattgtgaggggagggtaaaagtccagagtattttttttttttttgagacagagtcttgctctgttgccaggtaatggtgggatcttggctcactgcaacctctgccttctgggttcaagcaattctcatgcctcagcctcctgagtagctgggattataggcatgcaccaccacacccaggtaatttttgtatttttaatagagatggggtttcacgatgttggccaggatggtctcgatctcctgaccttgtgatccgctcacctcggcctcccaaagtgctgggattacagacatgagccaccatgcctggccagtccagagtatttttatgcaaccaaatgtatcagcttaagatggtctattrtaactacaatattgtttrtcttagtttcatagtaaccacaaagaaaaaattgcagcagtcacactaatgagaaagggaaaggtatcaaagcttagcaccacaaaaaggtatcaaaccacaaaggtaagcaagagagcaagaaagaaatgaaggatctagaaaacaaccaacaaaatattaggaataattccttacctatcaataataaccttgaatgtaaatgaattaaattgcttagttaaaatatatagagtggctgcatggataaaaagcaagactcaactatatgctgcccactagagattcacttcacctttaaggacagacatagcctgaaagtgaagggatggaaaaagattttcaatgcaaatggaaactgagagtgagcagaagtagccacacttagataaaatagacttaattcaaaaaatgtaaaaaagagtcaaagaaggtcattaatagaaaaggatcagttaagaagatataacaattgtgaatttatatgcattcaacactggagcatccaaatatatgaagtatgttttatctaaagggagagatrggcttcaatgcaacaatagtagggaagttcaacaccccactttcaacaacagcagataatccagacagaaattcagcaaggaaacagcagatttaaactgcactctagaccaaagggacatactagacatttacagaacattctgtgcaacagatgtatagctgaagaatacacattattctcaactgctcatgtggcattctccaggacagatcatatgttaggccacaaaataaatctttaaaaatttaagatgatatcgtatatattttctgatcacactagtataaaactagaaatcaatactgagaggaactgaggaaactttacgaatacatagacattaaacaacatacccctgaataaccagtgggtaaatgaagatgttaaaaaagaaattaaaaattttcttgagacaaacaaaaatggcgacacaacataccaaaagctatgggatacagcagaggcagttctaagagggaagtttacagtattaaatgcctacatttaagaagtaaaaaataaaccacctaatattgcacctccaaaaaccacaaatacaagaacaaactaaaccccaaattaatagaagtaaataaataataaaaattggaacaataacgaaacagagactaaacaatacaaaagatcaatgatacgaagagttggttttttgaaaagacaaaatcagtaaacctttagctagacaaagaaaragatgactcaaataaataaaatccacattgaaaagaagacattacaacstataccacagaaatacaaaggataatgagaaaatattatgaaaaattrtatgccaacaaattggataacctagaagaaatggataaattcctagatgtatacaacctaccaagactgacttatgaagaaatagaaaatctgagcagattaatagtgagtgaggaaattgtatcaataatgaaaagtytctatcaaagaaaagcccaggactaaatgggggaaaagttgaaagcttttttttctaaggtctggaacaagacaaagatgcccactttcaccacttctgttcaacataatactagaagtgctagccagagaatttggcaagaaaaagaaataaaaggcatccaaattggaaaagaagtcatcaaattgtctcagtttgtagatgacatgatcctatatataaaaatacctttaaaagtttactaaaaaactgttaaaactaatacattcagtaaatttgcaggatacaaaatcagcatacaaaaatcagtatttctttgcactagtagtgaatgctctgagaaaaaaaatcaagatacaatctcagttacaatagctttaaaaatcagttatcggctgggcgcagtgactcatgcctgtaatcccagcactttgggaggccgaggcgggtggatcatctgaggtcaggagttctagaccagcctggccaaaatggtgaaacctcgtctctactaaaaatacaaaaaaattagccgggcatggtggcaggcacctgtaatcccacctactggggaggctgaggcaggagaatcacttgaacccaggaggcagaggttgcagtgagctgagctccagcctgggtgacagagtgagactccatctcaaaaaaaaaaaaaaaaaaaatcagttatctaggaatacatttaacaaaggaggtgtaagatctctacactgcaatctataaaacattggtgaaataaatttaagaggacagaaataaatggaaagatatctcatgctgttggattggatggattggaagaattaatattattaaaatgtccatagtacaaaaagtaattacagattcagtgaagtccctatcaaaataccaatgacattattattctattatagaaatagaaaaaataattctaaatttcttatgaaatcacaaaagaccccaagcagccaaagcaatcttgagcaaaaagaataaagctggaaacatcacactaactgagtttaaaatacacaaagccatagtaaccaaaacactacctgacttgaaactatactacaaagctatggtaaccaaaasagacatatagaccaataaaacagaacagagaacccagaaaaaaaaacacctatccatatccaactaattttcaacaaaggtgccaagaacacacattggggaaaggacagtttcttcaataaatggtacagggaaaattgaatatccacatgcagaagaatgaaattggacccctatttttcaccatatacaaaaatcaactcaaagtggattaaagacttaatgtaggaccttaaactatgaaagtactggaagaaaacatgggggaaacacttcatgacattggactgggtaaggattttttggacgagacctcaaaagcacaggcaacaaaagcaaaaatagacaagtgggattatatcaaactaaaaatcctctgcacagccaaggaaacaacagagtgaaaagacaatctacagaatgggacaaaatatttgtaaactatacatctgataagggatcaatatccagaatatataaggaacacaaacaacaatagtaaaaacaatctgatttaaaagggggcaaaagaccttaataaacatttctcaaaagaaggcatacaaatggccaacagacatatgaaaacatgctcaacatcactaatcatcagcaaagtgcaaatcaaaaccacaatattaccttattccagttaaaatggctattatcaaaaagacaaaagataataagcattggcaaggatgttgaggaagagggaaacccatacactgttggtgggaatgtaaatgaatatacccattatgaaaaacagtatggaggttcctcaacaaattaagaatagtactaccatatgatccagaattcctgggtatatatcccaaggaaaggaaatcagtgtgtggaaggaatatctgcacttctataattatcacagcactactcacaatagccaagatagggaatcagcctaagtgcccatcaatggattagtaagtgaagaaaatgtggtatatatacacagtggaatactatttggtcataaaaaaaatgagaacctgtcattygyaccaatatgggtgagcctggaggatattgtgtttagtgaaataagccagacatagaaagaaaaatactgcattgcccactcatatgtagaatcgaaaaaagttaatgtcatggaagtagtgaatagaatagtggttatcagagactgggaagggtaggtgaaagtgggggagagggagcagatacccaatgggtatagagttaacattagaaaggaagaataagcgctggtgtcctattggacagtagggtgactatagtcaaccatcaggtattgtatatctcaaaatagctagaagagaggattttgtatgttctcaccacaaagaaatgaaaaatgttcaaagtgatagacatgctaattaccctgatttgatcattacacaatgtatgcaagtatcaaaacatcatgttacaccccattaaatatctacaatgtgtcaattaaaaaacagtaaattagaaattaaaagaaaatggaaaaagttagattaattatgtatgtttacttctgttaaataatgacaatgccttaagcccttcagagtaaacagagtatgttccccaagcagtgttcacatagtaatgaaatactctaattcttgaaggagcacatcaatcaatatgcaagaaaggaaaatctctgggctccttctgtaaagtattcctttgttgttataaagaaaaactttttcccttgtcttgtttcattactaacattattaaattcattaaatgtatttcaggtggaaccgagtacaaaattatttcctgcggtttttgcacaagctacaagtcccaatgttttccagtttgagttgggaagaataaaggtaataaaacttattcctggtattgtatttgtattttttctattaggatatagcattgwtttattctgaaatgaattcagtatattagtactgatatgaatcaaataaatcattctttcaagaaaagatagccatgcttgaaaatctctttcaggtcacaagggtaacaaaataattaaaaagtgtttcwctttagttatcatatgtatattattcaataaaaggcctatagaaaaaaaaatgccgagattacacacattgcasyagtcattgaactgataggtgagctaatgaatggacttaaagatctgaaaccatgccacctacaatagtggtatgtatggaatactccagtaacataaatgaaagaacaactcagttggatgggttggatcagctaaagctcaaagaagaggtaacatttagtttgattactaactgtaaaatagaagctcttggggtaygtttattaggagaggtcattctgggcagaggatgagaagaagcaaaaatatgtaagagtgaacatgctgaaggttaaggaattcagtgtawmcgtaacaaaggatgccttccagaatgtggctggagattaagatggataaaaggtagaacaagtccaagttgaaaaggtcttgtgtgccatgtgaaaaggttarcatctattacatagacaagggaaatccattggaaatttgaagaaggggattgagcataatgaaacttgttttggaaaaatatgttgttattaatgtggaggtgggcaagaatgagaataatcagtagcaatgaggtgtcaataatttgatactgtctacatggaagacagtgattagagccatggaagtcagaatgaaaaatgataaatgtgaaaacattctagagaagaaatgaatacgcgaaggcccgtggtgggtgatgacatgatgtgatttctgcccagtgctctgaatgtcaaagtgaagaaattcaatgaaggacgggtaaacggcgggagtaactatgactctcttaaggtagccaaatgcctagtcatctaattagtgacgttcatgaatggatgaacgagattcccactgtccctacctactatccagcgaaaccacagccaagggaacgggcttggtggaatccgcggggaaagaagaccctgttgagcttgactctagtctggcacggtgaagagccatgagaagtgtagaataagtgggaggcccctggtgcccccctgtcccagcaaggggacagagtggggcaaggccagaggtgaaataccactactctgattgtttattcactgaccccgtgaggtggccccaaggggctcttgcttctggcgccragtgcccggccacatgcacatgccaaattgtaaagaccatcgatgctaggaagaaactgcatcaactaatgagcaaaataaccagctgacatcataatgacaggatcaaattcacacataacaatattaaccttaaatgtaratgggctaaatgctccaattaaaaaacacagactggcaaattggataaagagtcaagacccatcagtgctgtattcaggagacccatctcatgtgcagagacacacatatgctcaaaataaagggatggaggaagatctaccaagcaaatggaaaacaaaggcagggattgcaatcctagtctctgataaaacagactttaaaccaacaaagatcaaaagagacaaacaaggccattacataatggtaaagggatcaattcaacaagaaaagctaactatcctaaatatatatgcacccaatacaggagcacccagattcataaagcaagtccttagagacgtacaaagagacttagactcccacacaataataatgggagactttaacaccccactgtcaacattagacatatcaacgagacagaaagttaacaaggatatctaggaattgaactcagctctgcaccaagcggacctaatagacatctacagaactctccaccccaaatcaacagaatatacattcttctcatcaccacatcgcacttactccaaaattgaccacatagttggaagtaaagcactcctcagcaaatgtaaaagaacagaaattataacaaactgtctctcagaccacagtgcaatcaaactagaactcaggattaagaaactcactcaaaaccactcaactacatggacactgaacaacctgctcctgaatgactatggggtacataacaaaatgaaggcagaaataaagatgttctttgaaaccaacgagaacaaagacacaacataccagaatctctgggacacatttaaagcagtgtgtagagggaaacttatagcactaatgcccacaagagagagcaggaaagatctaaaattgacaccctaacatcgcaattcaaagaactagagaagcaagagcaaacacattcaaaggctagcggaaggcaagaaataactaagatccgagcagaactgaaggagatagagacacaaaaaacccttcaaaaaatcaatgaatccaggagctggttttttgaaaagatcaacaaaattggtagaccactaccaagactaataaagaagaaaagagagaagaatcaaatagatgcaataaaaaatgacaaaggggatatcaccatcaatcccacagaaatacaaactaccatcagagaatactataaacacctctayscaaataaactagaaaatctagaagaaatggataaattcctcgacacatacaccctcccaagactaaaccaggaagaagttgaatccctgaatagaccaataacaggctctgamattgaggcaataattaatagcctaccaaccaaaaaaagtccaggaccagacagattcacagccgaattctaccagaggtacaaggaggagctggtaccattccttctgaaactattccaatcaatagaaaaagagggaatcctccctaactcattttatgaggccagcatcatcctgataycaaagcctggcagagacacaaccaaaaaaaagaactttagaccaatatctctgatgaacatcgatgcaaaaatcctcaataaaatactggcaaacggaatccagcaacacatcaaaaagcttatccaccatgataaagtgggcttcatccctgggatgcaaggctggttcaacatacacaaattaataaacgtaatccagcatataaacagaaccaacgacaaaaaccacatgattatctcaacagatgcagaaaaggcctttgacaaaattcaacagcccttcatgctaaaaactctcaataaattaggtattgatgggacgtatctcaaattaataagagctatttatgacaaacccacagccaatatcatactgaatggrcaaaaactggaagcattccctttgaaaactggcacaagtggccttctctccccactcctattcaacatagtgttgaaagttctggccagagcaatcaggcaaggaaaagaaataaagggtattcaattaggaaaagaggaagtcaaattgtccctgtttgcagatgacatgattgtatatttagaaaaccccatcatctcagcccaaaatctccttaagctgataagcaacttcagcaaagtctcaggatacaaaatcaatgtgcaaaaatcacaagcattcttatacaccaacaacagacaaacagagagccaaatcatgagtgaactcccattcacaattgcttccaagagaataaaatacctaggaatccaacttacaagggatgtgaaggacctcttcaaggagaactacaaaccactgctcaakgaaataaaagaggacacaaacaaatggaagaacattccatgctcatgggtaggaagaatcaatatcatgaaaatggccatactgcccaaggtaatttatagattcaatgccatccccatcaagctaccaatgactttcttcacagaattggaaaaaactactttaaagttcatatggaaccaaaaaagagcctgcattgccaagtcaatcctaagccaaaagaacaaagctggaggcatcaygctacctgacttcaaactatactacaaggctacagtaaccaaaacagcatggtactggtaccaaaacagagatacagaccaatggaacagracagagccctcagaaacaacaccacacatctacaaccatctgatctttgacaaacctgacaaaaacaagaaatggggaaaygattccctatttaataaatggtgctgggaaaactggctagccatatgtagaaagctgaaactggatcccttccttacaccttatacaaaaattcatccaaggtggattaaagacttaaatgttcgacctaaaaccataaaaaccctagaagaaaacctaggcaataccattcaggacatargcgtgggcaaggacttcatgtctaaaacaccaaaagcaatggcaacaaaaactaaaattgacaaatgggatckaattaaactaaagagcttctgcacagcaaaagaaactaccatcagagtcaacaggaaacctacagaatgggagaaaatttttgcatttttgcaatcttctcatctgacaaagggctaatatccagaatctacaaagaactcaaacaaatttacaagaaaaaaacaaacaaccccatcaaaaagtggacaaaggatatgaacagacacttctcaaaagaagtcatttatgcagccaacagacacgaaaaaatgctcatcatcaatggccatcagagaaatgcaatcaaaaccacaatgagataccatctcacaccagttagaatggtgatcattaaaaagacaggaaacaacaggtgctggagaagatgtggagaaataggaacactttcacactgttggtgggactgtaaactagttcaaccattgtggaagacagtgtggcgattcctcaaggatctagaactagaaataccatttgacctagccatcccattactgggtatatacccaaaggattataaatcatgctgttataaagacacatgcacacgtatgtttattgtggcattatttacaatatcaaagacttggaaccaacccaaatgtccatcagtgttagactggattaagaaaatgtggcacatatacaccacggaatactatccagccacgaaaaatgatgagttcatgtcctttgtagggacatggatgaagctggaaaccacaattctcagcaaactatcacaaggacaaaaaaccacacaccgcatgttcttactcacaggtgggaattgaacamtgaaaacacttggacacaggaagaggaacatcacacaccggggcctgttgtggggttgggggagggagggagggatagcattaggagatatacctaatgtaaatgacgcgttaatgggtgcagcacaccaacatggcacatgtatacatatgtaacaaacctgcacattgtgcacatgtaccctagaagttaaagtataataaaaaaaagaataggatttaacaatgaattggactaatagaatttgtagatgaatggaattcaggatctcaaggagactgagaatgaatgattgatttaaaattttagtttggacaatttgaccatgctaatcraaaagtagaagagcttttcgaaattcaggaaaaaaggttgaacttaattttgcaattgtaaagttgaggttccaggcacacawtggagtgaatagagtagatagttttattaggctggcttggtgaccttggacatctttcttaaattatttgagctcagtttctgcatctataaaatggggttcacagtatccgttttatggagttaatataactaaacatcttgagcagtgctttatacatggtatacagcaaatttatatactcaataaatttacatacaatatacatacgtatgcatacctatatacacatatgtatacaccattgtgctaaaaagagctatgctggagattaaaattttcatcatcaagaaatcagttgtaattcatctttgagtgtgaatggaatatttgagggcagatgtagagagtgggaagagatggctgaggagagagcctggttgtatcaactaaaaaagaggaacctatgagataggctgagggcagaactctcaagaatgttggagaagaactgaaagagacattttagtagacgccaagcgaggatggagttttctaaacaggagtggctaacagcggatgccgtagatggactcatacaactcggagtaaaggaattcctggcttttgttaatgaggagggctttggtggccttgccagaagaatttaagcaaaacaatgggagaggggctggtctcagtggctcatgcttgtaatcccagcactttgggaggmaggaggaatcacttgagcccagaagtttgaaaccagcttgggcaacatagtgagaccccatctctacaaaaaataaaaaattattttaggcagatgtggtggtgcacgcctttagtcccagatcctccagaggctgaggtgggaggatcacttgagagtgcagacatggaggctgctgtgagccgtgattgcgctgctgcactccagcctgggtgacagagggagaccttgtctcaattattatattaaaaaatgatgagaggagccatgtgacagtgaattcaagattggaaatgagagaaaggaggcagcaagttcagactgacctgtttttttttttttttttttttttacaaaattggacaaggagttgtagtttctcagaagcctgactgatatattcagtcatctattgactattgacttctactgacattttcattggccgactaatagctatcacaaattgaatgcatccatactggactgcttgctctcttctcttcttttcctttcttctttctctcttcttctcttctccctctccctccctccttccctccctcccttccttccttccttgtcccygtcccttttctttcttgctgacagtctcactctgtcacccaggctagagtgcactgatgtgatctcagctcactacaacctctctctctctctttttctctttctctctccttccctccctcccttccttcctgccctcctatcttccttgtccccatcccttttctttcttrctgacagtctcactctgtcacccaggctagagtgcagtgatgtgatctcagctcactacaacctctctctctctctttttttctttctctctccttgcttccctccctccatccctccctccccccttctccccttccccccttcccttttctttctttctgacagagtctcacttgtcacccaggctggagtgcagtgacacgatctcagctcactgcaacctccgcctcccaggttcaagcaattctcccacctcagcctcctgagtatttgggactacaggaacatgccaccatttttgtttttttttacaggcgaatttttgtatttttagcagtgggccaggctggtcttgtactcctgacctcaagtgatccacctgcctcggcctcccaaagtgctgggattacaggcgtgagccatggtgcctrgcccagtctttctttaaatgttgctttctcaatgatgcccattctgacaaccccatttaaaattgctgcccttgattctggttcccccattctagctttctgtcccccaaacccccaggcccatgacatctcttttaaaataccatttaattcatttaatttacttattgattttatttcatactttcagtgagaaaaatggaagctatatgagggcaggggttttgttagttttattcattagcatatcatcagtatttaaaccagtacttggtttttccccscctattgttagagggcaataggaaagcagtttgaggatgaagtagtctacagcatgcagttgagggggctctagaggagaagaagagatagaagataatgcagaaatatgagataatggttttcttatggtcccataagaggcaggcatcggtgttgtcaagatcatagataaatgaagaagcttttggcaaagcagagacctctctttctttgacaccagacagaaagaattaaggatggctgaagatgatactggaggtggaggagaaataagtaggtttgttaatgcctaacatattctgttttcttattcggtagtcaggtttatctgttgagctttatctggaatacttctggctagaggaagtgtcttaaggacgagttgggtgacagagaacagatattgagagagagagccagggggatgtgacatatctgtcattcaggaagtttggcactgaaagtccctaaagacttgccagctttcccggaggtcccagcctggtaaagaaatataaaggatatatgggtatgcttggccttctctctgtgccattcagtatatgggaaagacacatcccgaaacctgtttgactgcccggaaggtgtaggtattctctctcataatgtatttcctggtttgtcctttcagaaacttttcaacccaatttctatgatttcttgtgttgactttgcttgactcatagggttatcttactttccctgtctctgtcctgtgcagaattctagtcattactttgtgaaccccaagggatgttctacatttattctttttctgcctccccatccgctagaatgtgatgcctctctcggcgggattattcaagagtgagcacaagaaccccgtgccgcagtgccccccgcgcctccacgtgcagttcctgtcacacgtcctgtggagcagaatgcccaaccagtttttgaaggtagatgtgtctcgaataagtgaacgccaaggctggttggtgcagtgtttggatcctctgcagttcatgtctcttcatatccctgaggaaaacaggtcagccccagtgaatccctgacattctgattgggacgcttgggattagcctgctgcccggggcttccggtagtggtgcggggcaggggtggttctaaagaaacaaratgaaatttacaaagatctaaattctttaggcaatggagtcattattctgcgtattctaagtttaagtttatttctcaaccattctgttactgaaaaaaattattctgtagttgaagatgccacatgatggtttcttcattcactcttgcgttacttacaatgacaatggcgaataaaaattcagacaagtgcaactgcaatccgacttatgacttagcagagtactgtaatagagaatagtgagatattagagatggaatcataagaatcacttatgattcctatgttcaacccttcattttatagatgtaaaaaactgatccaagagatattaatgaaagaaaattgggaaaatactgggagtgtcttcgaaacaagtttatatgcattctaggcagtaataatagtaacataaagtataataagtactcaaaggtatttgagtagctttgtttatgattttctgtttttccatatgatagccaattaaattgcagagatttcatttaagcagccttcttatcaataaggagctaagtttctaagttttgggccaagatttccctcccaaaatgccactgaaatgttgaatcacaaactgagtaaaaacaagtcatgaaagtaatgcacaaacatatttgtatgttttaagtctttaatctgaaaataattattgaagccaggtccatttttatatytttagatgttcttggcattttttattttaatatctttaaaatttaacctatgctttggaaaacagtttgtcagttcctcaaaaaataaaattatagcgttaacatgtgatctagcaattctactcctcgtatatacccaagagaaattaaaatatgtccacacaaaaacttgtacatgaatattcatagaagcattatgaacaatagtaaaagaaagggaaccccaaatgttcaccagcttatgagtcaataaacaaaatgtgatatatccatataatattatttggcaataaaaatgattgaagtactgatatatgctacaaaatgcaagaactttgaagacattatattaagtgaaagaaaccagtcacggaagtatattaagtgaaagaatcctactagtgtgggattttatttaattgaaaagtccataatagacaaatctttagaaacgaaaagtagattagtagttacctagggctaggagcggaacaggactgctaatgggtactaaattccttttgggatgataaaagtgttctaaactcaacttatagttatagttacacaactccattaatatacataaactattaaattatgtattttaagtaggtaaattgtatagcatgtaaattacagttcaacaaagatattttaaaacaaaagaaaatcaaagaaaaattaatctggctagttrattctttttatgtattacatatgtatttacattttttacatgaggtaattagatatctttcataatgtactcttgagatggttcagtttgattttaattttgtattctttttttttgtgagaagagttttatcataatttttcatctgatgatgttttttaagaaaataccgaacaaccaaaacaaacacaacatttgggaaggaattcttgtttatgaaggaaaacgttgtgtctctactgagcatggaattttaacattataatttaacattttggcatgctatcatcgaaaaccaacataacaccttgtctcagtagtttatattaattgcctgtgatagatgtgtatgtatgtgaatggataatgtaaactctcactaaagatcataaaggatttgaggcagttttccaaatgatatggaacatgaatgtataaaaatgtgtcactggcatcaggccatagaaaatatatggataggaaaataaaactgaggctaagagtgacacacagtcatttataccacaccgattggtagagttggggcccacattaatttcattcttcctagcagccaaagaaaaatatgatgagtttcaaaatccaaattccaaaaaaggaagtcttaactagcatggttgagaagaatctgatgccccaataacatgacaaatcattaatattttaaagtgtgcaatggtggtagatttatgtcagtgtgtactttgtttctccttaacacatgtcacagtttataatttaatttactccattttggtcagcgggggtggtttactccctcaattgaatataagctccctgggggcaggaatcatgtctatattattcaccattgtatcatcagtgcgcagtgctaatacataataggcactcagtgatatttgatgaacaattgaatgacaatgacatatgaaagaaatttctccactagagacttttttgttgttgtttctttatttatctattgttttgaggtggagtctcaccattgcccagtctggagtacagtggcgcgatctcggctcattgccacagatccttgatacaatggaggaggaaggaggtgctagatgaatgtcaaattctatgtagaagaaaatttgtagaacatctagaaatgattaaaagtactatgcagccattaaacatgtcatagaaaattaaaagaagacacaggttgggtgtcccaaatccaaaaatctgaaattcgaaatgctccaaaatcggaaacattttgagcaccaacataatgctcaaaggaaatggggtatttcacatttcagactttcagattcaggatgctcaaccggtaagtataatgcaaacatttcaaagtctgaataaagtcccaaatccaaacaattctggtcccaagcatttcagattagggatgttcaacctgcagtgtctattcccataacttttttccttcaaatttacagtgcatactgatttctcctctgattcagattttaaaaaatcattcatttctaatcttactaccactctcctcccttctacagatctgttgacatcttagagttgacagagcaggaggaattgctgaaatttcactatcacactctccggctctactcagccgtctgtgctcttgggaaccaccgggtggcccatgccctgtgcagccatgtggatgaacctcagctcctctatgccattgagaacaagtacatgcctggtttgctgcgtgctggctactatgacctgctgattgacatccacctgagctcctatgccactgccaggctcatgatgaacaacgagtacattgtccccatgacggaggagacgaagagcatcaccctgttccctgatgagaacaaaaaacacggccttccagggatcggcctcagcacctccctcaggccacggatgcagttttcctcccccagttttgtaagcattagtaatgaatgttaccagtacagtccagagttcccactggacatcctcaagtccaaaaccatacagatgctgacagaagctgttaaagagggcagtcttcatgcccgggacccagttggagggactactgaattcctctttgtacctctcatcaagcttttctataccctgctgatcatgggcatctttcacaacgaggacttgaagcacatcttgcagttgattgagcccagtgtgtttaaagaagctgccactccggaggaggagagtgacacgctggagaaagagctcagtgtggacgatgcaaagctgcaaggagctggtgaggaagaagccaaggggggcaagcggcccaaggaaggcctgctccaaatgaaactgccagagccagttaaattgcaggtaatcagaacaagagacttgagtgaatttcagaattgctaagcattaaggtattagaacatgcctttgtttctttctctgtgtgtgtgtttatttctttgcattcctgtgtaatggtagttcttcataaaattaactaacttcctattcttttccctcttattcattagccatctcctcttgtttcccagatgctttttaccttcattacattggaatacctgaaatacaagccatcaaatacccctttccacccatatttccactcttaccaaccttagaatacttgtttaccagtagatgcacccattgtcacatagcaaggttttactttcccctagtatgcttttgttttgttcttttgagacagggtctcactcagtcacccaggctggagtgcagtggtggtgcaatcatagctcactgcagcctagaactcctgggctcaagccatcctcccacctcagcttctacagcagctgggactgtaggtatgccaccatgcccagttaatttttttttatttttagtcgaaatgaggtctcgctctattgcccatgctggtgtcaaactcctggactcaagtgttcctcactcctcatgctcccaaaatgctaggattacaagtgtaagccactgcacccagccaccttagtatgtttttaaggaatcagacacactggctgtctttatgctcctcaagatgtctaaagggtcctttattaatgtctcctctgtttattaaagtcaattggatgtttgcatygctgacctgcttttttgctcctcgttcctttagtcagcgttgactgaagccttactctgggtatgcacttaggggaaacacaagtgaaccctgcctttcagaatctcacagcctctaaggaaatatacactcatttatgcattaaaaaatcttattgctaattgcattaaatactctgaaggcaaagaatggattactaaaagaaagaacatttagactggattactgttagaaagatgagggagaagacccctcagagattttgacttttaagctgagttcagatttaagagttgtgctcagcagttacaagaaaaaggaacaaggcagggtgttctaggagctttccatgcaaaacaaatagcccagcaaaggtcctgaggcaggaaaaggccagtgtggctgctggtaggaaaatcgataagggaggaaagagagtgtgatctagtgtctggttagtcaggaggctttcttgctggtccaaactctaggagaccatgctcagaggagggtggggcaaaggagatggagaaaaggggttggacactgtgactacttcagagacagcactgatagaaatggttatattgtagatggtgacacagagggttttaaggtcctctttgacactgtcatgtatttatatcacaattggtattgagtgtatagatttttttaaaaatttggcagagcattctctcttagaaatgtttctaccaacatactcactcagttataaatccttttggttttcagtaggagaaagacccagctaatcactgaatgaatgagcattcaccacttaattgtcttaagtttagatttctagaattggtacagcagttcaatgatctcatccataacccagatcttaatatttttctgctctgtgatcctcagcctgtggttttcttcctaaaatgctcaccttattctttstgcagtaatcatgtcatcacccagttacactcattttgaaagaagggaactctagtctcttatcactgatggaataactttcccagaagacccttagcaaactttcccttatatatttcattggccattgcacctgtggctgaaagggaggctgggagggtaagtgtattagttcgttctcacactgctaataaagacatacctgagactgagtaatttataaagggaaaaggtttaatggactcacagttccacatggctggggaggcctcacaatcctggcgaaaggcaaatgaggagcaaagtcacatcttacatggtggcaggcaagagggcatgtgcaggggaactyccatttataaaaccatcagatcttgtgagacttattcactaccacgagaacagcatgggggaagacaccctcatgattcagttatctccacccagccccgcccttgacatgtgggggttattacaattcaaggtgagatttcatggggaaagaaccagaccatatcagttaacatccactaaagggacatttgtttgccatttttgcttatacaaattatgtttcatctcctgggaccgagcacattgctgcctatacaaaatcaggattctgtttctaagagagaagagtaggcaactaaggatgtttaccacagattatgatttcatacacattattaaaggatttagaaattaaatttggtgtctttttaatggtctcttagatgtgcctactgcttcagtacctctgtgactgccaggtccggcaccggatagaagccattgtagccttttcagatgattttgtggctaagctccaagacaatcaacgtttccgatacaacgaagtcatgcaagccttaaacatgtcagctgcactcacagccaggaagacaaaggaatttagatcaccacctcaagaacaggtacagaaatgaaatgaaaattcttcgtatttatgttggcttttagtcattcaggatctctgccttgcaaaattatataactcacacgtcttgttttccttgttctgtttaaagtcttcaagttgatttagttagtattcttagtttcaccaaaagaatttctttggttagtttacacaaaagagggacttattagaagatatcaggtatatcaccgactctttgagaaggccaagatatgccagagtctgaagttcttcaaataggagcaaatttcaaccacaaatgggtcttcatcatcttccactcataggaatttttgattcctaggactcgatgctagaggctttccatttgtgcctaccatagaagaaacacatgtctcttccaccttgcttgccggaagactgattacctgcttgtggtttcttcctttcattgcttacccccaaagtcaggtctcctgagggtacaacagaacaaagggaacctgcctatatcagagaatgggctagttgggggatgtaaattttctggaatctacctcagagtgggcctcagagtgtgggaagttactggcgtagggatggtgttaaacaatgtaattcacagatgtcttttttgatttcttacccttaccattttcttctctatccagggtagctcagaatgaaagtgtttatagggactaattacagaatttttttttttctcaccagaatgtaatttctttgaggaaagggatgtggaattttcttaattgttataaacagcatttattgagcagagaacaggtccagcctcttccagattaactctgttaaactactgttgggaaacttctgcttctggaaagatggagtacatgtgcttttcccgattcttccttttaagtacaactaaaaccctggacattacaaagaagacaacataagaaggctctgaaagatagagagaagaagagaggttggctacagaactcaggacccaaggaacaacatggtggtgagttccctggattttctttttgcctcatctatcccagatttgaagctaaagaagacgacaaccaggaaacaccaatgggcatagacaagaaaagctgcaacaaaagcctcctctttctagataaaggatcagggaaggggcagcttagcaagacagaaatgtgttagataataactgcactactgmagccaaaaaccacagaaaaaactgttccccacccacactgggcacaggctgagtggggaaccttgacttccactctcaccaggctgtaacaaggtgtcccagtagaggacagagctgggactttatccccgctgagtagtaacaaggcccatttcttccaaagtatcagtagaggttatggaaggagaagtagcaagacactcttacctttctagcaaggttcacatcagtacaggtctaatgaggaaccagaactttttaccactgcccaacagtaacagggtcccttccctcctccagatgtccaagaaggctgagtgggaaaatggacttcgcctcccacctggcagcaataagataccctaagcccttctcctgctggatggggtcagaggaaaccaggtgaaacagagttaaaaataagacccagagctcctagcataatcctcaaaatgttgagatttcaattaaaaatcatgtgtgtgaagaaccaaggaaaacttgaatgaaaaaaccaatcaataagcaccaacactgagataacaaagatgttaaaattatctgatgaagttttgaaagcaatcgccctgtaattccttcaaaatggaaaagaaatagaaagcctcaacggcagagaaacaaaatatatggcaaagaaccaaatggaaattttaaatctgaaaaatataatcactgaaattttaaaactcaatgaataggcttaaaagcagaatgaagggagaagaaggaacaatcagtgaactgaagagagggtgatatcaactaccccatctgaagaaaagatgaagatgaatataacaaaagatctaacatttgtgatgttggagtctcagaggataggagaaagagggtgaactgaagaaaataatgctgaaaacttttcaagttcagtaaaagatatgaagtgagagattcaagaagatgagtacattccgtataggataaacataaatctttaccgagacacatcatagtcaaatttctgaaaaaattaaagacggagtctttaaagaaatgacactacctacagggggagaaacaatttgagtgacagcagatttctcattagaaagtatggagggcagaaggaagtggcacagcaattttcaaatgctgaaagaagagacgatcacctcagagttctatgtactttgaaaatactcttaaggaacgaaggggaaatcaagacattctcaaatgacaggaagttgtaagaatttgactacagcagacctaccctaaaagaatgctaaaggaagttctttaaatataaggaaaatgaaaaatgwaggaaatttggaaaattcagaaaggaagaaattaacactgggtaatgttgtaatatggtgaatgcagtgcatttttattctctggagttttctaatttatgattgatggttgaagcaaaaatcataaaactgatgtgtttctaaatatatgtatagggaatatttaaaaattataaacagaggagaataaaggaacagaaagggagataaggtttctatccttcactcaaactgaagtctactggtgttgacattgtaccatctggtgcaccgtcaataccagtagactgtatgttaggtatgtatataaaataatactcagagcaagcactagaaaagctgtacaaagagatacactgagaagtaccacagataaatcaaaataggattctaaatattgttcaagtaatgcatagcayagcaagtcagtaaaaataaatcagaacaaacggaaccacaggtgaaatgacagactgaagtcatagcatatcaataatctaaatataccaattacaagaaattggcagagtgaatttataaaactcaatctaactatatgcttgctatgagaaactcacttcaaatataataatgtatacagattaaaagggaaaagttaaaggaatatgtattattaaaatattaatcaaaataaagcaggagtagctatgttacataaagttgacttcagagcacagaaaattaccaaggagataaggatcatacataatggtcagtccaccaagaagataaatatatatgaattaaacaacaaagcaaaatatgtgaagccaaaactgatagaactgaaaggagaaatagacaaatccaaaattatcttgcagaattcaagactcctctctcagttgatagaacagctgaacagaaaaatcagctatgacacggaaaaactccacactatcatcaaataatagatctaccaaggtttgtagactactccacccaacgacaaggtacacactcttttcaagtgttcatgaaacatttgctaagatggaacatatccygggccataaaataacctcaagacatttttaaaagttgaaatcatacacatttttttatcacattgttatcaaattagaaagcagtaacagaaaggtaactggaaaatctccaaactcttagagatactaaacaacacacttctaaataatctatggtttgaggaagtatggggagaaatttaaagatkcattaaactaaaagaaattggacacatcacatttgaaaatttttgccacagctaaagcaaggccaagagggaaatttctaacactcaatgcttacatttaaaaagcggaaaccactcagatcaataacctgacctgccacttcaagaattttgaaaacaaagagtaaaataaacctaaagcaagcagaaagaagtcactaatgtagataataacagaaagtaatgaaactgaaaacaggacaatagaaaaaatggatccaaaagctggtttttaaaaaatagcaataaagttgacaaacctctaaaacaactgamaaagaaaaagagaagatacaaattacccataccaggaatgaaactacttatcatggcacaccctgctgacgtcaggtgataacatgggatttttttcttctcacctttgaaataacgataagtagatgagctgatgaatatgttaattatcttgatttaatctttctacaatgtatacatatatcgaaacatcacatggtacctcataaatacatacaattaatatttaccaattaaatatgttttaaaggatcgtatgggaatacatgcatacatactatatgattccatttatgtaacattcttgcaatgacaaaaccatagagatggaaaacaaatttgtggttgccacgacttaaggatgaggggcagacagarggatgtgggtgtgctcatgaaarggtaacaggagggatctttgagataaaggaattatcctctattttgactgcactaatgttgctatcctggttatgagattgtactacagttttgcaaagtgttaccaatcgggaaactgcataaagcgtacttgaagtctctctgtattatttcttacaatagcatataagtctataattatatcaaaataaacgtttagggaaaaaaaatcacataaatgccaaaaagaaaatctaaaatagtttcttaaaggaaaattatgggaaagcatctttctcttccgaatttataaatttaatagtattgttcaaacataaatggtaaagtttcccgcagtttaactgaaccattaatgttagcagcgcgtagttatcccttataaagattaaccatgccgaatatgaaaattcaaaacccagaatactccaaaatccaaaacattttgagcactgaaatgataccacaagtggaaaattcyacacgtaaatacttagtacaaagtttatttcatgcacaaaattatttaaaatattttataaaatttccttcaggctatgtgtgtaaggtgtgtatgaaacatagatgaatttcatttttagacttgggttctatyctcaaaatagctcatgtgtatgcagatggagctggtcctctctatctgtgggttctgcatctatggattcaaccaactgtatattgaaaatattcagaaaaattccacaaagttccaaagcacaaaacttgaatttgctgtgcaccaagtactatgtctaatccacttaaatgaagtgatatgtcagcactgccttgggtattataagtaatttagagatgatttaaaatatatgagaggatatacataggttatatgcaatttctgtgccatttcatatagaagacttgattgtctgtggcttttcatctctatggagggtcctggaacsaatactccatggatactaaaggatgattgtattccaaactctgaaaaagaaatcctagatctgaaacacttccggccccaagcatttcagataagggatactcaaacctgtgttacttttcaattatatttttccttcttatttgtgtctgtgttcttctcaaaaagagttcttgtaaatattcaatgaatgttcaatagagatgttagctagaaaataatggaaatttaggataagcatgatacaatactttttaaaaatagcatttagatctcttagttatgaattcttaaagtatacaagagtctgacatattgtggacttgagaaagaggaagaaacgttatatgactattttgcagcttgttaagctatggatgatttgatttattctgcggtactggttggattgtgtgatggacacctgtggaggaataatttatgaacaatcagagattttgagcatttttgcttttgtggtagttgtgcctttctttgtttctttctttctttgtttgyttstttctttctttctttctttctttctttttttttttttttttttttttttgagacaaagtctcactgtgtcgccgcccaggctggagtgtagtggcacaatctcggctcactgcaacctccacctcccaggttcaaacaattctactgcctcagcctcctgagtagctgggactacaggcatgcaccaccacacccaactaatttttgtatctttagtagagatgggttttcaccatgttggccaggctggtctcaaaatcctgacctcgtgatctgcccacctcagcctcccagagtgctgggattacaggcatgagccactccgcccggccctgctgtgccattcttgaattcacctttcttttcttcctccttcttcctctttcttgtttttcaaactttcagatcaatatgcttctcaattttaaggatgacaaaagtgaatgtccatgtccagaagaaattcgtgaccaactattggatttccatgaagatttgatgacacattgtggtaaggtctttttgattaaaagcttttattaattgtatgtttttaatccatatatcctgagacgaaattaagtgtatatgcgaatattttcacgaatacacacgatacctgttagaaagttatataaaaacatttattattatggcaaaatggcaaaataactgtccctatgtggggagtcctgagggatagagaaatcagagaggcagttaaactgagcagaagatgaccaaaattctttctctctttttcctctttccattagtggcaggaaatgggaagggggacatgtggccaggtgcctctggcagggaggttaaggttggtttagtcaatgggtacaaagtttcggttatacaagatgaatgaattctggagatccatggcacaacagggtgcttctagttcacaatactgtattgtgcacttaaaattctgttaagagggtagatgtcatgttaagtattcttaaaacaacaacaaacaaacaaaaccccccaaaacaaagaagtgctaagaaacttagaggtgatggatttatgtctgttcctggtggtggtgatggtttcacagatggatgcatgtgtccaagctcatattgcatagataaaatatgtacagttttgtttatagtaacctcaatgaagctgttttttcctcatgtaagaaagaaatttgatcacaaacagttgtatttaaagcagttgagggtgtactttctagaaaatgtagactatatcttttgaaattagtgaatgcctatggaaaccctacattaagttgttatgtcagtaatccaaatctgttaagggaagtctcccctccttttattctaagaactttaaaaatggaattgattaggtattctggacgtgtgtgtgtttttattcctttatgcagtggtgtggataaggtctgatgattcaatgaaagaaaatgaaccagctgtttttaaagttatagataaaaataatgccactggtttaaccggtggttatcttattttaatgaagataataaaaacaccactttgcatattaatttggtttatgaatgaagtaccactaaatgactcccagaaaattatactacatgtgtgtgtacatgtatgtgtgtgtatatatatatatttctacaaatatcccttgtagaaatgtgtatgtatgtgtgtgtatatatatatttttttttttctacaagtatccctgtatttctagtatccctacaaatacagggatactagaattctagtatccctacaaatacagggatactttaaaactttagaattactgcttcagatataaagcattccctggtttagggtacctaattatgcctgttctctctgtttctcaactaaccaaaatactgctaaaatttttggaggcaagagaggagaattaaagtctgtggggcatggtgtaggcagggctggactgtaagtctaggcagacagtatctgaagtccgagatgcccaagggttagcccaaatagcagaattgatctttgcccctaagagagtctttttggtctctactcagtgttatattttgttctgggtgacagccctgagcccacaggaatagaacaaaaagagagaggaagaaaagargctgaccagtgaatgttatttatgagggctggtaagcaasattgcttaacttaatgtyagatgtttttgacattgytctaagttgtgcatgaaagaaattacaaggcctcagaattatttgcccaagtgtattctttaaatatttttttctgcctctctgtttttttatactaggaattgagctggatgaagatgggtctctggatggaaacagtgatttaacaattagagggcgtctgctatccctggtagaaaaggtgacatatctgaagaagaagcaagcagaaaaaccagttgagagtgactccaaaaagtcctgtaagcagtatgagagtgcactggcagaatgacccaactgctgacacttaactcatcctttgaacgaatgttttactggatgagccagtgagataattgagtttgcaacttccaagaatcagactcttaagtagatgcctgtagctcccagaaataaacagcagcatcagtctatgtgtatagcaacagactgagaggtagcagcatgataargatggatggtctccatagagaactagaaatttaggtattttatcagagaccataaagagaaagttaaaaggaagtatagtaatttagccttcatatctaaatatgaggtcgattttcaaatattattgcatcaaattaaacttttttcttaaaatttaaacagatattgtctttatattttggttctgaaatatttcctcaactgttgtatacttctggttgatccatatcctatttcagaataataagcacccttgggctgtgagtgccttgggcacagcactctgagtaggtctgagggatccagcctactttttacttcacttctaagactgtattgattttaagatgcagcaatggtttgttaatagctttccctgaaataaaaaaaaataaacttacgaaaacttttacagcacttttttttgacttacaacagaaaacctttattcatacagttacttytaaatttatttttcagtgtcacaatcacaaatttgagtcaagttttytttaaaatcagagttcagtgtttctttcttttctttttctttttcttttyctttttttttttttttttttttttttttttttgagacagtctcgctccatcacccaggctggagtgcagkggkgcattttcggcttactgcaacctctgcttccctgtctcagcctcctgagtagctggaattacaggcatgcaccaagacgcctgattagtttttatatttttagtagagactgagttttaccatgatggccaggctggtgttgaactcctggtctcaagcaatccatccacctcagattcccaagtgctgggattataggagtgagccactgtgcatggccagagttcaacgtttcttatgaatcactttctattattatcaagtttatgatcttgagtggttaaaatgacartgtggttttcagatataggggaatatattggcattttatttgcattttgtatttggttaaaaatggtagtttttgtttttgcttaaataatttctagatgaaagtaaaacagcctaatttgaaagtcagccagcatattaatactaggattaagtgcctcatcgtgcataaattggtcaccccacttaattttggtaatttcactgtttatttgaaaagatttggacttttctattgcttttacatttactatgtttcatgttacattgcaaagtaattttctgtgtatgtagtaacttttcgctttaatataaattcacaatcaaatccttttgaagacattttaaatgacaaatatggatacaactttaagtgaaaacataattatacgtagtcactagtgcaaatgactcaactgaggagacagttggataarcatacctttttgaatgtccgtgaccraactttataaggataaatgatgtcaggccttctgggaagaaaataatagaacaaaacaaataaaagtagtaggacaccttatattaattgccataccttcaattacatatgaattgccaatggtaattttgaaaaagtgatataactgtagcttatttaattataagaatgatttttaaagaaaggtttgtgttttttatctttgcatgattgtaactgatctgtattgaaatatgtatcatccaatgaaggttattttcttcaaagaatatctagagccttttcaagcctggtacaaatagaaataccaatttgggggtacaggatatggacttgaaatgtccaactgatttgtcttctcttatttttcttttaaaaaatatccataatgactttgcagccactctgcagcagctgatttctgagaccatggtccgatgggctcaggagtctgtcattgaagaccccgagctggtgagggccatgtttgtgttgctccatcggcagtatgacggcattgggggtcttgttcgggccctgccaaagacctacacgataaatggtgtgtccgtggaggacaccatcaacctgctggcatcccttggtcagattcggtccctgctgagtgtgagaatgggcaaagaagaagagaagctcatgattcgtggattagggtaaattatttaactactacaaccctttgtctcgtaaatgttttctaattgttatacctatagagcagtacattaactacattgataaaaatatattgtctggattatacgattattatactaaatagcttttcttttttttatttattattatcatactttaagttttatggtacatgtgcacaatgtgcaggttagttacatatgtatacatgtgccatgctggtgcgctgcacccactaactcgtcatttagcattaggtatatctcctaatgctatccctcccccctcctcccaccccacaacagtccccagagtgtgatgttccccttcctgtgtccatgtgttcacattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttagagatagaaacaaaagctaagttagaaagttgctcagtaatgaaacaagactaattttacagtgtggcacacagccaatatctttcagtgtttttttttaagtctcatagtaatgtacaataatatataaaaacataggacagtaaaaacacattgatccataggtctgtgtggtgtttaatacattaaaaaaataaaaaaacacattgaaatccaaggtgggtagttggaaatatgaacaggaaatgataaggaagcttgtctttatctattgggccttggaaaaagaaggggtagggggaacaaattttctgagaattcagcatcatgagcttgcatttcatgtggatttgggggttaaagttaacaccccatattcaagagtgaggataaaacaaagatatttcagaatatttacttacagtccctcattggaagaccttctaaaatttttatgctaaatgttaatatatacattagggagaagaaaacggaattcagagaaaaagaatgggatgcaacacgtttttttgagtatactactgatttatacatgtataaatctaagcaatcattaataataagcttatatagttcggggwtttgaaaataagatggaaaaattgcctattgagtagtgttcgctactcaggtgatggtacaaccaaagcccaggctgtttttttgtggtacagcaaaagcccaggctccaccacgacacaatatatgcacgcaggaaatctgtatttgcaccccctaaatatttaaaatatttttaaaaataattaaagaaaaaataagatggaatcaaaatcataacaaagataaaaattatattaagctctatgatgttcattaagaacaatacctaaacataaaaatgtagaattctggaagataggatgttaaacagtgattagaagacaaatatttagcagaaaaaaaagctgatgtagttacatagatatcaggcaaaagaggagataataaaggtaactgctacatgaataaaatagaccaaaagaaacaataaaattgatcaaagaaacttagagttaattctttgaaaaaaacgaataaaatggaataccaagtttttctttgacagaactcaaatacaatcctgagggaagaaaacaagtgtataatgatacagactgtttcatatcatttctatacattttaactcagaaaacaatattgcatattgctcatggacctattaagtatttaaaattataaaaatggatgaaaggttctattaaaaattcataattgttgcacactaaaaataaatatactaatgggacagagagggaaagcaaaaaagccaattgagaaaagcaaatattagagtctttataattgtatgagcataggtcttatttgagtactaatatttaaatctaacccgaggaagcctctcataagaggttatcttaattaaccaaatgaaaaagaaagccttccagaaaatggagatcatattctttcttaacacacaacagtaatatgtgccattaaaaagtaaatcattcattagtgataaaactcaaaatgatgttaaaaagcaaaatgcttctttttgtggtattcaaaatatttaacacagagagattcttagtaaatgacagcctgactgctatttaatttacctaaaactaaaagcaaatgagattttaaaatcaagttacttcattcaaagatttgaattaatgagacaataaaaagaaaaagctgccyttgtttaccttagtttgttctggcatgaaataagtcagacccatattagccttgggcatcaagttttttttctgacctatgctatctaaaagccctgttcattaaaaataataaatgcaaaaatcatactatcccactttcttgatatagccagagtaactaaagttttgcatatgactaaatgaataggtgagtaattcagttaaaggaaactaatttgaagagaagtttcaattttctcataggctgtatgttmtattcttgctctagatctaacaagaaaatgttttatagaaaagactcttggcatcgatttgatttatgttaaaatagaaatcaacagagctctttatttgcagtgaatgatactttctcctgaacattatgacccttaggaataccttgacacacatattacaagaatatgtaatgcagtaatgataatacgagacattttaggtatcacctaacaccgtttcttgaaactggatgtccgttttaatgagttagattacttgtacctggacttcatgtatactcagtttctcttggagaatatgaatccttttaagtatttgtcagaatgataatatgaatgcaataagaaataacactattgtaataatatacacaaatactgaatgtaatactaacaacagcatatataaatactagcaacagcatatatatgaaaagcagagatacttatatatgaagaatttttatataaacatggtataacactaattcatatttttatccagaagaaggttggacacatggttggatatccataaaattaggaatgatgtgtccaaagtatatttcattttaactgtttacatttttactatgtttattacaatggaaaagaatagacattcgtcaaccaattttggtaaattatcaatatttttgaggaaaacaattacattcattaatttttgtggcttattaaatactgtgattgcttttacttttcaactcacataaattatttctaaaagatttatgaggaacttggttaactatttagatgttgctctgagctttaccccatacgtccattgtcctttctagggatattatgaataacaaagtgttttaccagcaccctaatctcatgagggcactggggatgcacgagactgtgatggaggtcatggtgaacgtccttggaggtggagagtccaaggtaacgtctttgattcctgagatgctatttagtatcatctcctggagtatatagattgatatagaatgcagattttttttttttttttttttttttttttttttggagacagaggctcactctgtcgcccaggctggagtgcagtgmacgatctcggctcactgcaagctccgcctcccgggttcacgccattctcctgcctcagcctcccgaggagctgggattagaggcgcccgccacctcgcccggctaatttttttgtgtttttagtagagayggggtttcackgtgttagccaggatggtctcsatctcctgacctcgtratccgcccgccttggcctcccctcccgaagtgctgggattacaggcgtgagccaccgcrcccagcccagattgtagattcttaatgagaatttcttaaatcctcttaggatgactgtttttaaagaagactttttgaaaaaaacacacaaaccttagggagttgaacgtactactagtttttttttccttgattttgataaaaatttcctgtcttatactgtgtaatttttggcctcctaaattattctcttttaggggatatttagaaactgaagtatctcatttaggggatatttagaaacttagaaacataaaaattactctatgtgttaatttattttaaaattttgaattataattcagttctcatcacgttaccagtccatggcacaagcatgttcttcagactccaccatcctccatgacacagacattggttggtttcacttaatttccaatccagattgagatttgatgataatactcttggatgtatttgttgtagaattctaaagtgaattctttttttttgagacggagtctcggtctcttgcccaggctggagtgcagtggcgtgatctcagctcactgcaacctccacctcccaggttcactacattctccttcctcagcctgccgagtggctgggactacaggcgcccaccaccattccctgctaatttttttggtatttttagtagaaatggggtttcgccatgttagccaggatggtcttgatctcctgacctcatgatcttcctgccttggcctcccaaagtgctgggattacaggcgtgagccaccacactgggcctaaagtgaacttttaagtgaccacaacttaatggtatcaaaaaccaaattagtagaatagtataataaaaaaaaactttatataatcagtataattytataacctctgatatgaaaatatgttttgatattttaaatcttaggatgtatttttcacaatactgaaataagcccatatttcatatgatcagtctgtttaccagttagacaggcttagaaggatatcataatatactgtacttyattacagaagaactccagagagtatctggggtaaactatgataatatttggtctcaaggaagatgtgtttggtggggtcaaacatgcaggccttccagtccaggaaatcatctcatgaggtgcaaatcagggaggttgtaaatccctggaatcagtaattctactaatattaatactgataagaacatcctattatatgtgccacgtactgaactatatatttttcagaaatcagctcaatgaattcactcccctgccccttacctaaagcaagtattattatccatattattctaacagaatcaaagagattgcatcatttcccatggaagcacagctgatagcggtagtgaggcatcacaaatgaatctgcctttcacctttgagaatgcagtaataagtcaatttctgttctaacccatccatggtaatgaagtttctgaattagtgccaggcttgattttcattgactcagggacgaggcaaatcgtagtctgcacatttgaagatctttggtatctsaagtttggcacacacatggacacacggggattgacgatgtgattgagacctcaacgtatgaactcaattttataaagrtcgtttgctttcrgcagctaatgacatgctttatctgtaggaaatcacctttcccaagatggtggccaactgttgccgttttctctgttacttctgtcgtataagtaggcagaatcaaaaagctatgtttgatcatctcagttatttactggaaaacagcagtgttggtcttggtaagtaaatgacttttatttcatctttaaggttgaaataatataatattacatttaaaaagcaaacgtttkgttaaaaaatgtgcaatggamctgaatagacatttcacaaaagaagacagatagttggccaataggtatatgaaaaaatactcgacatcactcatcatcagcaaagtgcaaattgaaaccacagtgagctatcacctcacacctgttagaatgcctattattgaaaagacaaaacataataagtgttggcgagggtgtggggaaaagggaacccttatacatgttggtgggaatgtaaacacagccattttagaaaacattaaggagattcctcaaaaaattaaaaatagaactaccatatgatctaacagttttacttctgggtatatatatccaagggaaatgaataatcagtatgtcgaagagatamgtgtacttccatggtcattgcagcattattcacaatagctgagatatggaatcaacctaagtgttcatcagtggatgaatggataggaaaaatgtggtacatattcacaatggaatgctgtttggccttaaaaaaagagggaatcctgtcattttcaacaacatggatgaacctggaggatattacattacatgaaataagctacgtgtagaaagacaaawaccacatgatctcactttcatgtggactctaaaatcaaagtcgaactcatagaaacagagagtagaatgaggttaccaggtgtrggggggagtggttggggagatgttcaaggatacaaaatttcagttagatagaaggaataagttcaaaagctctattatacagcatggtgactatagttaataacaatgtataatattcttgaaaatcgctgccagagtagattttgagtgttttcaccacacaaaagtgtatgtgaggtaatatgtatgttaactagctcaattgagtcattccacaaagtatacatatatttcaaaacrtgtacacaatatatacaatttttatttgtcaattcaaaatacgtaaaattaaactttaatgtaaatcaatgtagattaatacactatggatggtgtttagaaattaaattttaagaggtagtatatttttgtatggagtttatagttacagcacgatccaggttatatttcatcttcatttgaattaatagcctccccagctatgagaggttcaacaccactggatgtggctgcagcttcggtgatggataataatgaactagcattagctctgcgtgagccggatctagaaaaggtgagcaatgttcctgccctgtgtgtttgtctgaattatgctttttcacggttttctcaatattttaaatataagtaaggttggtgcagaagtcattgtggttttgcaatgtgacattatggccaaaaccgcaattaattttgcaccaacacaatatgttctagtgctattagaattaaagtacattataatttacattgcacactatataatgttatatattacattgtatataattctactatacattatattgtagttagaagttatgaagaacaatacatttgaaaaaatgaattttctctgatgagaaacatttttctatggaaggagaaccaacgttctgtatctgtattcttatgtgtttttttcttttcgtgatatctgctgccacttttgacttaatcatacacttcagtttttaaaaaggttattttgacatctcatatgtacattttatatcacatatactttattccagcacaaagcatcagcgatatagtaaagccgtgcactctaaggatactaagccacacatgtgtattaccagcatttagagaaactttccctgtattgtagttgcaatagcattccaagtagtcacctgattttttttccttgctcacctggcatctgttcttcccttatcagccaaagtgaccctcttaaaaagatcatgccaatcctccatccagtactccccaaaggctttctatctcactcccagtaaaaatcaaagatgttgcaatagctcctacatcatctgttcctacataccagcctgatttcatctcctacagctttcccgcactctctcttctttgcttcagccacccttgtccccttgctgtagctggaacacgccaactgtgctcagcctcagggcctctgcacctgctagtccaaccatctgcagtatccttacccaagataccatcgtggctctttgtaggcattctttcagtcaatgctccaaagtcaccctcttgatcagctcttccacatccatgctgtgtaaaactgaaaccttttctccacttccttaaactcttcctgtttcctttactgctttattttcaactattggaaatgtaaatatttgtatattmtgtacacaaatatatactttcattttatttatatttatagaaacttatattttaaatatatattaagataatwgtatgtaaaataaatatatttaatcaaactctatgtagttatgtatttttaaaaattcatcccctactataatgtcaagccagggaggtcagagtggtttttcctctgttgttaactgctttgtcctgcctttagagaacagtgtcagcactgggtagacacttagtgcatggctgttgaagacatgaaagagtgaaactcttccccaaatcctcctgacataccagtccaggatcatgaagtcttgcatctctgagacacctcaggacatgtttcccccgtatagtacttaaaatcttttaatctacacactcattaaaatggccaatactaatgcagttgataataccaaatgctgagaaggacaaggagcagctagaactctcttctacttctgttgtgatgagtaatggtacagccagtgtggaaagcagtttggcagttccttaacaaattaaacatacacctaccataaactatatgcctagcctttccactgctaacaatttacccagtagaaaggaaaatatatgtccacacaaagacttgggcatgaatgtttctaacagctttattcgtcatagccaaaaagtgcaaacaacttgaatacygaccatcaatgtattagttgataaataacactgtgatatacccatatacggtgaaatgtcatcccacaataaaaaagaatgaattgctgacatatgctacagtgtgaatgaatcccaaaatcatatgctgagcgaaagaagccaggcacagaaagatatatgctgcatggttatgtgtacaagtgtccyagaaaatgcaagctaaattgtagtgagagaaaaccgattgtctgggactaggtgtgtggggagaaagggactgcaaagggcccagggagctctgaggagtgacggcmatgttctgcgtcttgattatggtgtgttctcacagatgtctacatctctcaaagctcattgaatttatacttcaaagagatgagtttattgcacattggttctcttgcttcactatagttgatataaaacatttttagctatattattatttatatttgaaactgatttaacttaagctggatataactcaatttgcttgataagttgctcctctgtcagtcttacttccattgataatgacttttctaaggatttcttttaaaattgaatttcttgtgaaatattgtagaggactaacattcgtataaaacaaaaatattttaagaggaaaggccaggcaaaaatatgttatgtgctaatttcatcaatactgaaaagtgggtcatcttwtcaaaaatttcctgaacactgaaaccttggctaaaaaagtaaaagtaactgctcaaaataaggtgtttgctaaatgctgtgtgtctgatttgaaccaaggatgtttgactgtgatcttaggtttttctctacgtattttctcacacctgcttccccattaaattgatatatcattttggaaacaatttctctttaaaatatctttgcatctcatatagatcttttaatatcttgagtggattcagtttttacattgcaccagaggtcattagacatgtttgcaatttatgactttgatagataagggtctcaagttaaatgctattaaattcagaaacattcttctttcgtagttttacacataatcctgcagctcttggcccacccagacagacttggttgccctgtctgacaaggaattgcgggtggatttatacagcaggcactgtgggtgattgtgggtagatgaaaacagaaggcaccgcgggctgaggctgctgctttattgtctccaaagtgtttaaggagatggtgcaaataaaacagcaactggttctagtccgtgagtcttgagccctgggcagatatgtttgtggcatttattaaaaagaatgtctgcttagagagagctgaaaaaaaaaaagcttatagtaggatcataaatatttttattatgatgccattttatgacgatatttaaatatttctaaagtctaaggttttactaaagggagttcaagtagattatcatgagagcaaaaagaatttgcaaaaatgcatttgtttaaaagcatcctttaaggatgtcatttattgtatccaatgtaagcatctaatgagttttcagccaagggataactctttgttaatcatgttgtttgcaggtagttcgttatttggctggttgtggactgcaaagttgccagatgctggtgtctaagggctatccagacattgggtggaacccagttgaaggagagagatatcttgactttctyagatttgctgtcttctgtaatggtaggacttgatttcttgaggtcttttgagttatcattaaaactgcatagagatataataaggattcatctcagcactttcatgaaggaagtattagtaaagaaatcacatattttataatcgataggggtttttcacagtaaccacttataatacaatatttgtttacatacttctttccttatttaaattaaaatttttaggcatctaagttctcctaaattttttattttgaattctaataatagtttggattatgacatcattctatartaataacaagttagtgagaatcaatagtttatgcctccataatgctttactctgaaaatttttaatgcaagcaaaatttactgtgtctcatatacttaatgctagcaattmggattacattttggctttattagtatattgttgggttttagttattcttatacataggaaatgattagtataacatttatttgttcagaacttccatataatcatatttgtttacttatcttccccattctactttaggggagagtgtggaggaaaatgcaaatgtcgtggtgagattgctcattcggaggcctgagtgttttggtcctgctttgagaggagaaggtgggaatgggcttcttgcagcaatggaagaagccatcaaaatcgccgaggatccttcccgagatggtccctcaccaaatagcggatccagtaaaacactgtaggtctaatatacacaccctcacgagtgatccatactacttgatgtgaaattttayaaaatatattctgcatcctatgaattgtratataacttgtggtacagaagatttctccctttgaaaatataatgtcttagatttggaagaatgaatggaatttggtgctggaataggtcgaatgaacaaagagagctgaagaagatggtgtagatttagcagagggaaatttaggttgtagaagatgcatcttatgaattttcctaggggagctagggcaaggtgggttgttgtaaatgatacgaagtgaacctttggggttagactggagtttagtgggaaggtagttagaatgagattttatgattagaaagagacctttcgcaaatgaaagggggacttgactaaactgttatggtggtaaaacctagaaaaggtttcattctgaggagtgtgatgctttgttgaggtacagaagacagatacgagaagcagtcactatcttacatttatctgtaggtatacgttgttaatactagagtccagtcatcgacataagtaaatccaggtgtgatgcttatctgtgtaggtgaatgtcctccagcggggtcatgcatccacactgctagtgcctctggtaaagatgtaacatagggctttattgaggcacatttctaaagaaaaaaaagagttagagggcacgcaatcctgcaaaccctttgtcttttacatataaactgggcatagatgttccatgtacaccatagccggatttgcagactgggagcactcctagagcaagaatgagcactccccaccacacacacacacacaccatgctacatgcttatcagtttcccatgaaggaaccagggagctcttaggttctctcagtagtagaaaatgtatccagagacctctggcccaggaccacactagcaagggtacacctgagggcctcacggacasccttgcatgcccaggaatgaggctgtcattcaaagcctcactgtcactctgcagactgctgtattcagtggagacagctgtctgctgagttaccaaggagggaggatgtgagcctctagggccatccagatttggctctcatcagcaagagaacatgtarttatattttccctgcagagatggggagggagatatgttgagatatgttggattctttggcaggggttgcaggaggttgagtagttggtacagaggtaggtgagcaagtgcaataacatttataaagtacttgctctgggcaagcactgtactggatgccttacatgtgaccttgtatgmcatctttgtcaccctttctctacatgtgtgccacttacagaaatagtctaagctcacacgtcctttgatcagttattttctttgttaatgcactcactaccactaggaaggaaaagaagccatcaaataagcagttcctccttttcccctcaaaggaatcttaatactaaaatttccacagatgtgttcttggtgttagaatctcaagtctgatctttaaccagttgttattctcccttaaaaacgtcaagctctacattataacatatatgaaacatatcagaaaaataatgtgttacctagtagtccctttcctcggagagatatgtaataaacatgaaatgtcagttatcccatttgctttctctttcttttgaaacattcatgaaagtgacacagaggaggaggaagatgacactatccacatggggaacgcgatcatgaccttctattcagctttgattgacctcttgggacgctgtgctcctgagatgcatgtgagtttctgggagttcaggagcagcaatcctgatttctctgtgttaagacatctatagctgtcaaagagcataacagcatccaaaaccaataatcttcatgctccattaaaaataatagctgcagtctaatcactgaacaagtgtttgtttagttggaaatgtctcgttggttgtaaaaattagtaatgggatttcagtgcaagtcattaatagagtacttaagttactcatatatctctgaaactcatacagcctcccacattttaagaagaaaagaacatattttctctatgcaatttcctcttatgttacagtgcatccagaaaacaactgctcctaccaaaagtcattttcttttgtgtatttagctctatgtgtttgccatcgttttaggggaaagtgagagggaaggtatagggggtggatattaagagctatttagaccatataaattagtgtctgtcttctttctttctttctttctttctttctttctttctttctttctttctttctttctttctttttctttcttttctctctttttttttttaattgaggcaaggtcttgctctgtctcccaggctagagtgcagtggcatgatctcagctcactgcaatctatgcctcccaggttcaagtgattctcctgcctcagcctcctgcgtagctgggactacaggcacatgccaccacgcccaactaatttttgtatttttagtagagacggggttttgccatgttggccaggctggcctggaactcctaacctcaagtgatccaactgcctcggcctcccaaagtgctgggcttacaggcrtgagccagcgtacccagcctagattagtattttctgaaactttttgacccaaatgaaattaaagtttcgtggaataatacttttactctgtaatacattctgatattttgttctttattttattgtagttgattctgtgttattctattatattcatttaaaaaaaaatcctggcccarggcccaaaacattcatttccagatcttttaatgggaaacaaacccagagtttgagagtttgaaacacattgattggtgctggggtagttaagaactgtaagtatatttctaaagtgggatgagcatgaagccagggctttcttacaaagcacctttttctctacccttattatctatatttcttttggttttggttgggtttttkgtgtggtttaggtttttcatacccagaggttaaaacttccttgatgtactcttttgttgtgaacaaagaggagtcacaggatagagaaatgttagaatgttagaaaactggagtctgatttttataaaaacttaaactttgctgctagtaagattctttcatcttagtaaatggaaacagagactattaaaaatttctgtgctggaggtgattactgacaacaacaacaaaaatacttgctcacaatatttgttatttttcccatctcagaaaaaaacatcagcgaaacaaagagaaagtatactaataaatagaagttttcattctattatattaatgggggaaaactaagtgaaggaataggggaccaaccttggcatttctgaaatttatgcatcttcacaactattatttgaggcctcctgtgtgccagaaattgtgcttgagtttcacgccctrtaatgaggtaaacagatgcccatcccggctcttcagacctagtctgtcctgaagacttgctgagattcttgaccgtatgttcatccacagtcatcctggrtacttcatgtcagtctaaaagaactgttaggatttatgttcgtcatttcctccacattatatatccagccttgggagaaatcagggtcgaagacagatggatatgcaattcatttcttagcacaaagcaagaaagaagctaatttggtcataaatattagtatatgttcagagtctaatgataattttctttgtattattgctcatgttattgataggtatttacatgtaattttggaaagtaaactttcataaacacgtcagattctcartatatcttaacagtccccaaaaggataaaaactattattctaatggatgaaccaactggcctagaccatagtataaataacttggtgtatgctgaaatcactgaaaactgtttgagcaagtaaatattcgcaggtaagccagaaaactatttctgagagaggcataactttatgtatacactgatcagaaaattattttggacttggattccaatacttcagatttcctagacagaattgtaacattgatgtcacaaagttgttctaatgtttttttttcccctgtatagttgattcatgccgggaagggagaagccatcagaattaggtccattttgagatccctcattcccctgggagatttggtgggcgttatcagcatcgcttttcagatgccaacaatagccaaaggtaaggccaacttcaatttgtcctaattcagtaggatgttggatgacatcatgttctaaagaatgttttccrtactcaacatcccaacctctccacttcctaaattatgtgtatactacttaaattagtttttttaaaaaagctgtaaagtatatattttataattttttcctttttttttttgaattagagccttrctctgtagcccaggctggagtgcagtggcacratcttggctcactgcaagctccgcctcccgggttcaagcaattctcctgcctcagcctcccaagtagctgggactacaggcgcccgtcaccacgcccggctaattttttttgtattttaagtagagayggggtttcaccgtgttagccaggatggtctcgatctcctgacctcgtgatcygcctgccttggcctcccaaagtgctgggattacaggtgtgagccaccgcatccagacttttttccattgtttttaaagctcattgtttttaaagctgtgtttgctttgggattttaattttcttttatatgacatttcagacagcttccagagaagcagaaacatgcactgctaccctccattgtcttatgtcctgccttgtgtcattggtcgcaagctcttctgtctttcttgaccttagttccttagttatgcattttgatagttttcattgtcactttcttgtaatgcttttctattaaaagcactgatgatagcttttgacttagagattttaaaatcccctctctgttaaaaagagtgtttgttgtttttttggttttttgttttttttgagatggagtctcactccgtcacccaggctggagtgcagtggcgcgatcttggctcactgcaatctctgcctcacaggttcaagcaatcctcctgcctcagcctcccaagtagcagggactacaggcatgtgtcaccacgttgggctaattttttgcattttttgtagagacagggtttcaccatgttagccaggatggtctcgacctcctgacctcgcgatccgcctgcctcagcctcccaaagtgctgggtttacaggcatgaggcactgctcctagccaaaaagaagtgttcttttcatgagtaaggagaaaatgtttttcaagattaaagaagttattgaagacaactaaaataagtgttaaatcccaaattatactttgtttttactttatcaaatgtaaggtgttttttttcagttttcaatactttattggatatttatacataaatcatttacatgaaagacttctaattgtagaacaaaacataattaggggccaggcgtagtggctcatgcctgtaatcctagcactttgggaggccaaggcaggtggatcacctgaggtcaggagttcgagaccagcctggacaacatggcaaaaccccatctctactaaaaatacaaaagttaaacaagcatggtggtgggcatttgtaatcccagctactcaggaggccgaggcaggagaatcgcttgaacccggggcagtggggaggttgcagtgagccgagattgcaccacttcattccagcctgagtgaaagagcgaaactctgtctcaaacaaacaaacaaaaaacataattaggcaggaagtgcatgctatatatattccttttctttcattaattatgcccctagagaaggcaggctataatagctcaagtctagaatgaaaggggtcaccatatacctgaaggtagctcatcctgtttgccagtcatgattatgagaaagtaaagcttcatgtatgctaaccttacaaacccaaatctacaaggtggcaaaactaccataataattgaacgcccattatagctttaggcaaagctagaaattaaaaatcttccccgcctttggcttccccatttgagacagtttcttytccttgtgcatctgtagctcatcttcctttgctgtctctgtacctctcttctaactcattttcatttgcttaaggaaaatatcttttctttactctatactttgagccacaaaatagacactatcaggacaaagataataatagtaccagtgacatacagattaggaaatagggaagcattaaattttgtaataacataataacaaagaaccaagaacatagattgtaagagagcccaggggtcctttacagaatgggccccaaagtttccaggtacctcctcgtttcctccagtcatctgcctttagcagccttcaagagttttcaagttgctttctttccttttgtagttagttgtgctctaatatgttatttttcttcaaatatatgcagtatattgtctacrtcgggagtcacagtggtttgtgtgtgtgtttgtgaattttgtatcagtcacaatgaaagttaacttttaacaacacaatccattggtatttgttagatctctgcttttttttttttgcttttttttttttgagacggagtctcactctgtcgcccaggctggaatgcagtggcgcagtcttggctcactgcaagctccgcctcccgggttcacgccattctcctgcttcagcctcccgagtagctgggactacaggcgcccgccactatgcccggctaattcttttgtatttttcgtagacacggggtttcaccatgttagccaggatggtctcgatctcctgacctcgtgatcggcacatctcggcctcccaaagtgctgggattacaggtgtgagccaccgtgcccggccaaatctctgcttttttcagccaggtgtggtggtgcacgcctgtagtcccagctactcaggagtctgaggcaggagaatcacttgaacctgggagacggaggttgcagtgagccacggccgtgccactgcactccagcttgggcagcagagcaagactctgtctcaaaaaaaawtttttttttttactgctttccttttgtggagaatgtagacagaaacctgtaggtttttatgtcaccatagctgtgcatttaactttatgtggctgtgcattcactgcagagcttcaaccaccaatatttctttctccttttcaatgacaactcaattggtctataagcatcaccaagtagcagtaataatggttattatacattccatatttagtatgtgaagtttgtctctaaagaatgatattttcccttctcaggattagctagggtcttcctcagacatttttatcatatttatttccaagctagagtatgcctcagaataataatgaaagaaggaggggttcagaaaacttgaggaacragcacataatcttgcagctcttggcccagactgatttggccgccctgtctgaggcagtaattgtgggtggatgaatacagcaggcactgctggtaattgcgggtggatgtatacagcaggcactgcggggtgacactgctgctctgttgtctccagtgtgtttgaggagatggtgcaaataaaacagcaacttgagccaatccgtgagtcttgagttacaggcagatgcatttgtggcattcattagaaacaatgtctgcttggataagagcttaaaaagcaaagcatatagagcaggatcggtgagcttctccctttttccctaggcacagctacggtttaagataatagaacactgtacatttaaattcctttttaatgcgatttttaggagaattgaaattgaattttatatagatttttaattgaaaatcataatatactgatttgacactaaggttaagtcagctttggctggattttaaatccagttttagttggtttaaatacaactctgtcagttactaggtatgtgaccttggactagttacttctctaaaggctagttttcgtcattcattgaataagagtcatgatagcagcctcacagttgggttgtgggaattgtgtaagatcgtgtcagtaacattcctagtgcagtacccgacaacagcacaacacatcagaactattattcttataatgtaaggaaaggaatgtattagttatattgggtgttataattataaggaacgaatactaccaggcattatcctttcatctagtttcctttagaacattatttgtttgttttcatgattcacatataaaattttttcattgactatacgtggaaacagaaaagttgtcattttattcatcagtttattcaggatgattgtggtcatgtgtcttctttctctgagttcttrtttctttgatgttgtatccatatgaaaatttctgtgatagtatttgtagaagagtacagtgtgtggtcagcaccagtttggcgtaattatcatgtggtcaaacaggaagtaaataaattcttcagtatttgaaattggcacataatcccatgatttctcatatcagcggtccccaattagggaacctacggagtgactataaggaattcactaatctctataggcataaagctttaagtgttgatagagaaagcaatatgacccttaaatgcacgttaaatgctattatgattaatgaaacatatttcatatgaaagccatactggttttatagtgtcatttcatcatttcgttattgttctaagacgtgaaaatgtaaatataccaagattatcacataaaggtagatgagctttattcatgtttaaaacaggctcacttagaaaagagtgaacatccccacttcacattttcacttttcatggatttcacttggagttttagaaagtagattttggatgcctgtttgtttctcctaagtatctaacaatgccatgtcttgtatcctgtatgcagttaacaagtggatgcctatataacagttaaatgaccttggctttacattcactgccttatttcctcagcaaactcccataatagcttgagggtagtcgaagaacagaaagccatttcattgaaaactgtgtttaaaatgtaagaagtctagaaagcagccatttgtaatctatcctgtatatgacacagccattgacaccaaaattcacttctctcttttagatgggaatgtggtggaacctgacatgtctgcggggttttgcccagatcacaaggcagccatggttttattccttgacagggtctatgggattgaggttcaagacttcctcctccatcttcttgaggttggctttctgccagatctccgggcggctgcttctttagatacggtgagattggagcgatggacttcctcctctcttgactcttcactctgtgccttatgatgttcttttttatatatccattcattaatttattgacaatgaatgtttattgagtacctgttatattttcaggtaagccatgggtaaacagaaaataaactaggctatgttctcaaggaattcactgaataaactgacaacctcaagaaacttcccactgaccaaaaagaatatgataagaattctgataaggtgctatatgggattcaataagaggttcacataactctaatttgggaggtcacagtgactcctgttaacctctgttcagtatcaacttccaaattggcctaaacaattatgcttctcaataaaagcaatgaaagaattaagatgatttaatggatattgttgagtcagtatcatcttggtatcttcgtttgttaaggtacaaatggattgaaggctgttctgtatattgggtggcccacatggagaatctgccattatcagcttaaatgttcttttctttgaaacactgtggaataagctgaagttctaaatgttattgtagtagttatgctactrtacatatttaatacctactttcatgtactcattaattttatcaattaaatgtgcttttttgatttcaargcacattaggacttgagccgacagtagccccttcatgaaatatatgagagcagaatcacaaaaatgaaatgaaaatttcttttttctttgttttgtgtattcacctgamgttgtggacctggatagtatggrcgataacatagtagtaatacagttatcctttggttattggtgctgatagacatgagaagaataaatatgaataataaagagaattcagaaagaatttacgcatatgagatctattgtgagaataagctcctctctttgcctagcaaaggaaaatactcacatctgtgatattattgtcttcttacattgatcctaccattgatatttaatgatagagtctgaacctgttaagctttttgaggagataggtgtcatttcattcatttttatctatttatgaacaatggatagttgattgtttttagtggtaaaaatcatatgaacccgacayttaaagatgtaactaaagaatacatttccatgtgtcatagtgctatcatcttccggatagtgaaattgtatgtccccatgttaatccctttgaagrttatctactgccaaacacaaatggccttctactctctgattctttttcaggcagctttgagtgctacagacatggccttggccctcaatcggtacctttgcacagccgtcttgccattgttaacaagatgtgctcctctctttgctggcacagagcaccacgcttctctcattgactcattacttcatactgtgtatagactttctaagggctgttcacttaccaaagctcagcgggattccatagaagtttgtttactctctatttgtgggtgagtggataacaaattctattccggcttcttctttaaaaaacagaatttacaatgtggcctttgacaaattatttagaattttggaaacattttccataccacaaatttaattcattttaggtagtcccatatactgaggtatgagtcttctctgatcgcccttgctcccagtcaagttccagagtgttcctccaagcctccctagggtatccagctgttggatatagcttttgaccagttacagaatactattctggatgttgggagtggggagtaattgtgttgggagtccttggccactttaggtgagatgaatagatctccccttttgactgtgtttgatgatttaactcatcttctagaagagaaaagaaaaaagggacttcttaaatataaaatgtgatacagcataatattaaaccatatttatgtgtggcaacgatgaaggctgaatatttcctccaacctggaaaaccatttcctataagtagaagtgctagaatgtcttacaatgaaaaccagaaacgtatctccccctgatgaagttttgcctgtgaaagtgataatttctcaagcccctagaaagatcgtggctcatttgtaactgctcagggactcttgcaggtgcagccagcagcctggcagtccctgggggaagggcaagttttcacccatgggggagtgtctgggttgagaaccagatggcactgagggaagtggaaaatcagaagagtaattctttaacttccctaatctaagattctgtaaaattgaaccaaaatgcctatctcacagatattttctaagtattacatgaggtaaaacacttgctgttgcctgacacagtagawgttcactgtgtacattttctctcccttccttctctggcaaatttgctgtctcagcctttttttcctcctttctgttccaatattccctcttctttttcttcttaccatccattggaatgagggaagagacatttactaaagttaatggaggaaagtcttaggaaacagtggagtctgcatttgtgagtggttaggaaagaaaggaggagaacagaaacatcttctgtatcaaagaaggggtggtcttcagatctaggggatagagataagttgggaaatctaaccttatataaaataaagtaactaagtggttaatctttggacaaagaacatctaatgaataccatctgaagtgaggtatagattcaggtccttggctgatataatttattctaatgaatgatctacttagtttagaaacatttcttggcattatgaacattagctttgttccaacagacaactgagaccttctatgatgcagcacttactcagaagattagtatttgatgttccattattaaatgaacaygcaaagatgcctcttaaagtaagtataggaaatgtttgtagatatttgattactggcttctctgactttattttctatgacaacatatacatttcttagatacatcatgcttgamgctgggaaatttctcccaattattgaaatgggcatagaagttataggaatgtatacatcaacttgaaataaacaacttctataagattatagaaatcttaacattgatttccatggaaacaatggaaatagaaatcaattgaaaaaaaaggaccacaggccgggcgyggtggctcacgcctgtaatcccagcactttgggaggccaaggtgggcggatcacgaggttaggagatcgagaccatcctagctaacacggtgaaaccccgtctctataaaaaatacaaaaaattagccggacgtggtggtgggtgcctgtaggcccagttacgtggaaggctgaggcaggagaatggcgtgaacccgggaggtggagcttgcagtgagccgagatcgcgccactgactccagcctgggtgacrgagcgagactccgtcaaaaaaagaaaaaaaggaccacagggaaaagataagccaagatactcttaagttggaaaacatggtaataggcctggcctaaaatattattagaaacctcgagagataaagacgaggctttaaagacaacattttctaagttaataatcacatgacaggttccaattgtcacttcatagggttcaaagataacctctctgtatatgcaattayagtttgtcacacagcatagaaaaatcactggtattttctctaactttattattctgttcaggatcaagtctcactctatcttactgagttgggaatgttttcttgtcctttaatatcataatctagactcagaatatagaatatagtgtttgcatcaaagttatatagtaatgtgatggatttttatagatgaccactctgcaatgccatctagtagcattattttttccccaatggctacccagtactagtgctgaagaagtatgagatataaagagtctatatggagctgttacagtaagcatccctggatatttagcaaaagtaatctttctctatgaaaattgactttggtttaataaatctggatacattagtgaattaggtaaaataaattatatccttgataaaaattctatttttatgtttttttgtcatcttcaatagtccttgtcttgcaaaattttttgatacaaatgagctggaaaattcgtgaaaaaagatacagtctcatgctgttacccttatgcaataaaactcttttacattagagatatgtcagtgttaagccaagcaaattagaactcaatatttcatcatttgtgactcctaaattgtgtggatgtatgtatgtgtccattttttttaactgaaagggaaagtaaatgagttgtaatattttaacagtaagacatgcagtccactttaataacagtaattcttataatttaytttcttcgttagatataggaaagggtcaaaatatgtatagtcataagatcattttattaatttgacaaatatagatcaagaataaattatccaaagaactaccaaataattgaaagattctgtgcttgtccttgaccttccagtttagttctaaacaagcaatatgcataggtgaaaatgtaaggagcaacgtagacaatcagtaaagtaataaattgcatccataaccaccaaagaaatgtagacaaataagtgatcagagtagagcaattttggaacttcacttggagaagtaagttttgtggcaagccatagagaggcagagagggagcaaaaagaatcacagatgtatagttcctttattgtgcttctgggtcatcctgacatcagtcccttcattttacacacagattccaagatattaataacaattcattaaattattagtaaatgattaacgtagaactcagggatacatagacatccaaacaacctcataaagaatcctgttcaagatatagttacttgtaaaattgggcgtctggtcttcatattgcaatcagtgttaaatttgaaagagacatagtgtcttagccggggttctctagagggacagaactaataggatagatgtatatatgaaggggagtttattaaggagtattgactcacacgatcaccgggtgaagtcccacaataggccgtctgcaagctgaggggcaaggaagccagttcaagtcccaaaacctcaaaagtagggaagccaacagtgcagccttcagtctgtggccgaaggcccgtgagcccctggcaaagcactagtgtaaatccaagagtccagaagctgaaggacttggagtctgatgtttgagggcaggaagmacccagcacgggacaaagataaaggccagaagataaaggcaagtcaggttcttctgcctgcytttatcctagccgtgctggcagctgattagatggtgcccacccagattgagaatgggtcagcctctcccagtccactgactcaaatgttaatctcctttggcaaccccctcacagacacacccaggaacaatactttgcatccttaaattcaatcaagttgaccctcaatattaaccatcacgtgtagtatacacggtgatagtattctccaagataatttatatgggattgggcaatttcacttcagatgaccttataatgtagcattagagtgtgatatgaggagaaatgaaaaaaaaatataaaaggttttgatagctcattgcttttataattgttttcccacatagctgctgacaaatcattatgaaagatgctggaaatattactgcctgcctggagggtggggaaactttggtgctgcctcagaagaagaacttcatttatcaagaaagttgttctggggcatttttgatgccctgtctcaaaaggtaatttaatggtttgtgggtttgtttgtatcaataaaatggtatagagccacacattcttagtaagatrgtattcctagttgaatactatctttgctaaccaagacacgtatggcttgattttttctcttttctcaacttcataacaaatgttgaaaatgcaacttatatttacttaatcattgtggtagcattttccttgtgatcataacactgtttctgaatataaaatggctaagcagttcaggaaattatgcacaaggttgataagtttccggtgcatttggactcaaactctccctagtcccatctccaatcttataaaggccaaagaaattatatccaatataaaaatacaaaacatgaaatcttatgtaattgtaatatcccagtgccctgctaaagtctccagctttgctgctatggagatttagataccgtcgctcaatgttgcattgcatatgtggcattgccttatagttgcaaaatttataatgaatagttcatatgttttcagatgactgacaggtgttgatcttagagaaaaggcagaacaacaagttttgtgtgttcatccttaaattaatcaaaattagtttcaattcccagattgacattattagatgattggagtagtataaccactaatttgctacataatagaagaaaatttgtctgcaattacatttggtagcaacactttaatgctttttcttaccgaatttcctttggtaaactgagtccttttaaaataatgtgtaagtattttttagaatcatttacaacatttatttaacattgaacatttaaagtgaaataaattattactattatttttcagaaaatctataaatataaatttaactgtcattaatatataaatagctcttcctataaatttttagcatgcatactttctatagaatttcttttccagctcagaattttatttttcaaagctttataatgcaacatggatcagttaaaatttctcattctctagaatgttatgctttatgtttttttatatgtagtcattataatgtacaggaattatctataactaactataaggaatgtagtccctattgactgaaattatgtttatctcttaacaatattttacacattgacaatattaaagtttacttcatttccagtgtgttggagagtcaaagattttattctccttaagctgaaacttcagtaaatctagctgcagcttcttttctgtttgatggggttttaggccctgtgtttcattttctggaaaaagaatgatcagagagttcagttagtccagggtaattcagattttcttctgcaaccttctgtcagccctgatgatcatgctgacaacttttgccatatagtaatttttttttttggtcctccatttttcccagaaatatgaacaagaacttttcaaactggcactgccttgcctgagtgcagttgcgggagctttgcctccagactacatggagtcaaattatgtcagtatgatggaaaaacagtcatcaatggattctgaagggaactttaacccacaacctgttgatacctcaaagtatggactctttctattgcagcagatttttattgtaaatgatgtgtgaagtctgaaattgaataaggtactaaagtgaactttctctaatacatgccccctttgaattggtatccttttaataggggtccctttaatttataaaaygatagtaataataataatgattatactaatatcagaaatagataagatgtaccttctaggatactcttaacacaatcaagactctgtacatggaatatctataatagaattaagaaagtatgtcagttatatttttagttgaaaaattaccctaaatgtttattaataackacaatcaacctctatataacatcttttacttaggatgtacccagcatgcacygcaaagctgtttctgcgagtagcaagggaatcccttcacccatcactacatctcagcaaggcccagggttaacagctgatgttcagcatgataaaacgcagcacaagatggaagggaatatcaaatgagaatttttatggaaaattccaattgttctacaaataggatgtttgggaacttcaggtgttcgacgtctgagcattttgttgttgtcgttactgtttttaagtaggaccatggttctccatgtgcaaggaaagctgcctcttcatgccaccttatcttactgattctatggtgactcagcaagatcagttttagcaaggtagacacttggtagttattatccacggcttctgaatttgcttgggagttcaactttgaggcttctgagtggcccccagctgatttagcttccataaccagatcagaatttcaacctgagtggtatgccattagtttgataatgccttaaatttgcatgtttggtctttgatgacagtcctgtgagaaaagaccctttcccccatcccccagtatttggcttatatgattgatcttttgtatctcttccgaagtaagtaaaccaaactatcacatattcacattcctacmtgggtaagtttgtggtttgctaacatatgatctcatctgagatttttaaatatcagaacaatatcatggttttggtgttggttgattaaatccaattaattaataagtgtgggcatggatattaatttacctaggcttgcccctttggggacttcttaacagatacaggtttatgtggtgatatcartgatttctagacgattacgattttttatatattgcttcttaagtatgtgtatgtcttatagttcaattactgttaactgctggaaaacaacagcaaaccatcttatactagattttatgtagaattgtattctcaaagttaatactttaataagatatatttattaatgaatagaattatgtatgtatgtatatatatttaattttccattcatagatacgttttaagccttagatttatcatcagacttggtcatcatttgcatgtcctcaacatcaaggaattaaatattcatttaaacacaaaaggagtcaagattaaatattatcaaaaagcaggagttaattattttccctatagttaataccagtaacatttacagtgttatttgtggaccatgtatatttaaaaattttaacacatcactactaaatttagtgcttgttttttcttttttgtgtaatctattgtcctaatctttgaatgtattttaattatttcaatttatatatttaataataattgttattatagttttataatatgtaatttgttatgttagcacataaaatatgaatcaatataagatgagcagatagaacattatctgcttgacttttcttatattgttgtgaaaatagaaaaatgtaatwctaaaaaaagaagtcgtgtttaacagttaaaattgaatgagatataagcattcataagctgtgagtaaattattaatatgatttcctgtaaattctgtgaaaatcaagctcttttgtctttacttttctcatagtattacaattcctgagaaattggaatacttcattaacaaatatgcagaacactcccatgacaaatggtcaatggacaaggtaaaaagagtattacattctaattcagtagtcattattaatgactggtcactgttcaaatatttctgaccatgacagttttctgttttaaaatgagaacttgatctaaattaggaaaaaatacttaattacaattagcttatataataatataatatttagctagctctatcattaacacaaatatgatacccttatgaataagcactattttaagctttcaaaagatctattcattaaattataaatatagtttctataacatatattgtttatcagagtaaaaaagcaacaatcaccaagagcttcaggaggaaatgatgactccgggttcagaattcaccttttaaggaaactttggttttatatgtaggtttttttggtttattttttgagtcctgctctgctgcccaggctggagtgcagtggtgtgatcatacctcactgcagcctggaactaccgggctcgagcaatcctcctgcctcaaccgcctgagtagttgggactacaggtgcacaccaccataccttgctaattgttaatattttttatagagatgmgatcttgctatgttgcccaggctggtctccaactgttgttggcctcaagcagttgttcagccagcctcagcctcccaaactgctgagattacaggcatgagccaccatgcctggccaggttttatatgtagttctatatcagataaaatcttgaaaattcttaatcaggatttaacaattatttaccttttctattcttctgttgtatttcttactaccaactagatctgcagtttactaaaaatagattacatcggccaggtgatttttttgtgtgttttcaagaaaaacaacagaaatgagaaaactaaagtagctgcatctatgagataatttctacatattataagttttctaaaggaaatcttatgcctacaggttcatgtttaagttgagcttagtctaaacttgacagaggataaagtaggttcatcagaggagttgagttgagatagttcaagaactaaaatacttctatattggtttggcgaaatgaaaatcagacaccaaaggttgcttccagaggatgtgtatgctacgtaacaaataaagatcatcatgctggagatgtcatgttgagtttcaaactctgccctggccagccagtctttcggtccctctaagaaacccttttttgttggttttgataagtatctggttcttcattcagtaattgatttactaggtaagtcagtaaggatctatcttatataaaaactctgctaaatactgagtgggtggagttggtgatggagaggaatattacaggaaggttttccagtctaattactcagattctgtaggcagacaagaaattatatagggaaatggtgatatgtacagatgggcaaaataatatggaatgaatgtgttgagagaaaatttgatgaaagaatgggtaaaacaggtggcattattcagagaagacgctgagatgcatactctagttttcctatttaaaatgcatgttttgtatttacacttcataggtggggtcccaagatgggtcagaataaatatccttgggaccatgcatccctctagcctcctcctgtgggaatgcttattggcacaattataagaccttggtctgtttaaggaagatcaagtgcttctaatctctagataaaagacttgttccagatgattactgaaaatacatcatgcaatatgtccatgtaacaaaactgcacatttactccctgaatctgaaatttaaaataaaagaaaatagcattgaatatctttatagtgacttatgctggataaaatttcaatcttaacccttaccttagttcattttaggtttattttatcaaacacgcacttaaacacctgcatatctacaatctctaaaattaacacgtgtaaaacaatttttaatgtttgcctttttttaagttggcaaatggatggatttatggagaaatatattcagactcttctaaggttcagccattaatgaagccatataagctattgtctgaaaaggtaaggattttttgtttgttttagtttgtaaagtttttattcttttgaaaaatgtgttttttggttatattttttatattaaaatgtcttctttattttaartttcacattttttcttccaaaggtcccgtttaaaaaaaaaaccttcttatattttgtcttttcctctcaattcttaatttctgtcagcctttctgtgtttattctcttctctccttaacatttttcttttcctttttggtttttattcctctcccatatttttaagtactttaaaaaatcttcttatcatgcttaagagtttcttgatgagtgatgacaaagtaataatgtgcttattatgtatagattttcatatattttacttctttgggaaaraaatgagtatcttgacaaatgaagtgaaaaggatttcacttcattgtgagtcacatgtatattacataagctgtcccttttttctgtgtaaggtcctaggaaccgggttgctaaaggaaattgaccttggtgctatataatgaacaaagcgaggatccctcttactaacattagtaaaactagatctctgctcacactctgcttttyagaattttactttcctttttatatttttaaataagctatgctcatcaaatttttaaaaagtgaaggcagtctattttagagcaaagcgttacttaacatttttatttacattcataatatatctgttgtttcttgttttttcttctctaggaaaaagaaatttatcgctggccaatcaaagaatctttaaaaactatgctggcttggggctggagaattgaaagaactcgggagggagacagcatggccctttacaaccggactcgtcgtatttctcagacaagccaggtaagaattcatcacggtgatgaatcaactgtttatgttatggattaaataattttttaaatttaattattgagtttttctaaaraataatctgaaaattctgaagagtcacaaaatttagaagggagagaaaaaagctatatatatattttttttagtttcaaaggaggttaaatgatgattaagttactggactttatgtacaagccttccttttcctggctagyatagaagaagtaaccagttgtaggacatggatgaagctggaaaccatcattctcagcaaactaacacaggaacagaaaaccaaacaccgcatgttctcactcataagtggaagctgaacaatgaaaacacatggacagaggaaggggaacatcacacaccggggcctgtcagggagtggggggctaggggagggatagcattaagagaaatacctaatgtagatgacgggttgatgggtgcagcaaaccattgtggcacgtgtatacctatgtaacaaayctgcacgttctgcacatgtaccccagaacttaaagtataataaaaaatttaaaagaagaagaagaagtaaccagttgtaaggtcctgaagttttcctaatgaaaacagtacatcatgttcgtttgctacagctagtttgtctatagggctttcttctcatttccagtgggatctgagggttgattcttasgaaagagtagggtgttcagacagtcatgatccagatttagaaggcacaagggcgctcctgtctgcagagggaaggtatacagccacacaggcagagcaagaattcacagaagatgttgctgctggaccatgtcaagggagttygacaaacaagcaaggctctacccataggtcttcggtgctcaaggtggcaagagtaaggcacagccttgatgtggaaaagctagagttcagggaggacaccaaataccacccgttaacatttagtcacgaggtcatgtgagctgcttacctttgaccccctcatttctcctgggagctaaatctgtcattattcttttcctgacccctcagctcactatgtatgtggtttacaccaaatattgtttattattgctatttacacaaatatcatttttgaaaaaaaaatgagggtctaacagcatgtgcttcacatgctccatatttgaaatatacttttaaataaatttgaccttggtcaaattttaattttaaataaattgagttctgatttgggcatactttacattcaattgtctttgggatgtatcatatatggatggaagctataaaagtgtattttatctatttttttgtctgtgtacttttctaagtagattagcttttattttaatctgtttcaacaaatgctgagcacaaactgcgtactagataataagaatacaaagatagcaagacaattctaatsctaaaagtcataaaatagtgttagataaggtcaagttaaatctactacaacatggtatggtaagggtgggactagtggtatgaataaggcactacacagtatagagaaagggatgttttttttttaattattctgtcaggtagataagaaataagaaattactacaaatggaggtgactttaggcttcatgaaaaataaggtagattctcccactgcccttaataacaaaaattatgtactctaatttaaaatcatgtatattttatatcactcctctttctctttctcctttttgttctaatagtaagcccttaatagaccctattaacccgtgaaaccatctctcatgtcttagtgattttcacggtgacatgtgatttttgaaattcattcttaaatttcatatgcgatttcaaaatattaggcgatgcttgtgccagaggcacagtttatgagataagaggaagggctatggaatttcaccacttgggcttaaatcctggtagtgctactttctaaagatgtacctttgtgtacttgatctctgtttgcctcattaartgtgaattcttattgttactattgttatgtcaatatttctgtggagggcatttrttgagagcatctcattagyggtaaatgaaagagtatatttgygtttgtagcactttggcctgtaggtgggaaagaaagaatatttctataagcctcagaaatggggagcaatatacaccaaaggccacaagtctatttataacttgccattattttcacccaaaggttctttaagcataaaccaatattatttgaaatattaacatagattgtcgtttctccrttacttgccttatagcattttcttttttgactgtcatcttgttaaacctcttcgtctttttttatgttactgatttcctatgtgattataaagcaattttctatcatgtataaactcttctgactaaaggaacactttttatagcatcattttataaaaggaatacaaatggatgagtgaagatcatgtgtagatgtgattctgagcctgaattcctcagctttttttcactggggcttagcactccctcagggacacacaagtggcccatggttaacggcagtatctggcacagccaagcctggggtgacattctggtctcacccatgagtacctagctggtatcgtgagcttgggtaaactggttaacctctgtatgctgcagttttctcatttttaaaatgaagctggtatgagcatcggctttgaaagaatgttgtgagtgttctggttatgatgcttgtcaatcacttaaaagaataactggcatatatttcaatataggtgagccataatttttgtcgttatcatcgttatgtggatcaataacctgatgaatgtcctttgtttaccatgaataccacaggaagacatgaatcctgatttcaggaaatttactgtccacttagggttttataatttgcatatgtaagacaaacttaaggacatgaataataccagtatcaacttgacagaatatacaatagagtatataagggctgatcaaagttacaagaagctgattggagaggggttaactgggtgggttttgaccccctccttggtagggatactaaagaaaacagcaaaaaacatttctgacaatttcaggcatatcccacaggttttcaacaattatttactcccaaattccaatttcttaccttgtatctgtttttcagtactacacatgtaggacaaaaactatttaaaacaaatgaaaaataagcttataacccggaaggggaatggagattagaatgaaactttyggaatgtgtttcttatctagaactaaaatacaagataggatagaggaatggtgcattcattccttcaacagatacttattgagcacctattatgtatgctgcattgttctaagcttttcaaatagatcagtgatgaaatggaaaaaaatctctgctgtcaaggagcttacattctaatgggggaaataaacaacatacttgaaactgggcaaatttcaaaagaaagaggttcaatggactcacagttccacgtggctgcggaggcctcacactcatggtggaaggtaacaggcacatctcacatggtggtagacgagaagaatgaggaaccaagtgagaggggtttccccttatgaaaccaccagatcttgtgagacttattcactaccacaagaacagtatggaggaaaatgcccctatgattcagttatctcccactgggtacccccgacaatatgagggaattatgggagctacaattcaagaggagatttgggtggggacatagacataataatggatgaaggggagtaacccgagatggttgccatggattctagcttgtgtccccaaatcaatagctgtgttaggtgaggtaaagaccataggagtgctggggacagcaaggagagaataatgactttgattttatatgttgtggtgggcaaaattatgactcccaaatatgttcacccactcctcactacaactgtatgggaactatggtgttgatagcagttatggtggtagtagtgataatgatagtatactaacaatgagaatagccatttactaaaattcctgatccatttctttgtgtcaggcactttgctaaggattttacatccattacctagtttcataccaacctttgaggctggtggcctatttagcatattaaaagaaaaactccaggccgggcatggtggctcacgcctgtaatcccagcactttgggaggccgaggcgggtggatcacaaggtcaggagtttgagaccatcctgcccaatatggtgaaaccccgtctctactaaaaatatgaaaattagctggtgacagagatgcgtgcctgtaatcccagctactcgggaggctgaggcaggagaatcgcttgaacctgggaggcagaggttgcagcgagtcaagatcgtgccactgcactccagcctggtgacagagcgagactctgtctcaaaaaaaaaaaaaaaaaaaaaaggaaaacttcagacaaattaaatttaacagagtttaattgaacaaagaaccagtggcagtccctgaaaccaggacaggttcagtgagagtttggggctgccctgcggctggataatgtttatagataaaacgggatgctcaaaaaacagcagtgaggtacagagaaagctggattcattccaccatggtgtttgccttctttgaacaaggtttgaacagtgtcctcatggtgaaaggcacagaagccagggtgctgtcaaaactgacccgtaagttaagtatcgctcatgagcctgttattagttatagcatatgtaacactcacttttatttcacaagcatgataatgagctatattttcattttgtttttagtttgctttttgggcatttttaatgagagaatatacataattatggaaaatatcaagatatagttttagatttataagcaggaaccagagctcatttctgtggtacactttcacataacatgccattgggtggaaggaggtaagtgcccaggatggttagtgaaacttccttaaaattgataaagaggtatatttcattttttaaaagctttaattcagaaattaaagaagtctcttcctcgaggatttccaagtgcattgctgaatactatatgatatactatgataatttaaaagttggttatactttatcctaacatttgacccatcaagacatttgtaaatattgacgtctttgattaactcttgcttgcgtgaggaagagtaaatttcattgcagccaatttggatttgtaagaaactcaaaaatgtaatgatcctctgcataagataatgtttcagaattttggattcattgcacaatacatcaaattccgataggcaattttcagaattatcaatcataaatcattttcagacacccaaatataattttaatgtgcgagatgtgtttacaacatcattttgtataraaacttgccagttttatctaaggaaacactatgtttggaaatttgtgccatatttttaaagtataagttaagtctctcttcacaaggtttttaatgaggcactgttttttcacacaaatgatctaggtttctgtggacgctgcccatggttacagtccccgggccattgacatgagcaatgttacactatctagagacctgcatgtaagtactattaacttttaaaaatagtctccaaatttaatttttaagaagcataatgtaatgctttcctgcatatatttggcagcatggtttatttgaatgtggcgatctataatggatccatggaatttatagattatatactctaattttttaatgctatcaaaattgatagctgggtgtggtggcacgtgcctatagtcccagctacttgggaagctgaggcaggagaatcgcttggacctgggaggcagaggttgcagtgagctgagatcacaccactgcactccagcctgagtgacagagtgagactccctctcaaagaaaaaaaaaaaagttgatacaactttttctagggtgtttcagccgtataacatattttcctttaatagccatttaaaaatctctatgttaaatagttgtgtgtgagaagaaagtaaatagttaataatgctctgtgcaagggccaccttcttttaagtttttccagagacattgattgcatttgcttgctccattcatagtctcatctgttcttttttgtcaccaaggaacctactttgaaatagcagatttgaaagtaagataaaatttattgccttgagacataaagttaataggtcaatatggtgttcaaataacatattagcattgttggtaactgtattgttccaagagaaataaggaccgtaaatataaaatttacatattgttaaattgtttggtttgccatttgttattgctcccatatgaacgtattaaaatgacacagtaaacttgaaaatcaaatgtagaaagaatccgggaggtaatcttatcaaaacccaaaaggtcacagaaagattaacttggctagtctaaggtctctcacctagtttggacagagattgatttagaaatcaaatctttgactgtccatctaacattctccatattcaagttgcataaggtttaggtcatttttaaggctttggaaattaaaacaagaacttgtaaatacaaatagtttttctgaagtccatagctattttggtttcattattgaattaatgtcttcaaacattatgaataacaatgaccattttcatttgctgtttagttactgtataatattgcaaatccttacaattctctgggattcacattctaaagaagagtgtttgatatcttttaaatgtatcatagcactaatactgtatgagttattcctttamggtatctaatattatatattagaaagcaatattatccttttttacttattgaaacgataaatatttttgttcatttaaggctatggcagaaatgatggctgaaaactaccataatatatgggcaaagaaaaagaaaatggagttggagtccaaaggtaatattttctaaaaacgtttattaaaaaataatctgagctcaattccatgagtgtatggatgaagtcgtcttcagcacaacagcttattataactttttaaaatcagaacggtttaattgtgcctgtaacagattgaagttggaaatgctgtaatttcctagtggctagtatatattttcttgtgtctcagaattttgacagctttcttttacccattttagcttacagacttctgtacttctcatcctgatatctgagttgttctatgaatgacttagacttccctccctgactctcttccccaacttaaatatctcctatctcacccctttttatttcctatctcagcctcttttgtctggtccagctatgttactgtctcttacatgcttttgcttgcacttttcccgtttttttattcaaatactaaatgaactaatgttctcttagttatttctcaagtcttttaaaatttatttgcatattttcttcagtttaacgtatgctatgctgatgatatctttcaacattatttatttgccgttagtctatacacatattgtttataatgtggtgtctgtgtgtgtgcgcgcatatgcgctgtcgttaatgacttcctatatggttttctttcccctgataggaatatactattttcgagctcagggccacaacatttatttcttttgtaatccttattgtatagttacaggtgccaataaagcttctactttttatttatttgactaggtgaaaatgtagaaggggagaagattttgaaagtggggatatttcatggtgaaaggtaaagctgtgatatggaaggatggtacctggcaccaagcactaggaaacagagtaacacaaattaggattggtcacagagaggaaaagagaagattccacattttattttttattttttttattttttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacrtcttgcaccgyccttaatccatttaaccctgagtggacacaryacatgtttcagagagcacagggttgggggtaaggtcacagatcaacaggatcccaaggcagaagaatttttcttagtacagaacaaaatgaaaagtctcccatgtatacttctttctacacagacacggcaaccatctgatttctcaatcttttccccacctttcccccctctctattccacaaaaccgccattgtcatcatggcccgttctcaatgagctgttgggtacacctcccagacggggtggtggcctggcagaggggctcctcacttcccagtaggggcggccgggcagaggcgcccctcacctcccggacggggcggctggccgggcggggggctgaccccccccacctccctcccgcacggggcggctgccgggcggaggggctcctcacttctcagacggggcagttgccaggcagagggtctcctcacttctcagacggggcggccgggcagagacgctcctcacatcccagacggggcggcagggcagaggcggtccccacatctcagaggatgggcggccgggcagagacgctcctcacttcctagatgtgatggcggctgggaagaggcgctcctcacttcctagatgggatggcggccgggcagagacgctcctcactttccagactgggcagccaggcagaggggctcctcacatcccagatgatgggcggccaggcagagacgctcctcacttcccagacggggtggcggccgggcagaggctgcaatctcggcattttgggaggccaaggcaggcggctgggaggtggaggttgtagcgagccgagatcacgccactgcactccagcctgggcaccattgagcactgagtgaacgagactccgtctgcaatcctggcacctccagaggccgaggctggcggatcacttgcggttaggggctggagaccggcctggccaacacagcgaaaccccgtctccaccaaaaaaatacgaaaaccagtcaggcgtggcggcgcgcgcctgcaatcgcaggcactcggcaggctgaggcaggagaatcaggcagggaggttgcagtgagccgagatggcagctgtacagtccagcttcggctcggcatcagagggagaccgtggggagagggagactgtggggagagggagactggagagggagagggagagggagagggagacgggagagggagagggagagggagaagattccacatttttaattgcctatttcaaaatgctgctcagggataatatgcctgtattctaaaaccaccccataaatgtttgttaaatgaatgattaattcattgtttggctcatggatgcatggatgaatggatggatggcaaatgagtcatagagttttgttttgtgaaattcttgacagggtattgcccacataactggtaaacaaaatcactgcttattacatgagcagattacatgaaaaaatgtctgttcctttttttaaactatgtttaagtcactgtggtacagttaaattaaaaataataagcagctatcttattacaggttgattatcccttatccaaaatgtttggaaccaaaactgtttgaaagttgagatttttttctgattttttaaatatttgcatatacttactggttcagcatcccaaatcccaaatccaaaagcttaaatgctccaataagtgtttcctttgagcatcatgtagatactcaaaaagtttctgattttggaacatttggatttcagatttttagattagacctattcaacctatatgcttttctaaataagcatgatagaaaatcatcattatttaaatttctgagccagatcgatattttctttaagtcataccactcgtaaatggcacatccatacttctgcatacaacttgtactggctcaaatttgtattctgtagttgggaaactaacctagtggcagcagactaagtgrtgaggtaggggaaattagtcctcgcagtctttaattctcttactgcatgtatggatctcatttttaaagaggaactagtttagaaccaaaatggcagaccagtaggaaacgtgttgaactatacagtcaggatcctggcttttaggttattgagattagcaaaccagagaaatgagtcttgggcatagaagataggttacagactgtggccagtttcagagcagaaacgacatgtgtctttttttcaaagttgttttctcactcagagacattaatagtggggaggatccttayagccaacagttgtaggcagttgcatcctgccagctctactcccactgccgataagaggtaggtgggaggaatctgtcaccacctgatgtcttggtgcctgggtgtgtgtgtgtgtgtgcgtgtgtgtgtgtgtgtgtgcgtgtgagagagagagaaatagaaataagaagtcagaaacactaaaagaatcagggccaaagctgcacagttttgttttcacccattctcttctcttttatcatccctgcatctgtgcagagaagatgaatctgctttagggaaatcaggagaaaaatgcctcctttgcttgccttagtcatctgatcctcagtgctcttttggaatctagaaaagtctgagggaaaatcagatgccataaggagttaatagaaataaaggagtgtaagtccaaaaagtatgattagtgcccccaaattagtaaaaaatgttattttcccactgccacttcaagtattttgtaccatggtcatctgttgttaagccacagacagcccactgctgtcaagcatttttttactgtttagtatgaatgggttcatgagtccgtgctggtatgtttggtaatatcctcagagttactgctcactcatttacctctccatgtagctgatttccttcagcacaagatgtctacacccatatcataaatgggaaagttgagggtggaggagcaacgtaaatgtccacggtcacactgctagttagaggcacagtgctagttcagtcacctggcaggctttcagatcccttcgccatctagttcaatgaaggtcgaagagggtgagaagagtttcagagttagtgggtactttgcattcttaggatttttaaattatagacctctttaaagcatctttctctttctctccccacttcccccacagtaacttattggtatgcggccccaaaatcactgattacaaattaagttgccaaattaatagcattctctgggactaaatgcagtgatggagttcaaactaggtgatggttgattaaattagggtgatggaattcaatccttgattttaaaaagatttttgcttttatttttaactgatacataattgtctatatgaggtacagtgtgatatttgcatacatgtatacaatgtgtaatgatcaaatcagggtaattagccaacccatcacctcaaacatttrtatttctttgtgttgggagcattcaaaaactgctcttgtagctatttgaaaatatataataaattgttgttaattatagtatccttataaagtgtcctgtttaattatatctttgattaggacaaaagtcaaatttggtttctactaaacttagtaacatattctataccctctgctgttcacaagtgtttgttattattgtcttctgacaactgtttgtgcttgatattattaatatactgtgaagtacctgaattccttattatggttagtatttgttagcttggtagttcttgaccagcaccttccatgtatgatagcacagtgtcacctaatggtattaaagttcagtgggcgattgcatgtctgtagatggcgctttcagtcaaagccagcactagggaagcagacatttcctcctttgcttgcttatttattgtgtagggctaattcaacatttgtgattgttgcagtagctcctggctaaactatattggaaactgatttcatagggttatgttgttacaattcaaacaatatttattctcaattattcttcctggaattcccttagcagttgtatttcagggtagttgagcctctcacacaatatatattaccacacatgttttacgaatgttagatgtgaggcataccatgctattcggtttgctgctgttttaatagcattctttgtatcagatctttacatctgaaattaacagtttaatttttttataatttttgcaaaattttaaccaaaatttttacataatttataattttagaaaggtttttctccctattagtttttttaaatttacatattttctagaatttttaaatctgaaagaaagactacttttagtaagtattatcaggataagtatactaggaatctagactcttgctaaaatgtacttgcccacgtggtttaaagtcaagtattagacacttaagagtgatccacttttaatgtagcacatctacatatggttttgtgtatttataaataatgtgactatgaagtactctctgatctgagagatataatacaaattccatatttaagactttttctcttctctctgtgcgacagcagatgaagcataacccctgaaacatgccttataacttttctaaatccagctaagtatgatttagcatttgtttctactctccacattcagaattgctttgaacgcagaagagaatacagctgcttccctctcattggcgagtgcagatattattgtcacttagtattacaaatgcatgcatgttcatgttttaactgcctcttagaaggcatatgcacagtctttctgtgagtagtttttctgaattaattgaaacattaaaggcagtagaggcagaagagtcttatatgctctatgtattattaaaggatatggaaagttttatagtgtggtccaattatatatctgtgtctcatctcagattcttttcaaattactatgctgtgttcttgtcctgacatactcttaggaggaggaaaccatcctctgctggtgccctatgatacactgacagccaaagagaaagccaaggatagagaaaaagcacaggacatcctcaagttcttgcagatcaatggatatgctgtatccaggtaaaagtacacataccctaagtacacactcttttcacaagagtgaatatttaaatatctccatcatatttaaagctgaaaatgaattcaatgatctgtttacacttttgaggtactgtttaatatgtttaaaatacacacatcagaaacattaacacccctagctgtgtaccatataactgagttccttttgctacatatattaaatcagcatccatcatttaggcaaaatccccaggcaaaaaatcacactctgtttttgtaaatgcaacacttcgttgcatagtaagagagtcactcactgaagctttatatcatatgcaaaatattctttataggttaaatcttactttttctttgagctacaataacattagaaaaacttcaaaatttatatatatagataaacatatatgtatgtatatacacatatatatatacacacacacaattttaccttctaagaggctttgtacaaattgctttcccattttcatttttgctcttccagaggatttaaggacctggaactggacacgccttctattgagaaacgatttgcctatagtttcctccaacaactcattcgctatgtggatgaagcccatcagtatatcctggagtttggtaggtaccatagtcccattgctaatagcccagtgtttgttgtttttaatgtttacaacatcaggatatagaacaacacaggctgctgagctatttgtgatggtataaacccatctattcatcctactactaagtagagttcaacggtcaatggatgaacaagttcttggggagtgggtaaaatctgtgaacttttaaaaatctaacatataagttattccccttataatgtttattggcatttatttgttttcattttgaaagatacattggaaggacatcagaatttgaaggtagagttaaatctcgcctatgaaatcagttgctctactcataagaaaaacttccaaaactatggattttcaaaatttctaaacactatagaggtcttgagtttagcctttgcagggaaacacgttaatactagagtaactgctgtgcagaatactttattattgctcttagggtacaatgaaagacctcttccccgtctggcccagtgctgtctcaaaatttttaaaacctcattctttaagtcttagattcagcacagatgatgaaagcagcctccggtcacttctgttattttgtggtcctcccacattgttgaattaaaattcgacttgttaatttcttaccttaatgtcagagcaccttccagccactgcgtagtaatacgatgtaaggaattccagtttgttcccttttgaaaatagtgtgcttttctggtggttattcatttattttcattttcgttctcgacgttttctctttgtttttaacactcactccttttgtcattcaacacctttcctctgggaccattcatcttggatcccttagctgctgtttgtcttaggatgtaaatctagtttctgccatagcatcagattaaagtttgtagaaattagagctctggtattttcttctttctggcctcttgtatcctaaatgtgattaaagattttccaattgagcatctttctcataaacaattgacttctctttcagcctgcctctacagttcaaatactatattattgctctctttgagcccttctttttcttaaaagcttacactacaagctaatttataatctgtaatctctctatgactcatataactaacaatttttaaaaatatgattcctgacttatcctgatacgtagccaaattaatctgaattaatgaaatttaaccgaagaacaaaaatgaggtaggggtgaattattgaagcttttacacacaaagctaaatattgcaatttctgatctacatttgaaaggatccgatatgcgtagcaactccaatatccagtcttgtttttggagaaacaagggacaggagagaaagaaagagtcatcatttggagaaaggaacaagaaagtcatttgttttttactttcacattggagaacacaaacaccaatatgaagggaagaaatgtatttaggtattattcacagtttattcaaatttctgaataaactacctactacagttttcttgtatgggggtggggagaatcttgctccagggtacatctacccacttgacacatttcattctatccacagggtagagggccttataaacagagcacaggagagaaagtaggctacaatgacagagcccagccaaataacctttttcacaactcctgatgttgtgtgtaccgttttcagatggcttggccagggcaaattaggtacaagaactctgttagaggagcagatagagctgtgattgtcaatatcgtgtttattttaatttccatctttcattgttatcgcaagtgaaactgctatattgccttctccctttatccttcactttggagattttgcagcatatctctaatgtagccattcctagacctaagttaattgtgstagtaaaaatatgcatatgcctttttctaattgttgtataataccgtagattgtaatctctccacatctttttcacattttgcacagaagcattttttttaaatgtagtaaaagacatttcctatttaattcattgaaatatgagcagatttggctgtgttcaaaattttctcttgacataacttcatatgagaaagtctcttatatgaatccagccattttgcataatgtgcttaagagagattcaaatgccaaagtgccatgcaaatgaaatttgcaagtgttaaaaaaccataattttcttttacttgttcatggggagagcattctgatattgcaaaataattgcataagtttcctataaattatattktatttttgtctaaaatttgataaactattatctcaagttattattattatattattttgcaaaataacttcttcaagcaaaagtcagcttggctcttgaatatctggaagctctgcttacaaattttactaaaacctgatagctctccaatatgttctgcatgccatcgttgttattatagttgattattacctcgtctattaatatatgcatgaaccttttccatatgcatgaaggaggtgagaaaggccaccttctaagctaaatgaattaggttaatcaattcttgaccttggtaaaccatggggaaaacttgggtgtttttgcttcacttatgaaaattatcttttgacataggtcaaaatttctttatgctttagtggaatgctaatttgccaacctaatattaaaattgctgtcctcctcctcatcccagatcctgacttcctgcagttttttagtttgtgtcttaaattgagaagctttaactttcggtcacacgaagaggcaatctttattattagaggccagggttaatatctagccaattatgtttattcaatttacactcactgtcctcttccccagtgagcttcttttcttaaaggctactgaaaatgtgggacttttactctattctattccattttcccctctctatgtcaataagatctcaaagctacacaaatgtgtttgtgtctctaaccacaactatgggctgtcctcaatagctttttaaatttagatttgggtattaaacatccttttatttttaatgacactgccaaagtttgcctttatatttttggttggctttttacattcagtttagcgggataatacatttagcaatgctttctaacctttgcattatggatgaatatcttgcaatgtttccagtgcagcatttacctaaaaactcttcaaatctacagatggtggcagcagaggcaaaggagaacatttcccttatgaacragaaatcaagttctttgcaaaagtacagtatacaatctatcttgtttttgcttcaatatgtttgtttacataccctactcattagatcgttgcccttttcagaacatacttgtctacaaatgtgtattttactgcacgtaaatattctgtggcatgaaaataactgcatgaatcatcttcccagcattcttggtcagactttaactctgcattccctaccgcattccttcttcaaatgacttcattctatctgaggtttaattaggtctgcattttttttgttttatcatatgatatggaataaaaaatatctatttcttaacatttggatattgttatgatttaaaatttctagttgagaatttcttttataaataggaaagtctgagttaattcataaataggcacattataagaacatttagtacagaatattgtgggaccttagtcctgctcattttatggaagatcagagaggataaattgtttatatacaaaatatatcccattggtattatttattttgtttcataagcatttatcaggaatttgctatattactggaaaattcatcacttttttcagccaaaaagggatggacatgaagagttgtaaagtctccgaatgatttaatgcatttacttagtatttactgtgtgtctagtgtgggtcaggcattagggtatggcccagggatggccatgaatatacaaatgcccctgggtaagctttcttgtttaggacaccttgcagtgagcctgaagacctaattactgctgtctgcttccttttaaagtacttgcattcagcgattacagataatttgctataaatacaacttttgtggactttaaaatagcatgctttttgattgatgaatatttgacttgtagtatgttttcaaaattgtgttctttactgtaaaacacatttctgttgtcttttcttcccattcaatatagcactcagagtctgttccaatcatttgaagatccaaagtttgtcctggggtgcacatagttagcgattcatgaattgatagatccatatatatatctccggtctctgtgagattgtaatctttcttgatagccaattatcagaatgctgtattcgcagcctctaattttccctttaaaatacattcttgtgttgcccgtatactcagcacccccggtgcatctgtttacagatgcttaatgtggcttaatttctactaagtctataattcattcgtttaccatattgagtacctactatgttccagtcactaaattcaagcaatgtcccaattgtcaaggaagagcaataaaaactggtgtagtccccattatatatagctgtgctctaccacatggtaggaaaaagaagtatgtttagatagacatgagtttgaatactggtagtgccgatcttgttcttgctatgggcccgtcacagtccttagcactagggattcagtgacaaacagaagagaccagttaatagttctggaggccaggaaagggctataatgggaaacaawcccagaaatgtttcttgtttttgtgtaactcataggctcctggaaagagagactttaatccaaagtcccacgcatacaatgtaaaattgcaaatgatgttatcagagctcagaatgtgggactttatctagttgagatcagcaaagacttagccggcaaattgccactgagttgagatctacaggaggaccagagtgaataggatatggagtatgggaagagcacgccagacagagggaatggygtgtacgaggccaggtgatgtgagtggacagagtgaggaggaggaattggcccaaggccagcaggatgaaacatgcgtagaaatggaaagtgcactttaagaaaggccaggttaaaagaatattgtgtaggcaactaagtagcaatgtgaccttcggtaagtcacacatttctatgtctccatttaatacccataatgcagggatgatggcatctaccctacagagcagttgctattatcagttgcaatgttcacacatagtagagactcaacatatggtagttatggattattttggggtctgctgggcactgaactatgttatatgaaaacattgagaatatttcattttgagaaaatagtgagaataattccaaactgttgcaagtttgctctgttcaccataatcacatcctgccactgtggctggagacggtagagtgagatttaagagaggcatactatgacgtgcctggcatggacataaggagacctgttgcatgtgaacagaactctgactgctccaaagcctcagctcccattcatcccctgaaagattccactacgtagatctgtcttcttttcctttctttcaggtcgttcttcctttaattgatcagtatttcaaaaaccatcgtttatacttcttatctgcagcaagcagacctctctgctctggaggacatgcttccaacaaagagaaagaaatggtgactaggtaaacagctataaaaataagcactgttgtatgacttaggtgtatatgcagttgcaaagaaaacctgaggaccttgaagtggggctgtacggagagtatctgcccatttccctggtccgtgtcttcatggaaacaaatactagacaaaaacagtttctacaagtttggatatgtgttctagatgttgagtttctttatattttgctgctaagtgtaatggtggatagaaggataaaatatcactcatttcacaatctacacatagaggccggatatgcatcaccctattagtatttgtgataaatggtacttttgacattagtttctttaatgtttccacaaatctgatatttttgccagcatttattgttcagaagaaaaccccacatatacaaatttaatttaaaaataatgaccaatgttggaagaaaatgaagtaaagatacctataaaatttctgaagctttcccctcttaacaatgctttctcatttctgtttaaaccaaagggttctttatggactcagttgtgattctgctggggatatcaggtccttttactcaaacttctgctagaatttaatatacatgagaatcaattacagagcaagtttacttctctaatattacattgcccaaaagtccataccaagcttttagattgtatcggaacaaaatttctataaaagtgaatacacagtataaagcagaacactggagaaaatacagactttccttggacttgacgtcgatgctgtgctgaaaggcagtacggtctccacctattagacagagtgagatgagattgcatacagcctccgtgagagggtggagaagtggaaagattcctgcactacgtaacactggggaatgcagctggagtggaattgtcagttcatctctttcacttattgtctattttaccaagtagcaagtggccagtcatgtgatatgggattgcaacagtataaaacatgtcctcaaacttcttcaaatgataattttcctataaaattgattatagttaaaataacagcaggaatccatcccagcggcgtgctttgtttccacraattgctgccacatggagagaggcaatgcagttactttccaagatgtgaatttccaccccttcccacttgaacatggccttccttcccaccttcactgggagggagagcagctcctccctcatcatttcataagmaccacatccagtactctgggccagtatccccctgtggattgtgagtgcacgcaagtagctagaatatctcaaggcaccaagttacccttaaacgtcgtgaaattgaggacacgttgaagtctcctactcctccctgggtctgttagcctttttaaataggaactttgttctcagagggtgttgttaatctagctatcacttagttacataaagataaaatcagaaaatagagaaaaattcaaataaatcaatgcaaattctgctattttcctcctctcctgtcttgtgttttattatctccattcagtttcagccttacccttagaactattcactgagcccatactatgcatatatcgaagcatccaattgtgtgttttgggtatatatgatctgtatttgttaattatacctctataaagctggaaaaatttcatggaactatacaccaaaaaagaaaattggcccatttaccttggccaattctgtatccctcatagaataaatcagaggtacatcgctattttgtgctagcctcagttgatgtccctttggggctctagactaaccctagaccacccctctctctaatgacactgcaccagaatatctttaattatagtcatgcaccacataacaacatttcaattaattttggaccacatgtatgatagtggccccatactatatttttactaatttttttagatatgtttagatatacaaataccattttgttacagttgcctacagtattcggtacagtaacatgctgcacaagtatgtagcctggagcaataggctataccatttaggtttgtgtaagtacattctatgatgtacttatatcatggtcttatgggaataacagtgaaattgcctaatgaggtatttctcagactgaatccccatcattaaatgatgcatgactgtatttcatcttcagtttttcttctactaatagaaaaaacgttggtaaattttacttctcccattggtatttcccaaaaaaaggagcatgtgccatttaaaattccaacacatagaaaatgaggtgcataataaaagtaacttatgttattacagtactttagtgccaaacatagctagaatttaacctcagagagaaagaaaatcatagaggaaaatatgaataaggaaatgataaatgatggtgcatgtctgtacaaaatgctgtgcagtcattaacattatgatggagatgagtataatactttcggaaaatgatcatgataaaatataaaatatatgctcaaatagtattaacttttaaagggaacttaatttgtatgtatagaaaaatattggtagggtataaactcaatagatagaaaactggccctgccactatgaataaataagcatgtcttcattcgcatgataaacactatgataatggttttaagtgtttaacagacgtgagtagcaatagttgtgtgggtttgagttaacttttccacaattaaaaccaatgtttccatgagatgtttagatacttcctggcacaagaaattattatatactgagcatttgctgtatcgaaggtcagtactgtcgtgtctggagtatactttgcagtagctaaatacgtgaatatgagtatagccctagtgaaagccaggcagtaagatgggattcaaagtaaagtaagaccaccttgggtggatatagaggggcgagagatttatggaaatcaagccagtcaaagttgatcttgaacaacttgtaggtcagagattaacaaaggaacatattttctaaatgtagataactacataaataaaatgtagaagctggtaatttaggggaaaggtaggttatatagatggtaatggatattaactgtcagaatcaggaattttcttcttaaaattctatcacaatttttttaacctaattcattaatactaagaagctattaaagctttttatgtgaaagaatgatcagagcttccctctgagaaatacagtctggcagcaaaggtatgattgatgagagtgggagagttgggaggccatggcaggcacctggaggccaagacagcaacccaggctatagtgttggaagtgctgcctcaaataggtggtgctgcccactgatccatttagcaggtgggtctttttcttcttcttcttcttcttttgaggtagagtctcactctgtcgcccaggctggagtccagtggcatgatctcggctcactgcaacctccgcctcccaggttcaagcaattctcctgcctcagcctcctgagtagctgggattacaggcacccaccaccatgcccggctaatttttyttttttattatttttagtagagatagggtttcaccatgttggccaggctggtcttgaactcctgacctcaggtgatccgcccacttctgcctcccaaagtgctgggattacaagcatgaaccaccgtgcccggcctcgttcagatatttctgaatgccacctatgtacggcaagctgtctgaggcctgaagataaacacacacacacacaataacacagttcctaactttaataaatttagaactacagccaagtagacacgtacatatagagctaactctacaggaagttgtgatgagtgtcagtggagacatctacagagtgctgggaatatagaagagatgtaaacagcagctggggtgagaaacagggaagagagaaagtcaacatgacttggcgatgagtaatatggcaagtagaaaaaggtccaacttggtgctgaaatttcaactctgggtagttggaacattgttggtatcatgaatagaaacaacatatttcagaaaaagaatcgtttcgaagaagaggttacatttggtcaggtatttatcggagtataaggtacccgcaggtcattcagttggagaaatccagcagattggaaatattagcatgtggggttaattgagagattagagcaagaaatgacatatttggggattatctgaacaatatatatatatatataatgcttgaagctccgaggaagtagataaaactgaaggagagtagagaaagaggcaaaaggttttgaataccctggagaattattacatttacagggtttttggaaataggtctttgaagaacatcaagaatggttaattagagagaaaaaaaaaaaaatactgtaaacaaaatccaaggaaggtaagagtttcacgatttaagtaataaacaatgccaagtactgttgacagaactccaaaaaagaaaaggttattatctttgctcattaggggcattggtgagctgcaaaggagtgttttagtacaagacaatgagtaaatgctgaagaagtagatgccttataaattctggagaatgttggaaatgaggggaagcagagaaaggggacaacagtattatagaaaatattttttagagaaaatataggctaaagcttataataattaatccttatagtttctatgaataccatgccctaaaagtggattgcacaggaggggaaagagttacaatttgccctctttgaggaccttgccttctgtatctgtatttctctctggtggcacatgtggtgaggaatcagcagagattgtcaagtcctttttctctgacagattttcaggcattacatataatttgataaatgagacatagagcagtctgccattatagcaaaacatcctaggtttggattaattgagtaagacctaatcctagcattataaattctggatcatcaagaatatctcagaatgtttcactctggatactagagaggaataggtaaaatacatgacttaaaatagattggagtacagggatccaaagtatgtacaattctaaactgaattattctctttagaaaaaggcagaccctgtctgagttagcacacacagctgtcagccataaagctcagtagataagggcacgtggacaaagtttctcctgttttattgtcttaaaattatagcacaaagataaataaggcaggtcaagggcctcatgactaatcttatgtctagtagccacttgaatagatcattgttttaaaaatattttgttctgataagaaattccccaaaacctcagattcactcagacatttgtagatgaacattttcttggaaaactacaaaataccctacataattttcatcaatacatgaatccacattgttacagaagtgaggggtgatggccaaaacttactgtaaaagaggtcaacctcacaaacgttaccttctctgcttccctctcttcccatcctgccactgatcagccaagccactttcatggtattccatggctggtctgtatccctagtcctggggagctgcacgtttgatcacagctgttaatgcagagttttgcaagagaacatagtcagtgaggacttagctgttctcgttattgggaaaaatcaagctgagtgtgggtggtactatacacatggatcttcaaggttagattttctggggtgagtgctggctgggtagagcctgtgctctctgagagctgagaagagcgtgagtagatttgaaaataatgtcacttgtattggtagagatttgcaaatggcccctgagagcatctgggtatggacctcttgcagcctgggttgggagctgtacaggagggctggatgtcagaacgctgacctacttattttattgagtttatttagtttaatgagtttattcttggaagaaactcattctgagctgagttttgagggacgagtagatgggaggatagcatggaaatgagtgaagggtatttctcaaaatagggacctgtgaggatcccacccagctgaggcttggtgaaaagaaaggacaaacagcagggatctcccaggttcaagtgtctgatctgagagttagtggataccagcgttgtcaggctgaatgctgaatgtgggcagccattatttggaatggctcattgctaattgccatgaaggactcaaagacacaggaacctgctctggagcagataagaaatatactgaacttataggtatccagagactttaagttatcacatctgtaatgctttcctctgagtgattatcagttgctcaaattctgttcctactttactgtattcaaattcactggatgcttacgttacgtaaggagtgtgatcaaggttggggacgaaggagatttcaaataataaaacatattaaaacttaaagtaacattgtatgcccgaagcaccatacgtctgttgtaaaataaaataatgtccatatatatattttttaaatccagagtttcagtggtacatttgggcagataaaaccaaattttttcctggtggtttttcagtagttatatccttatggggttcatatagattgcttttatattaattagctttgctttcaattttttttggtttcttataatatgtgcttttttaaccatgtttgttaaagagatgcactcaaagactctttctttaatacctttactccacattctgctcagagaattgattctttctgcgtgacatcatgttgcttttttccggctcatatatcagctgtttttttttcttttttcttcttcttttttttttttttttttaatttccccctgtcttttctaccttcccttcccccttcccttttctcttttgtttttcttttgtcttcagcctattctgcaaacttggagttcttgtcaggcataggatttcactatttggtaaggagacccttgaaaaaatacaagcatggccatcacttggttttctttgccatttttgcactgtgttgtgtgctgctatgttgcatggatgcatgtttgcatggctgcatgcatggtcgttgcaggccaagataaggtcctcgaggttgttcataaatagcattatgtatggtgaaattgaggactctatcttttttacactagtccaaagcataactgaaagtaaaaagactattattaaagagcaaatgaatgaaaatggcaggctgtgccgtattttatctcaggggtaaaaacaaaacaaagccaggcccttggatttgtgtttggttacctctgacagattaaataatgagctgttataaatcaaaattttaaactgcacttattttttttaatgctcttgactacagatttgcatgtcttctgcattccaaacattggaacgtcatagtcaagacactgaagccaaggagcttcggagcttcacttggcaagagtggcttttctagcaccactcactccagggtcagtttctgtttgtttctgagaattcacctagctggagtccatgttccagagcacctgcttccggacagccatgcagggtgggcactcactttccgcagattttccctgccgtggggctttagaatctttagtggctggtggaatttgtgtttcacactttcctgcatccgattttataaactgccgaagaaaatgtgaaccctttgctctctaggttttgagacagtgttggagtaattttagtaataaaacattgaatgtattgctagaggtattataagttcaattctatttacaggamaagctaaggattaaaaaaattaagtcatttctacaaagtcacagttaaactgaggaacgggtatatatatatacatatatatatatacacacacacacatatgcacaaataagttcttcacattacactttttgagaaataatagtttctggatatagtaggttattgctatatttggtttctagtattatatccaagatttggtgctcttaaatttagtaatgaaaatttatatttcattaaaattgcctgagtttttacattaatatttcagttatttaaaatcaatggggcagttatctttagaataatttctagttcactgacttttgtttaacttctcttcaacagagaaatattttcatgggcttattcaggcaggattttcatacactctttaaccttctcagaataacagtggattcaaatattctccatttgtcytcagcaagtgctatctaattatacatatcagctgcccttttgcggtcttattaatgakcataataatactttctatggtgctatttctaacttcctgcttattgtatatccttcttttcctgttatacctcatataatttcctttaaaatttttttgaggtattccatacctgaactacaaaatcctaagaacaacttggctaggtgtggtggctcatgcctgtatcccagcactttgggatgtcgtggtgagagaatcacttgaggacaggagttcaagaccagctggggcaacatagcaagaccttggctctacaaaaaataaaaataaaaaattagccaggtgcagtggtgcacacctatagtcttagctacacaggacgctgagatggatggatcacttgagcccaggaatctgaggtagcagtgagctatgatcacaccactgtactctcatctaggaaacagagcaaaaccctgtctctaatacaagcaaataaaaagaacaacttgatgaaaatgtatatgcatatacaaccatttaatcatagctcaagccaagacatagaacgtttccaacatgccaggagcctcccctgtgtcatttttcaaattataaccatctccagaggaactatatgtagactccattctatggattcttttcagctgttcttgaaattccatttttgttgaatatatcatttaagtttggttattgaagataaatgtataatacagtttgtcatgcttgttaggggtgaaaaactagaccttaacattagttccttccctgtgtggtcctagtatttcaattagacattgtggtttcatcccttagccttttaatactattatttttatttttaaggggaatttattggagacctggtatgttttctttatatctcaaagygcatttttgcacatttttatattattaaagtgtatgttattgtttcaaatttgctttgatatttgcctataaaatataaacttcaacatggctttattaatcaaacatctagtacagatttgccaaattattagaatctttaagtctttttttttttttttgamagagtttcactcttgttgcccaccaagctggagtgcaatggtgagatctcatctcactgcaacctccgcctcccaggttcaagcaattttcctgcctcagcctcccaagtagctgggattacaggcacacgccaccacacacggctaatttttagtagaaacggggtttcaccatgttggccaggctggtctcgaactcctgacttcaggtgatctgcccacctcggtctgccaaagtgctgggattacaagtgtgagccaccgtgcctggccaaatcttttaagtcttaagcatttaagcttcacatattatgggtattggtatagtatttaaatgtcacatattatgggctgtagatgctaatatgacatcctagagagaatagtgggtttggaatcagaaaacctagttgtaagtcctatttttctaacttaacagctgaatgatttggacaagggacttaaattctctgaacctgcattttttcattgttaaagtgggctaaaatacctaataaacctagagatcaattttttgtgaaataattcatgttaaagtgctatgtaaagtgtaaccttatagttttcacatataagatgtttctagtcttattaaaattattagattttattaacttatctaaagcttattatactttatttacataaattacatactaaactagtagacttagccctttaaaatacacacacagggccaggcacagtggctcacgcctggaatcccagcactttgggaggccaaggcggacagatcacttgagctcgggagttcaagaccagcctgggaaacatggcgagaccccatctcgactaagaatacaaaaaattagccatgtctggtggcatacacctttggtcccagctactcaggaggctggggtgggaggattgcttgagcctggagggcagaggttgcagtgagccaacattgcacaccacacacacaaaaatacacacagtaaagcctttataatacacccatttccagaatgaatcagaagtgttataacccaactatttactttttgatttatcagctatgccagtgtggatttttccaaacagagagacccagtagcatatatgcagtgcttgtttgtatatggtcatattaatctattctttttcagtctacttttatcattttcttgcattttggcaggaaatacattgattatcaatgggattacaagcgtgagccaccacgcccggccaaatctctaagtcttaagcatttaagcttcacatattccctgtactgtcttgtatttcctgtactatcttggtttaaagattttttcatgacctaaacctaagagtaaattaagacagaattgaaagttgaggttgacaagaaaatacttgagttttgtgatgatcagagaaggtaaggatgtagaaagatacatgttaaccttaaatatgtcagaaagtggagacaggacaggagcattaaaaaaaaatgaagagacaaaatacatgttctggtggtagtaattgtggtgagcagagtttgatgggtaatggaatatttattctaggttggctgccacattgtaattatatctccaaacctcgcctgtggttgaaatatttttctgacatatgaaatgaggattctcaaaactttggcttttatattttttgttatctactttaaaatatttcttctgcattgatggacactatacaggaattaagataatagtgtttttatgcctaatctattatttttgagacatttaaaccattttatgttatgtttaaaaagctaaggtttttaaaaaggaagacaagcggtattacccatagaattctgatgaatcaattagaataatttatggaatgaaaaagaaagaaaatagcttcttgtctaaatataggcttccctgtttgaattctgaaatgcttgctagtgattataagttggtgcacataacgaattttggaaatccaggtaggacataaataggacgtaggcaggttgacaagtgatatccttatcatttgccattttcaaggaccagtgttgactaaagaaacagtgctttgattcccagagttacccctgacttttgctgcctagaaattctgattactattttcaaggcagttagaggatacattagcccttctattacagtctgttagaatctttcaatcatttttagaggaagcagcatctgataactaagagtccaacagtaataatgatggtggcacaggtggtgcttatcagagtgccttaaaggctttctttttacatgtgaaaataaatcaaatgccttgatgatactcattttatgcattcattcaataaacatgtattgtatgtctgccacgtgaaaggcattcactcaagatgtgaggataggaaaatgaagattgatttctctttccactccggaacccagaccaatatgcaaacatctttcgcttgtactattgcaggagcatactgaccattctctctgaatcccctcctgcttctctcaactgtgttccacgatgatcttatcaaatcttctcaaaacacacttctccgattacactcctgcatattcagtggcttcccatgcctttagggtagaaagcacgtttcttaacctagccacattagtgtttcaccgtccattccccatgggccactccgtcctcgtgtcccagcccagtctctcctcctccctatgcttcttcagcttccttggmcttctctctgcctcttgaatgtgttagattcctttctgcccagggtttttgcacatgctgtaattatcgcctgagtaaaggaccctcacacataattactcatctcctcaatccttcacactcataacaaactatccatccttcagacttcaatccaaatattactgtctcaagaaaggcttccctgacctccttgataatactccgtcctgctactattataatagtctctggtgccgtgtacttttcctccatgtcactgatggtatgcytaccagattaatatctctcttctctcgcataaactctcagctctgtgaggtcttcctgttgcactctcagtgcctggcaggaagtctggcacacagtaaatattttatgaatatatgatgaatgaatgaatgaatgagccacccaggtccggccttcaagaagcctatagtctaatagagaaggtagataagtacgcagacacttactatgagacaagtgctaagaacgtggaaattttcttacattcacgaatgacacagctttcctttgtttattttgcttaagagattattaagaaaaatgtagtacctaattatcctacaattggtgagaatcatgttttttttttttttctcttattccttaagaggtccatgaaaacacttaggccacttacagtgaatagaaaataacacataattaatgacccttaaaataataagatcatgaaactcaaccaacaatgatcctttcagttccaggaactatttgaaaaggcaggcatgaaatatttgtcacttataggccttttctactttccagttttctggtgcctttttaacatcctagtgagacattgaatgacctggacactcctcagagttagtggagaatttgtgaattaatcacataggtacatctaggaatacctgatgttattacaaaaagccagcattttgtaatacaatgagcataatactgacctagaacccaatgtataacatcattaatacaactccaatattagctacaggagtattaaacaagataaatattattatgtgtttaacatgaaacagtagctgttgttaaaatattcagtttttttctaggtgagtatgcctgacttataccagtagataaatcttaatgttacgtttggaagagttttaaaagtagatactaaataaagtaatacaatggagcctatcaactcttatttctacctaatcaataaattagtggattaagtttatgttgatacttctaatatctctcccaaaaaacactgacgtctttaaatgatgatttctgtcttatctcagaagttattatattagaaaattaatatgtttgtgttatctctaacaaggctcagattgtgcttgtgtttggtaggacacatataataaaagaaaaattggccgggtgcggtggctcacgcctgtaatcccagcactctgggaggctgaggcgggcggatcacaaggtcaggggatcgagaccatcctggctaacaaggtgaaaccccgtctctgctaaaaatacaaaaaattagccgggcgtggtggcaggcgcctgtagtcccagctactcgggaggctgaggcaggagaatggcgtgaacccaggaggtggagtttgcagtgagccgagatcatgccagtgcactccagcctgggcgacacggcgagactccctctcaaaaaaaaaaaaaaaaagaaaaattacktaaagtactcagaatcactgcagatagaagcatatttgaggattcagtgtgccattaagttgagaatgtaatggttcaatcatgcgcaatctgtaactattttcttatccttgttattcgtagctggaggatcattgagatctttctctaatttaaaaattctgtagtactatgacaatatgcatggcaaaaacaactatttcctggatttaacttattatatatactgtaaaaaatcctatttttttagagaagttcagaaatattggaattagatgcctataatgaaagtaataaagtatacatagcattagatcaacatagtattagagcgatacagataattctttcagttgaacatagcattataggagaatttcctggctttgaaaamtgaatagaatatgtagttattcaaaatgtgtcctcggtttgactgaaactcctcaccaaattagggaaccaataattttactctgttcaatatcacagactttagaaataacaaagtcattgacactctgcaatttctctctattccctcataattgtgagagaaatttrtaagttctggcacagtggtatttcacattgttaatagaattctgccaagattaatcatttcttcagagaaaagaatacaatattagaaaagtagagaaaaataaaaagtacaatgactgctatcactgtttccagaagagagagaagtcaacattctgtgaattctcagcatatcagattataaaacagaactggcatatgatatgtcaaatttaacattgagaattcctgagttatagaaactttatttaaaaaaacaatttgggattaatatgcaaaaattatttatagttatattatgtaatttgttgtttttattatttagagagtcatatatgagagttgttataatttgtttaaaacccaatgttgtccctattgttattagacccaggtgtaagttattattttaattatgtactttttatgtttacgtacaccttgatgcactgatataaatacacaatcttaaggacaaataggcaatctatcattgtttccctgagtgctcagaggtgatgagaggtgtgtatctgaggacaagggaaatagctgggtccttgaaatactgtgagttgaaaagtatcaatcttttggttttttcaccacccagagcaatgaakcaattatgtaaacttaagtacataaaaatccagttgccacctgaaagttttatcatcttacaaaactctgctggcccttcctgttcttcctgataacgtgattgacatttctgattatggtaatctggatagctttaagaaggacaatatttaagtcattattttattgaaaagccttaccacatgctttacctcttcaagactcacattattttaggcttcttacacatgctaatgggattgacacttttgcctggtctacaaattaaaatattgaagactctactttttctgccttcttagagtccctttcccattttttacatagaggtgtttctatttaaagttgtgctgtgtctaaaaggggtctaccaagatgtaaaaatgtgtggagttcagtttattcctttagcaatcacagaaatttcatattcccaatacacagtttcagtcaacccacagaatttgtctggctcctggtgctgtttcctactcttcttacatcccagagacagtccacaaatattttaagggcctgctgtatgtcagacactattctaggtgcagggaacaaagcaaacaaaaatcccagcctgccaggcttatattaatagaagtttaaagtatccctggccacccctcatggaaaagggcacaggaaaactcagtaccaagtacaaacactgataatctataataagagcagattggaagggaaagggacagacaactgagtgtttaggaaaaatgaaggacctgcctctctgatttggggctgattaatagtggcataggactcatatacgttgcactggatctcttcctcctcatgggccttctctttcccattgtctatactgcatctttcttatcttctctgcctccaaacactggaggccctaggccttttttcttcttacttatattcatgctggctagtttcattkagacccacgatgtttagaattaaatgtatgtttacaatgcccaagtgtatagctctggcttagatctcttccctgcactgcagacttttttttttttttcaatcaattgcctattctacatctttacccgaattactaataggcccatcacacttaatatgtgcaaagcaagggtcaggaccccatcccccacccccgccgcatccccttcctcccacagtctgcttcttctcgttctctttctacaccattcagtggtgccgcctttcacctaattactcaggcagaaaaccttagagttatccttgactgctttcccgctcacctcacattcaatccataagtaaatccttcaaatatatattctcaagttcttcaccactgatatcctaatctgaattcaccatcatcagtgaactgattccgttcctgcagtaggtccctaattatcttccacttttgctcttccagaatttcccacatagggaattaattctttgaaaatataaatcgtatcatatcccatcctgctcaaaacctaagaatgtcttcctaccgcactgaaaatccaagggcttgctctaaccaagctctagaacctgacctctcccaacctctccaactcatactctgcttctttcctctcgctctgactcccttagccacttgaccctctttgcttggaacaccaggttcattttttgcctcagagcctttgcatgggctcttccctgtacctggatctcctcagatacatgcatggtttatttcttcatgtcattccaacctctgctcaaatgccgcctccaggaaggactcatgagcactatccctgttattctacccagtttctgtaggtgtgtgtgtgtgtgtatatatatatagtatatatatataatatatatttatataatatataattgcatattatatattatgttatatattatataattatatcatatataattatataatatatatttatgtaaatatatattatatgatatataatatatttatagaaatatatattatataatataattatatataatctttttgtatataacaaatattttttatatatatttaactgtggcctgctattatgttatatgctgatattttgctaaatgattttttttttttttgcttactgattcgttatctatatccccctttaaaatgcaagtaccataaggactattttgttcattactggaaatttgagagtgcctggttttaatctttctttgttaagtgaattaatcatcaaatgaatacttctaagagttccaggagaagccccagagctggcatctgccaatggacaggaaaataaaaaatcctaccattctgctcattttgtcttcattattaccaggaattctgagacttgaagcacaagatgagggaatattttcatgaataactcagaatctcagtaataaataccttattttttcttatttgtatcatatcactaaactggcttgcccatgttctaatacaattattaatttcagtgtgtacttaggtcattcattttaggttactttttgtataaagaatataacatataccagtattacaaaaacttacattcagataatagttgtcaatctcaggacccaggagatgatagtgtgtgtgtgtgtgtgtgtgtgtgtgtgtgtgtgtgtgtaatgaggaactgatcatgtcaaactatattgtaagtggtcaaattattttgttaccttgaattcatcattttatttgctttctgtatccccattacgaagaaaaatatatgtaatgcttttatcactcatatttctgtacttccttgtaaaatatgccaatcaaaatgagtgaattttatattactttcaagaggagttactaccatctgaaaatctcagaggagtattatttaacttctttagtgtctgattttttttttacatgacggtttggtgctttttggtttttgccaaagaccaataacattcaaggaaattaatttaccttcatgcaatggaattcaggcaaattaattcatcttaatgcagtgggatgaaataagaaagcagaatttttggtgcaattagaatggaatgaaaatttttaaactttaagcccaccttatttcataaaggatatgagctgactttaaaagtttgtaaacaataagatttaaaaatacagtgagatgggagggagaggggattattgaaaacctcggttaaaactcttttagtctggtgcagtgcttttgaatgcttcttgggcatgtcagctatttgatgagacatgctttattgcttttctacttacatttgcataaccacttttaagcagaaaaactgcatgatttcaaacttgattattaaaaaaccttttaaaatattactsttgtgtcattgactaatttttctagcacaaatattggtagaaaagaagaacattgagaaattctcagggcaatttatacagcattttgtttcctctttaggcaatgatgcaacatcaattgtcaactgtcttcatattttgggtcagactttggatgcaaggtaaatggatacatttttacctaaataaattactataataatgatacatgtatatatataagaatattaagaaggacccagtgtctggattttattctttggatttgtaayaaagtctttagtgtaggtgaagagaaaaactttttaaaattaatacagtggcagcttatgtctatgatcatatatagattattatttaatgtcaggtaatttctgtagcagctaggaccataaaggagggttgaactggtaatgtatcacacaggaaaaatggtaatctgacaactctagagatcttgttagcttccaggcgtgatatttgtgcttaacattcataataacatttggctttttaggaaacagagttttattctcattttacagatgaataaagtgatgtttaagattgcatactaagtgtgtaggtagacgaattcccatctgtgtgctttctactctgccctgtcaacttgaccagaaatctagcatgttgaccaaatacaaaatcagttcatttagcatgattgattcagccatacatttagtttatatctaggataaatctaaataaaagtttataaatgtctcctaaagagaatattccacaatactctttgattatccattcttgcgtttaagatttcatttaaggtcttttgtatgataaatgcagaaaggagacaccattacagaccttcacttcctactacaaatagtggcattaaggtatgaagttcagccttcggcggcttcattagaaaagacttgattgctacaccttaaaacacaaacattctgtatcatttgttgagttggtttagctggcatgaaattttttttgctactcattgcctcaggaaacattctagttttgttggatttcggattaactatactcactcagaagctgtgttttgttagttaaattggagaccgttagtgataagcatacagcattagcacagacttttgcagcaaggttttaataagttgactatgaaggcatttggaaaagataatttacagagcagtattgctgtaacttcaagtatattgaaaaaatttgttttagagttgattttaaaagttggttaccaggtgagtagagtaatgaagaaataaacatcataagagaaccacaattcatttatatttcatttgttcctgttggaagatacgagtcctcccttatttactttctaggacagtgatgaagactggcctggagagtgttaaaagtgcactcagagcttttctggacaacgctgcagaggatctggagaagaccatggaaaacctcaagcagggccagttcactcacacccgaaaccagcccaaaggggttactcagattatcaattacaccacagtggccctgctgccaatgctgtcgtcattatttgaacatattggccagcatcagttcggagaagacctaatatgtatgtaaatttatatcttggagtttttttttttttaatcgaaataccctgtagtacaatcaaaaacagtaatagccacatctgggttactaaaacactgtttacatgttaaaatgccttttttattgcaaaacgttataggttgacatttgtgtgatagacaccattcttacagaaatagatctctgaattacatggacccacagagaggaccagtaaggtactggttatagaaaatgacttccacattgttgaagtttccaaatgatcactatttctacattgcctcttttcacataaacgttttaatgcagttgaaccatataacatgcaacagtaaatgttttcaaattatttctgagtcaatgtagattgtttctccaagcttgacaatgtaataatgtgaagacgactgagacaaagtctgtgtctaaataattggccttttagagtggctcaaatatcctctgtttagaggtttctgacagtttttagggaagctttaatcttctgttttgggctggcattcagtagttaataaaactatacacagaatgcccaagattacgtggaaaaaatacgcatgagctgtttgaactccccactgccctgctcaggacatgagcctttgttgagcagaatcaccaactcagactcgtgcattgtccattcctcaggtgatgggcacctctgtgcaaaaactgctgagttactcagtgggtgccacaactaccagtggcagaacgtttattttaaattttgttttaagaaagcatgcttagtccgggtgcagtggcgcatgcctgtaatcccagtactttgggaggctgaggtgggtggttcagctgaagtcaggagttcgagaccagcctggccagtatggtgaaaccccgtctctactaaaaatacaaaaattagctgggcatgatggtgcacacctgtaatcccagctactcgggaggctgagacaagataatcacttgaacctatgtggtggaggttgcagtgagccagtattgccactgcactccagcctgggtgacagagcaagactctatctcaaaaaaaaaaagcagatgtgccttttgtttagttatttttatttgtataaatttacgggtttcaagtacagttgtctgggcttttagggcatccatcacccaaataatgaacattgtgcccattaagtaatttctcgtcatccaccccctcctgccccctcacccttctgagtcttgtctattattctcctctctatgtccatgtgtacacatggtttagtacccacttataagtgaggacatgtgatatttgactttatgtgcctggcttgtttcactgaagataacaacccccagttccatccatgttgctgcaaaagacatgatttcattctttttatggatgaatagtatatagcctaaactgaatagtayatagcttaagctttctcaggacaatgtataaataagtgggtttttctttcaagtgagattctctttttccttagtggaagatgtccaggtgtcttgttatagaattctgactagcttatatgctttgggaaccagcaagagtatttacgtggagaggtaagaatgtttaaagtttaactttgtattaattgctgcttcaagttttataactatttatttcaagaatcttcatttcataacctgtttcctagttataaactaaaccggattgacctttgaaattccttggaagtaattagacaatctttaaacaaaataagaattgatataataaaggacaatggagttatgcaaagaaagtaaagcactaatggtaaagactacacttaatatgaagtttcagctgagtgtttgagtcttatgaaagcacctgctagtatcgtttctcattatatatcagaaattcaaagtaaacatgaatatgagcagttattaaacctagttttattttctcatgttctcaagtttcaggatggagtggtttgcagtgttaaatgatgtgaataggtaacataagaaaaggtatccccagtaaatttaaaataaagagatcactggcaactttagtaagaaatttctgtgaaccagagaagaaaaacagggaagtttttttaaaaggtcagaataaataaaaacatattctgatagaagatttaattatgaatagatataagttctcccaaaattaacctgtaattacagtacaatttcagtacagcaaattacagaaatttgctttttccaacttcacaaaatcattcaaaagtttatttcaaagaataaacccatgagactagccaacggaatttgcaggggaataaaagagtaatgaacaggtactcatttggcctaccaaatattaaaacctataaagctacagtagttaaaataggatgacagttgtacataaaaatagcaaattagatcaatggaaaaacataattgggtttactctgaacattttacatttcttaccttcattttaagtaaactcaattttcatattatttttatggttatgacctatattaaggaagtataataatttattgaaatgtgactttatttttgacatgttggctgttttctgtttttcactaatatatataatgccagatctatgttcatagattccattgtatttttatgcttatttcccttagctgtattcttagaatttggaattataggtcaaagggtatgcctgtattacaggattacggtactcatttcactgttttcagaaaatcctttccatttacattctcaaattttagaagtgaatgctaatttcctcatttgttccttactcagattatcttttttttctttttagtgcttgtgtatgtgatagtgaaaatataggatccctatttatattttcaaatgcactttcctgattaccatctacttgctatttttttcatgtttaccttgtcatttgtgtttctttactttatgaattgccttttctcatcttgcatctatttttctattcatgtattgtcatgctgatttgtaataatgcttttgttcattaaaatgattaacctcttgcctatttctcctgtttttgtgagttttaccattttttacctttatatatatatagtgcttatatataaaatatatacataaaacatatataaatatataaaatatataaaaattatatacagatagcattttatgacatgataatgttgaatttttatataatcaaattttatataattttgacataatcaatcaattatttcatgtatgtttcttccccttagttttattattctgataagtttagactacacatttagcagttagaatttcaaacatttatcctcctagacttttcatgcttccagttctttatatttaactttataatcctattgtttgtatcctaaatatttgttaaatgccagatactaggatacagaaataaacaagatacttctctactctcataggttttatatctggtagaggaaaccaaaccaaaacaaacaagcaaactgataaatattatagtggcaaggtatagtttgtcctatgaataatcacacaatttagagaacaaggtagtcgagaatgtgtcttttagaaggcgacttttgaagcttataacttttctctatgcaacagaaaacaggtagaagctatatgaggtaggtctgtgtctagtagcttctgttttctcaatgaagaatgccttgagtcctaagccagatgaaggctgagaaaagaagtgtggaaagctcaaggaaagtagagaatgtctagaatgatcatctctgagataagaagggaatttactagaaatatatctgaactttatttctcttgggtattatgtaggattcaaattaaatttttaaaatcatcaaccatttgtaaagtaatcatttattaactatttattttattccctgatttaaaataaaaccatcatgtaaagtaatgtatttactagattacatttagaatttctattctgttctattatttgattttttatgactaaatcaatatcatatagcctgaattgttagtatttttaaaaatattttaatatctggtttttcaaaccctctaattccttcttattgctgtagcttttgtttttgtcattgttgtttttgcctatatatttatctggacaaaattcgaggtcacttttttaggttctaaataatgttttggtttttggtggcttgttttttaagtcttttttgtgcaattaattttgcggttataaagtgattggggaaacaaaaaaaaattcaaaggtaaggaaaagacattttgaaaaaaatagatatttacaaaaagttacagtggaactttttctaaaatatctacaaatatagatattttaacataagtcatccaaaagaaaaattgatatttccagaatgccaacacaaattatcagaatcagtctgagaatcactaattgaaacagaattttaaagtgaattaatgaaataaaaggactagtccaatcagatatgaggaaataagttgacagataattttttgctaacagataatttagctttttttcaaatggtgaggatattgctattgaaagcatatgatgtttagcaatacagaaattggatttgggagttaattttattaggaccaatattatcattccttttaggttaaatttgctaattgtaatatgacttttttagttactcacttggaagaccttaaaacataagcattttccacttataggcaacgttctgcattaggagaatgtctagctgcctttgctggtgcttttcctgtagcatttttggaaactcatctggacaaacataatatttactccatctacaataccaagtcttcacgagaaagagcaggtaacacagaaacatgtgcagtgctttgagatatgaagctaaaacttgatatttatcatattgtccaatagtgatttttaatgagctctttcagtttactatatccaatcttgtttgttcttaaatgttattgtttggtattctatgtgatgtaccctgtgatagatgagggagatatgatacatatagggcagcaatcagaatatgtggtaattcaagagcaaggtgactgagcaggccccttggacagcgtgtatgtgtgttgattgtgagagctcctagaggtagagtcatcttgtgtggcagatgagggagtatcgcagcctagacgtaatcccaggtttctcttctgggtgactgactggataatgtccccaccaagttagggcatgctcaagataggctggagagaaaaagagaagtttaaatttagatccatcgtgttttagttgtgcttgagacatccaggatgagtcagaacagtttttaagaaacatggctttacagatattagcttatagcagaaagaatggccaaaattgtctagatgaacatgcaaaccaaaaaagagaagagaatcaaagatagattcctaaagataatcagcatttgaaagttcagcaagggctgggcgcagtggctcatgcctgtaatcccagcactttgggaggccgaagtgggtagatcacgaggtcaggagttcaagaccagcctgaccaacatagtgaaaccccgtctgtgctaaaaatacaaaaattagccgggcgtggtggtgtgtgcctgtaatcctggctactcaggaggctgaggcatgagaatcgcttgaactggggaggcagagtttgcagtgagccaagactgcgccactgcactccagcctggcaacagagcaagactctgtctcagcagcaacaacaaaaaaagttcagcaaggagaagagagtcagtaaggacactgacaacattcagagggagccaaaaaggctgggcacattgatgttaagaaagaagggagttttaggaaaagggaatttggtcctgggtatgaaatgccactgaamggttggaaagatgagttgtaaaagtgcaattttgctgcacagtgaaaagcagctttgttcctgaggacggagagtgcctggatagctaagtaatccaggaaagatttgagtatcttgctgggtaggaggtattacagggctgaaaatacaggtctgagcaaggcatcaggtatttggtggagccgtgagtgggggacttcaaaacttcctcgaaaacggggaatggaggccaaggtggagccagtcataaatggcttgtaggtcatgagagcagcaaagttagaggaggaaatatttgatactattgtttgctgtaaagtaggaggaatggctgttttctgggagtgatggtacagtaggaacttaggggaaagagagaagctttgaaatagctaccttgaaacacaggagaaggagccagttgcaggcatgccacgtcttgctaaattttgaagtccaaaatgaaatagttgcctgtggaaatccgccatatcatctcagtactttctttgaatatcatccatttttatatgtacttctccagctctcagtttgccaactaatgtggaagatgtttgtccaaacataccgtctttggagaaactcatggaagaaatcgtggaattagccgagtccggcattcgctacactcaaatgccacatgtcatggaagtcatactgcccatgctttgcagctacatgtctcgttggtgggagcatggacctgagaacaatccagaacgggccgagatgtgctgcacagccctgaactcagagcacatgaacacacttctagggaacatattgaaaatcatatataataacttggggattgatgagggagcctggatgaagaggctagcaggtaagaactggaagaagacattgtacccctgaaatctgttttatttccaaaagaattttaaatacataaactagaattttcccatcacaatttttattaatattttctttactcaaaaatattagtatttgtcatgctattttttaatgtagataaaaacaggcattgggtatatgttaaatagttactacttttaagtaaacatttttctgacttgtcaatctctgtaagattaatcaataaacacagcagtaaaaactaatgattttatagccagagacaaaaataaaacattcaacttttagcaatccacttgtagccatctgttatatagagaatgtgaagagaagggagggtaaaccaaaaaaatgtagtctaatgtctacaattattgcattatttgtattgaaaagttagaagcaatctaagtacccaataaccagaatatggctaaataagttgtatacatctacatgccagaatattatgtcatattttgttttttgtttgtttgtttatgagatggagtttcactcttgttgcccaggcaagagtgcaatggtgagatcttggctcactgcaacctccgcctcccgggttcaagtgattctcctgcctcagcctcccgggtagctaggattacrggcatctgccaccatgcccagctaatttttttttttttttttttttagtagagatggggtttcaccatgttcgccaggctggtctcgaactcctgacctcaggtgatccacccacctcggcctcccaaagtgctgggattacaggtgtgagccaccacgtctatgtcatctttaaatgttgaagtttcaacaatattttatgccctggaaatactcatattatgaagggaaaaatggagaatttttaaaacaatgaattcagaatgttatatgtataatatatatgtaaatgaatttatctactgatgaaaactccagaaaaatgcagcaatgacttattaatttgggtagatgattatggttgactttaacttttctcttgtatacttttccccagtgcatatatgttactttcagggggaaaaaagtcattttaaaaatggcccaatcaagtttagaactattattaacaactatggttattattaaataagagagcagtgttccatataatctaactcttccattgtgccaaggatggggatagttaaaatgagataactgtatatagtctcatrtagtaattatgtagcagagcttgtccctattctaagggttaggggaaccttttccatttgggaattttatttcttgtgtgaaaatgatttccaaaatgagtgaaagtcttttttttcattctaaattagctatctattctaaaaacaaggaagatcgttgaattcaactcagtaaacatttttttaatggcagctatgcaattagaacttggactagaaaaatggctgaggcatgagctgtacccttaaggaagtcatgtgctggagaaggaggctttaattatgttacaattgtaattacaatctatcatcatgttaatgaatggttttacagagcagaatactaatgtctgtctttaaacagtgttttcccagcctataataaataaagtgaaacctcagctcttgaaaactcatttcttgccgttaatggagaaactcaagaaaaaggcagctacggtggtgtctgaggaagaccacctgaaagctgaggccaggggggacatgtcggaggcagaactcctcatcctagatgagttcaccacactggccagagatctctatgccttctaccctctcttgattagatttgtggactataacaggtatgatcaaaagtaatttagtaatttctccaattcggtcataacgtttcttggctcacatgtccttgttcaatcgcttcattcactattttgccatgagcttgttggtaattataattaactgtttataggcaagttaatttttggcttaaaattaaaacaccttaaaatcaaagttggccgtttcattctgattttgcatgtaaaagttaacagtttgacagttatgatgtttaaatttttttttaaatattacaacactgtgctgaaaccatcatgagctctgtggtcagtacatttaactttggggggatggtttttttttttaaattaactttaaggagtagctgagaaaccactttatttattatgtgatccagggcaaagtggctaaaggagcctaacccagaagcagaggagctcttccgcatggtggctgaagtgtttatctactggtcgaagtcccatgtgagtgtgaaaatattgatagatcacgcctactgtttgtaggcacctgcttacttgcctcctaggtttcatgtaacagttgaggagagagaataggttcccctgaggagtttgagggaatataaaccttcttctgagttttgcaatttatcctttaaaaaaatcacagggatttttaattgcactccataaacatattttaaatttgcccctaaattttggactaatattgacattgcataaagatgtactatttttactatctagctttccctatctcttggcattttgttctcttaatttgcagttctcagtttgagacgtgcttaaatagactagcaatttccaacaataacccacactcattttacttgtaaaggtactgcttccataaatttgttttatcttcacacactttacacctaaggaatttagtttggctcacattttagaatctgttgggttttaaaataaagcttctttctactgacaatcctgttgatagaatttctaaagtacgtatttggtgaattttcactattttgtgtattgcaagtggaactatgtatttttaaacctggaaaagattttaatcataacaatcgtatagtagtctatcattatttcagtaactagcagaatatagataaaagagcattgatgattatcctgaattattttaaaaatttagaatttttatatcaattataattctatgccactctgtaaatgagagacaaagaaaataaaaatttcaacctcagttttatcatctgagatatcttaccagtttacttaatcagactgttgtacaaatcaagttactttgaatacataatattttttaaatatgcatatttaatatttgggatgacaaatattatttattgcctacatctgaggagtctgtcaaacttaatagcaaactttatataaaaacatacattaaaaacataatcactcagaaaggatatatgaaataatggctgcttaacatgcaactttgtatcttcacaaagatacaaatttatttatcctgtgtaactcatgtttgggggatgcaatagatcatccaaggtattctgaaggaaaattcaaaatccactgtaaaaagataaatagattaggtgatgtagatagatagatagataatgcatgcccggtgacaggtgggagcattgcttgagctcaggagttagaggctgcagtgccctatcattgcacagctgcatcccagcctgggtgacagagccagaccctgtccctaaatacatacatgaatgaatgtataaataaatgaattccagaagaaatcagtccattttgagctgccaaaaaacaaagatgaatttttgctttttgcctgttgttttccctgttgggttacttcacttagaatgcctcatgggaaaatagggggagcccaggaaaaaattactaaaaactgcatatttttatttgaagaactgaaactcttcagtttcctcgatcattaaaatgccgaagaagcgtctttagatttaggtacaagactaaagtttggaacaagagtatttatcataatcagtatgttttcagatgaatgtctaatcatactttcaagaataagcaaaaatatctgaatatgtacttttgaatctcatgggcatatattaatataaacataaattggctaatgtgttatgtttttccccaaatatttaaagataaattgattttgccagtctttttatgttcccaaattaaaagggaataaataatgatatggtattttaaaaacaggtaaaaaatctgacagaatagaaagttacgtcatagttctatgtgtcctcggaaagtctatgttaatctcaggaatcagtatatgcctttcaccagctaaccaggcgtttgaatattcattctactccttggtaaacatgtgatcttgcaatgaaattttctgaatcttagttttcccatctttgcaatgtgcatattcatatctagttcacagaattcttgcttctagccaagtaccctcattagatactcaagaaatacttgtatccttttttgataattcttatatatcaaattaatacttatctctgtaaaaacttgcaggttctgtgtaacctctaattacaaagacttctttaagtggttttaactgaaatttcctttgcaacttctcagaatttcaaaagagaagagcagaacttcgttgtacagaatgaaatcaacaatatgtctttccttattactgataccaagtcaaagatgtcaaaggtattactataaactgtttcactgttctggaaaatatctgaatgtgactttcatgaattgactttttttttttagattttcgaagatttgtaactggaatctgacagatttggtaatgttataaattggttcaaatatgcaagctgttttaaggttactggaatttgtttgaatcaggcatggtaagacatgcagacgggaaatgactgtcatgaaggaagacatttctactgacagatccctggaaacaggaggcatggcatgccaggcagggccccccggggagaggtcagggtcagtcaggaggtagagagagcaaggagaagacgtgggcgagagcttgcctcgtggtctccactggaaggaatggacaaggcagggcaaacaggtttctgattggctaatttgaatacttttcaggggctccacatcatagggcctgtccttggctgcctggtacctagtcccagagtgattagagcaggtggatagtagcccagagtataagagcccgataggtgaggcaggggtcagtgtgggctctgggttggttgacttgtatatgaaaagcaagctccccaaaccaaggaagccatttccttctctaggacttgcctaacgatgggagggactgctgtctccccaggatcagcaaatctccaagatgtcagagcaacagaataaagacatgcttcacacacacacactcacacacacacacacgcaccccccactcaccaaaagtcagtataatgtatgtttaacatgtcaacactatgtgtccatcaagtgtgaatatttgtgtgcttatgtgtaccaaagaaacagacctcaaaataaattcgctgcattatttaaaagccacatggacgaattccaggttctcacacatgaagtgggaagtatctttccagatttttgttttctctgtcactcgtattggggaggggagtagcttccatttaaagcattttaaaggggctttatatgtttaattcctgctaaatgagaaataaatatattacatgtggtaacatttggctgccaaatggccaaagatccaaaaatgactgctactcaggcagagcaaattagcctctactgactcaataaattctggcaacagagtagcttaggtacacccactccactgacctccaaaagtcaccggatcctcaggcctgctctgtgatctgtcacaagggaagtagaatggtattgcttggtaggcctagtcttgtttaagagttttgaatgccctgtgtttgacccgacagcacatgaactagaagctaatgccagaagtctgtgtattcctgtacagatacccttttccctcttttccatcagttgagtccagtgattctcaaagatactctcaaagcactacatgtcatagaacctagagtgagacatgcataaagatgactgattataacacagtttgctcttatttgcaagaagaaaaaaggggagtaatagataagaacctctcaattttaacatttctgacccacaaattttctcaaactaaaaaattatttttttgtttttgtttttgtttgttttgtttttttgagacggagccttgctttgttgcccaggctggagtgcagtggtgcgatctcggctcactgcaacctctgcctcctgggttcaagcgattctcctgcctcagcctcccaagtagctgggactatacaggcgcatgccaccatgcccagttaattttcgtatttttagtagagacagggtttcaccatattggccaggctggtctcaaactcctgacctcgtgatctgccggcctcggcctcccaaagtacctggattgcactccagcctaggcaacaagaatgaaaatccatctcaaaaaaatatatatagatagatagataggtagatagcatttattacaagttctctgtgtttatttgtgggtgtgagaaaggtgggttttgcctgttgcattatacaattgtactctgtttttttcttaagatttcatttcctgttgaaatgtaatcacaggccttggacatttaaagctaggctaatttttataattactatatctaaaatacaaaaaagtatctttttataggtttttttttttggtaggctatttcattgtgggaatattagaaaattttttgtaagttcccacagaaaggtcatgtgataaatacaaccaattaaaactgtgctttctgttcataatgtggcaaaggaaagagcttggctttcagaggcagatcagcctggagtgctgactctgccacttcataatcccttcactcatcttaaacctcactgttcgtagcagcaaaatgtttgtcatgctgcttaccttgatggaggcttgtaaaatcagaataatgtgtgtgttgtgcctcacagattataggcatgcaacaaattttaatagatatgaattgtagtaacaaaatgataaagttaaaatacagctgaatatctaacaatcatatagttaataagtacttagaaaacgtacgagagaaagaaactgataggatagtcaaagatgtcagaggtaagtgaggatttgaataggtcttggaaaatgagtcttttctagatgggtcataaggagagagggtggaggagcctgctgataacccattttatgcagccatagcactgtttttgctcaaatctaacagtatatttgaagaagagtctgtttgatgtctttcttgccattttcctggtccactattaaatttaaagctattttctgtgaaattgttacaatcatatttgtatgtttgtgggtgtgtgagagacagagatagagaggaggcagaagcagaggttgattgattgattgattaaagaaagggctcaagtggctgggtgcggtggctcacgcctgtaatcccagcactttgggaggccaaggcagatggatcacgaggtcaggagttcaagaccagtctggccaagatggtgaaaccccatctctactaaaaatacaaaaaaaaaattagccaggcgtggtggtgggtgcctctaatcccagctacttgggaggctgaggcagagcattacttgaacccaggagatggagactgcagtgagccgagatcacaccactgcactccagcctggtgacagagcgagactccatytyaaaaaaaaaaaaaaaaaaaaaaaaaaaaagggctcaggtgattgatttaagaaagggctcaggttagtccacttcccttcttaaatatgcccacatatgggccatgttattacatcttcatatctgatccaaatgcacagattgaaaatgaaaaagtgtgcaaattcattagctttagcggctctgtttaaattattgagctgcgcctatgagcaaggcacagtgcgtggctttgaatacagagaaacgacaaaacaggtttggcagctgccccaaaggagctgcatagtttggggaggaaataggcactaaacaaatgaacaaaaaatacccaatatgtgcgtacaggaggatattttattgcttatagatttaatttcctcatatgaacagtgacatcacccataaatgttcaaatatttactactctttccagttatagatttcttctggggtggaaagcaaaattattgtttgtgtataagtaggaattcatttgcctagtgttactcaaaattgagcaatttgtagatgtgtttagtgttgattatttttattataagctcacaaatatttataaatattaaaccagatataagctccttctgcctatacaaccataaaaccaaaagaactttacaggttaaaatcagtgaaaactctaacaccaataaatttagactaagaaaactccaaaccaatacaatttagactaagaaaactccaaaccaatacaatttagactatattggggatgtcgctttgctgaaactaaattaccggtattggatagaagtatgtttgtataatttatatcaatttgcttaatttttaggatagtggttcttcctttgggcaattatttttatcattttagttatgttgtcctttgaacaaagagcccattttaaatgatccattttttaatgaatgagtcaatttaacagtacaaattattcatcatattttttctaataaacttactgagaataatctcttacaagttggtatgtataaaaatgggattcatgcaataagcatatctttttggaacagaagtataattcttactgctatggttcagaagattataggtttaatataacacttcaatatgtagtttaattattacataattgtatattttataacgtaatatataagctatcattgctatatggtgactcacttgtttcactactttcactatggtaaaaatgtctttcaacctcatgctatgatacactttaccttctgttaagtaaaacaaatcatttgtatattaaattctattatgttttttctcaatagcccaagactattacaatgtatttatatttataaatattaaaatatttttcattatcatttcattatcacgaaactatgttgtaactttgaattactgctacaaaatattcaacatgcacaaataagtggatgtgggacaattattttaattttgacattagaacatgccatcttgatagaatactcattacccagtgaaaattagattctgtcgtttaaggtgaccctgtgttactagcataagcctcaaaaacatcacaagagagcccttgagtaacatggcagtattcagttgtaaactggttatccagatcgtcctgaatatttatgaaactccaatgagtatattacttctatttctactaracggggactgaggctctaggaagacaagtttgcagactgtataaaagaaaaatgcattttataattgttctgatatattagaccacacacacacacacacacacacaccatatacatgtatatatatttcaaagcaagcatttgtcaaaacaaaaataagccctttattcttatatttcttaagcattgaaaattagaaagcacacaatatctgaaattactatagaattttttatatatttatctgcttccctaaaattacaattttcatttgtcttctaaaaattacgtgggaatgcataccagtgaattataatgacctaggaatctgagggtaggacttgaaatcagcaaaagatactaagaagggaagagaaaaattattctcaaaacaggaggattttcaaaactagggagcagcagaaaatgaggaagatgaagtgacaagttagggaagagtcatagtggttctacatgtgagaaaagcaggttcagatcccagcacttctctttgttccataggcagctgtttctgatcaggaaaggaagaaaatgaagcgcaaaggagatcggtattccatgcagacctctctgattgtagcagctctgaagcggttactgcccattgggttgaacatctgtgcccctggggaccaggagctcattgctctggccaaaaatcgatttagcctggtaagtctccttttcatcccagcggtaatgatcatctgacctccagactctcagtgtttgattcctttgtctcactgccctatgtcaatatttcatttgcattacatgttttattaagcaggttttctagacaggcccaagactcaaacataaagactgctctttttttgaggctgtttttatttgtaagttatgttaatcacctccgggacacattcaagaaccaaacaggaaagacacaaaccaatctctggtagtgaaaaaaatggatttcatataaacttctatataaagtttgtgatgagaagcatactcaaatttatgaagggtgatttttcaatgttaaaagcataatatattgtgccaactgtgggtagataaggtgttgacttttaaatcagctgctgttctcctctgcaagatttaagttcctctgcaagatttaagttctcaagattttacaatgtcctctgagtttctgttcttcatagctatgcaaatgaggatgcaatatwttgtacattggaatttctattttatatttatgtaaattggaggacatattctccattccacattgaatcactgaagctcgtcactgaacatgcatcgtttgacattctaaaatgagtgaattgaggggaagctgtgggagtgggctgcatcacgcagctctactggcagttctctagagtttgattctcagttgcattttccttgctattactgggtcatggaggatgttattaagggctaaaatgacttcgtggagatttggaagaatactggagatatacttctatttcagcccaagaaaacatgctatgcccccttcttcttatgaattggaaacttgattccattgaatttcaatgtccttactgtggaggtaaagcaggtcattaccttgcttcaggctacagcagtaccaagaaattatttgaatgagaatgccccaaatttgtagcatgtaattttataaagatgtttctcagacgtatactatttcaaaaaaggtttggattgtttctattgacttgtgacagttgatgcaatagaagactccttttaggtaacatatatttcttgacagaaagatactgaggatgaagtacgagatataatccgcagcaatattcatttacaaggcaaggtaagccaaattttattcttaagccacatttactacctatacattagttaatctctctttaaaataatactataaataatgttactttaaacattaaggtaatagacatattttaattagtcattatcctacttgcaaagccttttgtattaaaaattctaaagataataaatgatatatttttaaagaaaattaccagagattgtcaaattttggaaaaaatatatgtcatcagttgaaatacagattggatgtattcttttttaattattatactttaagttttagggtacatatgcacaacatgcaggtttgttacatatgtatacatgtgccatgttggtgtgctgcacccattagctcatcatttagcattaggtatatctcctaatgctgtccttcttgatagaggagttttagggtcttttggacgtagagaaggtgtctataagaaaatgttggctaggcacagtggctcacacctttaatcccaacagtttgggaggctgaggcaggcaaatcacttgagcccaagagtttgagcctgggcaacatggcaaaaccccgcctctacaaaaagtacaaaaattagctggatggtggtgcacacctgtagtcccagctacttgggtggctgaggtgggaggatggcttgagcctgggaggtggaggttgcagtgaaccaagaccgtgccactgcactccagcctagacaacaaagggaaaccctgtctcaaaaaacacaaaatttacatggagcgatcagtaattaaatatatatttttaagagtcgttagtctataggtgaattaggccatttttgctttactatatagaaatatctgagactgggtaatttaggaagaaaagaggtttaattgattcacggttctgcaggctgtacagaaagtataacacgggcatctgcttttggggaggttccaggaagcttaaaatcatggcagatggtgaaggagaggcaggcatctcgcctggcaggagcaggaacaagagcagtgaggagggaggtgccacacacttaaacagccagatctcacgagaatcttgagggcagcaccaaggggatgctgcgaagccacttatgaaagttttgccccgtgatcaactcagctcccaccaggccccgcctccaacactgaggattacatttccacataaggctgctaaaccacttatgaaagttttgccccatgatcaactcagctcccaccaggtcccgtctccaacactgaggattacatttccacataaggctgctaaaccacttatgaaagttttgccccatgatcaactcagctcccaccaggtcccgtctccaacactgaggattacatttccacatgagatttgggcagggacacagatccacactatatcaataggctatatcgagatttgcagcaataggaataagtgagtttacctaaggagaagagaagcgtgtacagttggaataaaaacatggatggaaatcgatagaacacctactttttaatggtgggtgaaagaattgttagaagtagttttggcaatccagtgaccatttactattatttggaaattttttataccattgaataaattattcatttgtttataaaacctgtgatgcagttttaaaagtcaagctagtattttgactcagcctgttgtcttctattctgggtgtcccttctgaggaattttttttaattatgaaaatacgcaaatgtcaaaaagtagcaacaacaatataatatatgcctttckgggtattaaaatgtctctttccaaagatccaaatcatatgatttttaaattagcattttaaagaataagataaaggtgagacatgcctttaccatattcacaatgcacaagtattcattcagagcaaatttcatgtgaagtttgatgtgtactcagttgtttactaacaattcttttagagtgagattaattactattagagtatgatctcttttcagatagccagaagaatttgaacatttttttaaaagtttataaagcctctattggaacttcagaagaaaagtttacactacaaacatttttcccctatagggagagacactaaatgtttttatgtacatgggtatttgagaagatcaggtaccccatgaaagggtgcaggggatccccaggggaccctagaccatacctggagcaccattatctagttcaacaattactgagttagagacagagagtgctcagtacctcttaagaggagtctgggccaatctcaagaaatggtcaaataaaggtggttatgattataagcagaaagaagtttgtccattatattctaaaggtcacttgtaagaatattttggacagtttagatgacgtattcaggagacaggaagaaggaagagagcaaaaaaggaaacattgattgtccatatttcacctccaaatgaataagacctgaaaataaagaggtaatgaataaatattcatcttgtcattttattctacactttcttaaactaggagttaggcaggcatattaatgagatacacagattttcaaaaaatgaatttttttattcctaacttcttgaatacattgtcttgaaattgtagggctgttcatcctgaggccagaggagtaattttatgttagaataaagattctactttattaattatgtattaaatagaactaagagtacagattaaaacctgtaagtatcaaacatagtcctcagacttaaaaagtaaacggatgaaaacattttattttatcaaaggataagtagtctttacaaatcatttatccctatacaaagctctatctgtctgtgtttgcctgtagatgaaaattatttctgacattttaactaggcactctcagtctgggagttgtgaagttttagatgtcatctatttatttctgcttcataacattcagtctcccatttctaatggagattctaaagtagaagacaaggggattgctttgtccgttttttgtttgtttgttttttgagatggagtctcactctgtcactcagactggagggcattggtgcaatctcggttcactgcaacctccacctccttgggttcaagcgattctcctgcctcagcctcccgagtagctgtgattacaggcgtgcaccaccacacccagctaattttttgtatttttaatcgagaagaggtttcaccatgttggccaggctggtctcaaactcctgacctcaagtaatccacccaccttggcctcccaaagtgctgggattacaggagtgagccaccgtgcccggctgctttgtccatttttaataacatacttattctatattatttctttgaactgatatgttctacccccattaaattgcttgcttttgtcaatttctatgacttataataatgtttctaaacacatgaagatttcatatacgtttttcaccaaggaaatttgatgctattgaaaagtaaaatgtgtagactcctttatgatgagtgtgattttaaaaacatctattgatttatataatttaatatctttgcctcagtgaaattaagcgctgttgtagagtccaaatatttataggtaaatgctatcctatatccttgcccataaaagtaaacatagaaatctttctacaattagactgtgaatggggaggagaagagcatgggtagccttacccattttgttttccagtttcccactcatccttaagccctagttacaacgtcttgtgttaagggaaatctacccaaccaccaaagagtatgataaatctcacggtattttatattttgttttagtagcccttatcacaattttaaatatttgtttaatgtctgtcttctctactagatgataaatttcatgatgaccaggactttatctgtctttcttagtatttttaatttttttttttttttgagatggagtctcgctctgtcgcccaggctggagtgcagtggcgcgatctcggctcactgcaagctctgcctcccgggttcacgctgttctcctgcctcagcctcccgagtagctgggactacaggcgcccgccaccacgcccggctaattttttgtatttttagtagaaacggggtttcaccgtgttaaccaggacggtctcgatctgctgacctcatgatccgcccacctcggcctcccaaagtgctgggattacaggcgtgagccaccgtgcctggccaatatttttaatttttaataattgtatatagttaaggtgtccaacaggatgtttcaatatacataagcatagtcacatgattagtgtagtcagacaaattagcatatctatctmctcgcatagttaccttttgcctgtatgtgctaagagctcctggaatctaytcagcaaatttccagtatgaattgcagcattattaactgtaatcaccatgctgtacattagatctccagacctgttcatcctacataactgcagctgcgcgtcatgtcttaactggtaaacactgtaaagcccaataaataatgatgggtggactcttcctatctttagattgtaaccttgtttttagattcccatcttcccattgtaaccttttccttttttctgcagttggaggatcctgctattagatggcaaatggctctttacaaagacttaccaaacaggactgatgatacctcagatccagagaagacggtagaaagagtattggatatagcaaatgtgctttttcatcttgaacaggtcaggctttgtgtcaattcaatcatatttgccttagccacatacaaatattttaaaaagagaatgtgtgttaatttgttaactatgacccaagaaacatatatgttcagcatattcattctaaagaataagagtccggtgtgcttagtatttcataaagacaatttctaagcttayaaatcttgtagcaatatatagattatatattttgggagatcctggcctttgttttgttgtcttttttcaaatatttctgaaagtattaggattatatttttaaattattctaaccaaaaaattcaggagttacatctgatttcaaatactttatgcatacttcattttttaatattgctcataaaaacatgtttgagatattatcttttaccggtttaatatttgaaacattttcttttttgccacttgtttaaccttgccttttattaggtatatttttgagctaattttctctgaaatcaggaacaaattacacttagagaagaacaatgcattgatagatattaaaatcatgtaagaaaagtgtttttatatattttttcagttgtgtcctactttacactacaaagctcagtttgatattcattacctttgcacaagaatgtgtaaaacaagaatacttgaaacattatcaatgggagggtcatatttttacagaagagatcatctggcttaggtaaaatatctgcaacacagagatatattatctatttctcatcaagtccattcagcaaaataatcacagtgaagaagctcattgtaacttgaccatctgatctgtcacagggctcttatgacagatcatactgttgatgacttggttattttatactaaatataaaataataataagatgccctatgccatctcaggaactttgccacctaaatgtatgtgtgtgtgcatatatatatatatatatatatatatatatatatgtatgtgtgataaatttcatagatgataaattaaattatatatatataattttgtattgcctttagccatatttgaacatattatcatagcaataataaacattttgcttgtattcctgttttatattatctgaaccctcacccctgccctggacagtttaataatgcaaagatatcatctaatgtagtatccttttaacttccttcttgcttactcaaataccctcccccaaacgttaataatttctctattgtcatgcaatttatcactacacttgatgagattaaagtcactaggatacccttaagctgtatggctattaacatatatttacgttatctaataccttggaacttaatactttcccctgaataacttacgtaatattttcatgaaatattaaataaatacaaattatcatcaatcagcagatgacaagacttgtcatgaaattttaagtgatttatataaagtcatagagttttatctccagaattatatatatatatgtttaagattattaaaggttaattaaatggctacatttctgacagcattgctctaccatcagtttttaattcttcctagtgtttatacatatatatagatttgcttgaataaattctagatacattaaatgaagcttatagaaactgattctattttattatattcccatatattcataaatatatccaatcatgatgaatgatggcatttctcaaatgaggttcacttttctaagtatccatttatgccttggatgtttatggagttccctgtcctagggcagccttatccccagcagacctggaggactgagtgctgtaagagaggaaacagacacttaaacagataaatatgggatgatacggagctgttaggatataaaatgtgctgaagaaagtatagaagcaacccatacttaatgtagatatgaagtaggtaatccctgtataagtcttaaggtaggaattatctagaaaaagtgggaggatcagagtttttcaaactgttaagaatatggcgagattggtttatcatgagaggagggttttgagttaaaagaaattgtcgattatcaaaaataaaaagtgggagatatcctcgtgtttaatttatgcctttaatatccctctgctaatgataacatgtgactgagtcacagaggagcgtgcaaagaatattttaacttgcaaacgtcagtgtaaaaaacagtaggtggacaggaaacacttgttgatttaatttatctcaagtatcagcagcctgttttagatgtatattttgtgttgtatatctggtaagttttcttatgagagtaggttatctccaatgaattttctaataatcaaattctagccaagctaacacatcagcacatcaagacattcagacagggttacaaggtacatctttgtgttcgcctttggatcacatatctcacagataactatttacttatcattgatttagaggaaagcacactcaggtatttcctgaaatactttaataggcaggtaataaaatgcctgccaaatgataagcttcctggtggcaggaaccctttttgttggatttttactgtatcttaaatgccttaggaacttaaaatatgtttgtcaactgtcacccatgctgatcataatgctgtaattcctgtaaaaagctatcatctacagactggggtctcaaaatggaaatttaaattgaagtatgttgggtctcattgaaaactattgcccttgattgcttttacttctatgttaaaggcctaacagtggtttatttcacttgacacaagcatcaagaagatgattgaagtggataattgtcaccacgtgtttattgatcatagagggggaagagcatcacagaaataagtgcttttccgttaaacaagttgcctcgtgaaaatttctaaaccaccgcagtccaaacattttaaatgtttacttcagacattattacaatcatttttgactctttactgcaaaggataataaatgtagttttacttttttagctaacataacatttttatttctttcagaagtctaaacgtgtgggtcggagacattactgtctgggaagtacagtgctcaatggcctagagattactaattaatttaggtttatatgttgggattttttctttctaatacaattaatctctttcttctcttagagttccaaacactattagttatataaataacttgcttgcatcatttattgcaacttttgaatttatatttgtccctatctaacaaaatatttacatattttaacatttttaccaaatttactcactcctaatactgtgttcacaaagcgttgtcttcttctctttatcctgctgtattaaagaatagtagaatttttattaactgtctctttttgtgtttattactttagctcttacaataaaattagttacaatggacatatgaataagaatgaggtaatattttatgtaggcagaaaatatgtattaaaatcataaagaaccaaagaaaattttgagaaggagataaaatgattttatatggaatgattttctatttctttgattttagaggtgacatagctttgaagtacacagtattgggaaaatgtgatattcttactaagggaattatatagcatttgcaactatctaaattttatctttgggtaacttttaggatatggacttcttcatgataatcttaaggtacttttggaattggaattccaaatatagattacttaagaggggcaactgtttaatactatatttttgaagatagtttggggtgtaaatatttatttgtttttgaaggtagtttggggtgtaaatatttatttgtgtcattctacctcaggtggaacatcctcagagatctaaaaaggctgtatggcataaactactgtcyaagcagaggaaaagggctgttgtagcctgcttccggatggcccccttatataatctgccaaggtcggaattactttattttttgtaatagatcaatgttattttttcctagtaagtgacaggtgtttagaatctaccttaataggggtacaatagtccaagagaaggatggaaaagctttattgattcttctacataaaacttgactaattttgttggatattttcggagaactgtggtctttaatgtaattattaaatgactcttactgaggaatatctgctcacatatgtgaggcaagagagagtcattaggagttctttctttgtcctggatttgaatcagaacatgatctgaatcattctttggcatcagacttgtcttgatttgaattctgacctcccaacttctctgccccatgacattggtcaagttatttactggcgaattttctcatctgtatcataatgggatcagccttatagagttgttcagattatttaatgggttgatgtatacagagtgcttagaagtgagctagtaggtttatgtcatgataaatgttagtcattattattatttttgtaattattagcattaggggaaaagaactgacttatgggaataatgtaaaaagatttgacaggcccgtcaaccttctcttagacatagagcagacatacttaatagagaagtagcctggtacattcaagtctggcttaggtggtccagggtaccatttcagtcaccttggagttctctgagaaactatgctctttcccactctgaagtttatacaaattgcatcacctctatgtctcagaaacaggactcagctcagctacatctcttttgtggaacatctctgaccaagccatgcccctctactccttgcacatcataccactttcctacagtattaaggctatttgtctctttgattcagactttgagatcctgtactagttttgttccattttctttcttcagcacctagaacagtgacttgtacattgacattcagtaagagtttgagtgaatgtataaggcaaagaaaaaaaagaaacataagcaaaacaaatagaggaaacatcatacttttcccttttgctaagacagctgtatttcttgccatcgtgtcacactcactgggtctaaaatgtattagcatcctcctcaaatgtgctacttctcaattctctgactcaattatgctgtcaccttttggtcagatagaatattaaccttaatatctagaaccagaaataccatttaacccagcaatcccatgactgggtatatacccaaaggattataaatcattctactataaagacacatgcacatgtatgtttattgcagcactgttcacaatagtaaagacttggaaccaacccaaatgcccatcaatgatagactggataaagaaaaagtggcacatatacaccatggaatactatgcagccataaaaaaagaatgagttcatgtcccttgcagggacatggataaagctggaaaccatcattctcagcaaactaacacaggaacagaaaataaaataccacatgttctcactcataagtgggagtcgaacaatgagaacacatggatacagggaggggaacatcacacactggggcctgtcggggggtgggggcaatgggagggagagtattaagacaaatacctaatgcatatggggcttaaaacctagaagatgggttgataggtgcagcaaaccaccatggcacatgtatacctatgtaacaaacctgcacattctgcacatgtatcccagaacttaaagtaatgaaagcaaaaaaaaagaatattaactttgaattcacattatcatttctttttggttactcctatactgtcattgcccagatttcatcagtttccctttgaactacttcacattcccatccttccctccatcaccacctcttcaagtcgcttgttccttgcctcatatcaagttgatggcagtggtttctgagttagtttctgtgatgtcatagagttcttccatcctctccaaaatgtcattttcaaaatggtatcctttattccagtggttcgccaacctggtgcttttaagaaacacacttaaactcatttaaaaagtattcaggcctcaacttattaaattagaatttcagtgagagcccagcatgtgtgctacttaaaagctacacaggtgamtctgatgaacccagaaggctgagtctgtgctttggcatgccactctcacatacaagaatgtatgatgatttctagcagttccggctgcgttggcagttgccccctctgatttccaaggcccttcataaacctgtctaactgttacgtctcatgagtccttaacccaatttgttatcataaagctcagctttccatcctgcaatggcaccgtctctcattctatcacatctgttgttgttttatgatgttcccttcatgacattcttttattctttcttaccttgacatcttatccacatctcttactaacttcatcatgaattccactgattcttctcatctgcactggtcttttttcacaggcggccatttatgataagtagtgcagggtttaatctttgagtatgtactcccataaagttcacttaataccttttgttttggaatcctcagggccatccatttgttttttaatgtttgcttggacagagactaagtcctctattgacactgattacattgcttatcgagagacatgttatatgataatagtcatttaatgaacatctaatcaatgcgatttacatcctttatctcattttaaggcttacaaaactgaaatgtggttggagttatcctggttttataaaggaataaactgaaatttgggaaagtcgagtcacttgaccaatgttacaaagcttggaaatgactgagccaggattgaaatgcaagtcactgtgcgctatgtttgctgcaagaagcattgtctttcaggaggagagtcaagaatagagaatttatttctattttacactttcagtgcacagataatctagtaataaagcactactcaatacaatttcaacttattttctaaacaccctttttctgaaattgtgcttacctttcaggcatcgggctgtcaatctctttcttcagggatatgaaaagtcttggattgaaacagaagaacattactttgaagataaactgatagaagatttagcagtatgtttttagtggggctctaagatgaaagagggtctaggcttggtgcagcaatgttggcgtgagcagtcattatataacattgaaggaaaaaatatcattacagtatatgggtattaggaaacttttaaatcttaattgttactgcattcaatgcttatgggaaaatgtgctcttgtcatttccaagagatctcatcaacatcaaggggttgagaatttaaaatgaataatatagaagtattattaattaaacatgatttagtctttcttttaaattccttctcaaagcacctataaacacctgagaaccaggatagactataaaagaatgaactgtcaagaagttatccacctaaattaagtagaaggtgaacaaaaaattgctggtttttagaaatcaacagggcagagaatgatagactgaacacaggagactgaacacatggtaaatgtggagcatgagaagtrgaattttcaccagactgtgctgataaagagcttgtgagttcagcacagaacagcagtcagtatcatcttttctaagtcatggacccatctaaatatctggcaaaagccatcttctcaacaaaatttacaagccatctcaaaacttggcagactagtcagaggcttcatgattcccaagataaagacatcttgtgtaaagttattttttaactcacagattattagggaatataatggataaattaatctaattcttaaaagcctaatcttgattgtccccatattttaaaatgatttttatctgtctttagaataaaaaatgtgtagactattggatatcttgtggaaatctgcccattatccacattaaggcttaattacaggaaagaacaccattcatgtacagagaaaattagtttccatggctaagtcagtggagatataaaactcaacaaaaagttggatgtaattgaattctgccaataaaaatgcttaataattttcctcgctattaaagttctatccgatagtaaaaaaaaaatattttttaagttttaaaagtaactgaaaataagaaaaaaagtataagtggttcaagcattaactcatttagtattatttacgtatcatgctgtgygtaagcgaagaaaatatttcactttataagcaatttgcactgctatgggaactaaattttcacacttggggtgactcaggattttattgcaaatatttgtaaatcgagtcctccctaaagctaaaatccatgcagcaaatatactttgagttatgaaaatgcttataagaatggcatttggtatttttaaatgatataagttatccctgctcatattaatttttggtcaaattattaaatatctctgttttgagctgcataattttacaatggtaatgtaacagatatctagcatattatattacatttatatatgttatagcatgtatattacatatttacacttacatgcaacacatatacatacaagcttttatatacacatacacacatatatacatatatagcatgtataatgcatataaaatmcacacacacacacacacacacacacacacacaccccacaacagggaaggaggaacgttcgcattccttttattcttcattgctgtccttcacagtgcttttggatttgagtgaacatttttttttaatgtgacattttataaatttgacttttttgcagaaacctggggctgaacctccagaagaagatgaaggcactaagagagttgatcctctacatcagctgatccttctgtttagtcggacagctttaacagagaaatggtatggttgggagggttcctatgagacataggaggagcaaataaagacacccgtgtctgagtattctgtgccatgtgttcatgttttaagttcatcttgttgttgttaggagagagaattgttcaaagataacaaccagcctggcatgtacctagggaccgacactcattcaattttaggcttcagcaactacctactagttctagtttttcttaacaactttgtaattaatgatgtagttgattctgattcttcttatgaaatggtttttctgtttatcacaaacaaactttataaataaaacaaaagaaccaaagcaaattccagtgccgcaagtgtatggagaccgatggtgrccccaaattttctgggtagatagtgtctccattgtgcagtgggtcttaggaaacctctagaggctaagtgagccatcacctcaacttggaggtatctctgagatctatttcaagggcattgcccatttttcttgtcttctgcagccttagtcatatgaattcaccaaagccacaaagggcaaacctctctgaagttacataagaaatgcactggtaggcctgatcgtcaaaatgtgctcagcatctgtcattacggagggcaatgcataaattggctgtgcagatgggacatagcagaggctagaggacctttatctgctgccctgcaatgggaaagaaagcctgttttgcccccaggcctttcccattctctgcagaatttgggatgtaatttaattaaaaactcatatccacatgaatctcctcagaagagttcatttgacctctttgcctgccataataatgtacatttctccctcttagctaatgtgatctatcctttctctcactatttctctctctcttattatttcctaactaacaaaatcatctcattcctaagcatagagcaactctctctctggcattgtcaggtaatgaggtatttctcataagtgaatttttctcatggctgaagtttaaaactgctgaaataactttgcaaattttaggtatatttttggtggaaacttttcttcacgtagtcatggtttccatgcttctcaaaaagaagataataaacatattttaacctttcttaatttttagggatcattattatggccatcttgttttttaattgtcatatcataatttggggaatctttccatcaaatgtcaaatttcacttctgtcaaaagcccccacctcatttaagtttgcttgtttcaagttttgtagtctgaagaaaattaaaattattacatttgtrtgtaaaccaaaagacagtttattttgtgaaaattgaaggcccttctgtaaggtaagatgggacagctatttaggatccccgggatctttgctttctgatttcaggatatttctgaatatcctaatattgtcttagttttgtrttcatttaattttaaaaaggtatacttgttagaaaaagaacaaaggttattttaagcagcgatgatacgtgtgcatgtgcctagccttctgcttaaacactgatgttttcttcttgctttccccagcaaactggaggaagattttttatatatggcctatgcagatattatggcaaaggtaaataagtatccttcctgattttcatgtttaattttaataaagggaagtaactttcatctgaaaaggataagaatctgtgtatttcattaatttcaactttttgtttgtagcatgaatctccgttctaaattccatggcaggtcatcattgtttcctacttaaacattttatttatgaggagccataactttttctaaacattcattcattcaacaaatatttgctggacatcaatatattggagataacatgtgaagaagaaagaagggcacacactacacctttgtggagttttttgtctgatggggaagataaagtttaagcaaatggttgtagaaaaaccctgatgaacttaatggcagagaaatgtatccctccatttttacactgctataaagaattacctgagactaggtaatctataagggaaacaagcttaattaactcacagttacacatggttggggaggtctcaggaacttataatcatggcggaaggcaaaggggaagtaaggtacatcttacatggcggcaagagagagagagaatggagtggggggctgtcaaacactgttaaaccatcatatcttgtgagaactcactcactatcgtgagaacagcatgagggaaaccgtccccatgatccaatcacctcccaccttgtccctcccttgacacttggggattacaattcgatataagattttggtggggatacagagccaaaccatgtcaagaaactcttaggagtattgggaacaggtcccatggcatagtagtgaggyctgcttaaggaagtctttggctgttgaaccatgagttggccatgcaaaaatagtacagcttagtatttactgagtgtttatgtcatttactcctcttgacaagtggataaattgaggataaaagtggagtgaaggttttgctaaggcttctcacttgggtaccatgtactgagatggctgcaccagaataattacaggcctggggtgaagagagaagaaggcaaagtaaattgtggatgcgttaaagatgcctgtgagacatctaagtggaggtgtcaaacatgcaattagacattcatgtctgacattcagtatctcaggtaaggcttataaatatagacttggaatttatcagcattagaagccgtaggagtagatgatcttacccaggaagagatgacagcatgaggagaggaggaggcctaggacctagcctgtaaggacacagaacattaaaagatggttagaaggaaaggagctcataaaaaagttggagagaaccttaagtgtgagctaacataggagctagaagctataggacttattgtgtggtcaccaaaatcatgttctgctgtgagattgagcaaggtagggattgaaaatctccagatttatttcatgtatatcacataagcagagtaagaacagcttctgcggtttgtggagaggggccatggagtggggacatgctgtagtgtgagaaagtaagtagtgattcagatgtgaacagaaatagtatagttgtttcttcattgcaaagattgagagggaacagaaagatataaggtaacaaatatctagatggaattgtgaggttgaaggggattatttttgtttgtttgccatttgtttgcttgtttttaaagagagagccatctaagcacacatatattctggtgagaaggagccaacagaataggaaagggaatcatttgtgaagtgaggtctggagtccatgagacctgctggagaagacaggttacaggacataagggaaaagccatggctttctaatttattttaaactctaacctacagcaagaaatacatttacccggtacagtcatctctcagtattcatgggggattggtcccaggacccccagtgggatatcaaaatccaagaatgctcaaatccctgactaatggcatagtatttgcatgtaacctacacacatcctcctgtatacttagatcatctctagattacttataatacctaatacaatgtaaatgccaagtaaatagttgttcaactctatcatattgttatggaataatgataagaaaaatatctgtacatgttcagtacagacacaatcacccattttactttctccaaatattttctatccacagttggttgactccatggattcagaaccaatggagggccaactgtatatttatagaaacataaaactgtatgtttaaagtaacataaaaatatatgccatgaaagaaaagtttcacaaaattttactcttcctatgagcaatgtagtctgaacttttccattctatttaaacagagttgtttttattttatcatgaatcaccaaattgtttttatgtctgattgatgagctgaaacacatagtttaataaacactgggttaaaagataaaaggatagggctgggcacggtggctcacacctataatctcagcactttgggaggccgaggcggatggatcatttgagatcaggagtttgagagcagcctggccaacatggtgaaaccccgtctctgctaaaaatacaaaaattagccaggcacggtggtgcacacctgtaatcccagctcctcaggaggctgaggcaggagaattgcttgaatctgggaggcggaaagttgcagtgagccgtgattgcaccactgcactccaggctgggcgatggagtgagagtccgtttcaaaaaaaaaaaaaaagataaaaggataaaagatacaaagggaagaagggaaggctgccaggataatgggaggttggaaatgtttccttttaaggttatttgctcgctctctctctgaagacaaaaggacagtcacctgctgacacctaagtgtttgatgaagtctataaaggaaggctagaggagagagagaagcaaaggaaggctggaggagagagagaagcactgaaagagacatcgtggcaattggcatggcacatgggctagaaattaaaataggactcacggactgtgaaggaagcctggtttattttaggctgttgtctacgaatttgtagcagtaatgctccccctggctgtgtgaggacaactagcaattctcagaaccaaatgcaaattctgagaagccaggaagttagattcatcaagggtgaagatttctgccagactcttgttgagaacagtagatcaaagcaggtttgtatgttgctaggaggtggcttgtaaggaaatgaagaaagagggaggtgagaaagagattgtagagcagcccccagcctgggtgttctctgcagctgaagaatcgaagtgggctgaacaggtagaagctcctggtttgagaataggtagaagctcttgatttaagaataggttgtttctgattgttagagttcttccttgtgagtgaaactgaatttgcctccatattgattttgttggatcctaaagctaaatctagtttcttttgatagatggtcaaatatttgaggagggctaccttgttgatgctttatctcaaattttccccttcataattaaataatcatattcattttattgtttaatgtaactcagggatgtccagcttgcaccacgcagtttgttacactcggcacattctccagtatattcatatgtgccacccagaagttaatcaaacacggtattccagttacgacctcacctgcgtagtgtgtatgggaactgtaccctcacttgcactgccttaggatcttatacatttgccatcaatggcaagaatgcattaaattttcagccaggtcatgtcagctatcctgtattatactgttgacttttaattttttaattaagtatatgtcatcatttctataattcaagtcagaccattgccccaggctgaaatctttctaacatttgattctgtcatacactgttatctctttccatttgtgttaaccacaaacttaagtgtgattgatttctctgtttatctcagttggtagtgtgcagctgaaatttttataccctttcccagactggttaacctactttgttttcaatccatctaaacatacttttataaaactcatatttctcatctcctttcatgagattcttaaagaaatcaagatgttactgtgattgcttaaactcgaattctaactttggtaaaactgccaaagatggatgagtattcctcagtgatttgcttgataacccattttagactattgttgattattaatatcgaacttcctagcgggtagtttttggaagctgtctttcctcattttaaaaattagcatcccagttgtctggaactttcacttggccttcatggtttctyggtttaccaacagtcattctgcatccacggatgttacttttgctttgagtcttgatacttgagacttgaactcactttaagagactgttgtatgtgtcttcctccaccactgcaggtcccttggaaggcatcatttatatcttacttaggtttttgtttttcagttttaattgttttttaaacttaggaacacagagttgggttaatgataactctgaattcatgatacacagtcaytgttagtccactagtgtctacttttaaagttacttagtcatttctaataatgtagtaactacccataaacccacttctgacaagaaacaacctagagaatttacgtgttatcctatgggcttctcattaacctataccctgtctccccacacaaagaaaccatcattctaaaccttgtgctcaagatgcccttgcttttcttttcatgtagttttcatttatttatatatagatagataaattttcatatatatataatttaagttgttactgacttttaaaagggcagtaggctgtgtgtaatattttgggctctacttattgaattaatagtgttttctaagattcctccatacttttttgtgctgttggagttcatttttttttattgttgtgttatttccctttgggcagatataccagagcttatccatttacctttttcgttgatagacttttgtatnacctctgtgtttttgctaatgtgaacagggattgaatgcctattcttatccatttcacctatcttacaagagctacagggtgtacccattttcaaataaaggaacaaatgtcatactgttttccaaagttactgcatcaatggacattcttaacaacaatggttaagagagattctggtgatccacaccccctccaatatttgatatatgagttactgacttttgtcaaccaaatgggtatgaaatggtattttgctggagtcatgattttcatttctcttggctaggtacttttctgtattacaaacatcacttctttctgaaacaaaagagctgatgagtggttctgcacrtcctctctattatgatgagtacagcatctgctctaaatcatgtgcttactgctccttgttgaccatactttggtgataatttgaaaaatcattttacatctttgtatctttcaagccacacttcattctaaactctattcccctactcctatcatatatacttcctctttaaaaaatcctatggagaacttcagtgcatcccatcggtttgctgttgccacccctttttgtctgcatcatgcctaccctgctcgattccttagaatgtctctttaccagctgtcatccctcttggactatttgaagctgcttcaccccaacggtggttttaccaatttgaataaggtaacagtatggaggaagatatctgcaatgatatcacaaattaaacactcaacaatgttgctgctgttttgagtttccagctaagggaactctttcctcctagttctcctccttctcttattaactttttaaaatatttaagatacacatcgttatgcctagtgttccattctttcttggttaaaagtataaaatgctgcggtcacattcttatgagtttctctcttctgtctcacccatgagctctctgttagtcagatttaaatccacaatgaaagtttctgggttttgattccttagtcttctgcggagttatcaaatcagaaaggcaactaaggaatgcatgaaatatacttctgtggcagaatgaaattttcagcagatactggcaagctgaagagccctcattactgtgttatgtattcgtgctgccagttttgaattctgttgtggatacctgaatgatctgacatatcctccattttatttattttcttcgaaattatttattccacacctgcccctttatgtatttagcttattcaccttttccttcctggcaaaagaaggactcttccttgtctagaatttagcattctgatccagaaagccaaatcctgctacaggactgtctaatataacttcccatttgcttagcattatcatctatgtcacgtggatgccatttgctattgaagaacatatcttttgttccagtaaatccttctgtttctctacagtatattcaaaagctgctagaaatctgataccttttttgtttgtgtgatcttagcatattctcaagctaattagtagaagtttaaagtagtttttataggtttggtgaatttgtcagatacagtctgtacaccaagtaaattcaggtttaatagtttttaaaaatcacarattttaacttcattaggagcaaatctcattaaattttcctaggaagatttttttaaaacagttaaaatattttatttcaaaatacttttttattaaaawtttttttcagctagtgctttaaatggattatccctttgtacaaaagcaaacatggcttatgaattttatggcttaaaaacatatcattataatcccaaataacaatttgtctgaatgtattctttatctcaatccttgtgtctctcctatgtttctgaaggtcatgaaatttttatagaagactatgtctttgagaaaatgtaaaatttcatatccttgagacattgtatattagtgttctaatttgcatagagagtaagcatgcttgttatctgataaaattcctattctttttactcctatttactaatgcacactgctaattattgggaataatgggagatattagaataggtagtcttaaggagcagctaagcaaaattcctctgttttcgacattagatgtacagtatgtattgatggaggactgcagatttgccttccaaatctgttttgctaaagttctcatgagttcttattttttaaatcctggctgactaataacatgggagacagagcagcagaaactcaaaggagaacatttcctgctttctgagggaatcattaacatctttgcttttgtgatgaaatgtgcagtttaacatattacccagacaatgaaactgtcctaggcctgcgtccccacctttatttcctcctttgcaaactatgctcatgtgcctatcattataaacagaaagcgtggtgctatcatgataaacagaaagggtagtatatatttgttgaatgaatgaaagaatatgacaaaccttttagaatttatcacggagtgagtggaagggtcacattgtttaccttccctcccatccccagttcatctccatgcccagagtactgtgtctcaccgaattaaaaatatgtttatgatttgtagcttatatttcattatctgccttcatacaccccatggaaacattgaatgcttaccaagcagcagaaatacgtgtaagggttggaacaatctaactttgatgagctgtagggttcttcctactatagctattggttaatgaccaatttcttttggtcactattatactacagaccataataataatagcagctgagatgyattaaaagcatgtatttttcagactcttttttctttattttatttttttgagatggaggctcattctgtcacccaggctggaatgcaatggcacaatcttggctcactgcagcctccgcctcctgggttcaagcaattctcctgcctcagcctcccgagtagctggcattacaggtgcccgccaccatgcccagctaatatttgtatttttagtagagacagggtttcaccatgttgttcaggctggtctggaactcctgacctcaggtgatctgcccgctactgcctcccaaagtgctgggattacaggggtgagccacctcgcccggtctaattttaactaatggtcattatatttgcctgtattcgtgcattgcaatggcagcataaaaaaaagagaaaatccttttaaggtttgcagtttggtttgaatgaggcaaatgtatgaataagtagcgggtatagtatgatatggacctcatagttatctctgttacctataaaatatgtaatttaatattttatttttgtaaaagcactatatataattttcatgtcatgaattcattgattatgtcatctaagcattctatcttacatgtgtttaaacaaggttgatgataaattaatacaaatgatttgctcttctatgtctaatgttcttttgcactttctaaaatctcaacatattcctgtctcctttttttttttttttaaatatacagagttgtcatgatgaggaagatgacgatggtgaagaggaagtgaagagttttgaagtaagatggatctttctggatttgcctttctttctatcttgaaacattgtttcatagcttataactgacatttatgtttcttgcttcatggcttattgcagcttattgtgtcaaggaactgcatgtcagagctggatggacaaacctgagtcctaacatttgctgaagttaagaccaaggatcatagaatagttaaataatataatgaagcacatatgttcagaatgagtgttcctgagaaccctcagagatgagacggcttcaaattggtctcatctcagcgatgtggtctggaatttccaacagacgtgaggaaaatatttattgaagaacaacatgatgtcaagtttttcagtaaacccttggtttgatattttttcctgamtagaagtcttaaagatktggccttaaagacttctgcccaattagatcactcattccatgtacatatgcagatagtggcacacaacgcagtttgcttgcatgaggtaggagtccatatatccctaggactgtattgtagtttacaactattttctcaaatgctctcagcttttaaatgtcctacgtaatttgaaatgctgcttaatgttacttagcccaaaggaragttaatagtattttccccctttgcttatactgtactttcgttttttatgaggaaaagctagttgttgctaactaccgctttttttgtttatyggctctttttttgttttgttttgtttttttagaattttcataaagaaattaagtgcagggaaatagaaattagattctttttcttttccttttaatttacatgtctggactttgagctagaagtctggaaatatatcagtagccagcaatgagtctttaattaaagtggacccacaaaaacgtattagccaatgaataagctcagagcagtgaccttccaggatgcatttgttatgaacctctctgcagcattgargtcaatgtgtcaaaaatataaaaacaatctaatttgaggaacccatgactattgctggctgagaaaaatgccataagattaatttctgtatgatttctataatcttttctaatgtatatgttttctattctcaaagtcatctttattgataagaaagtgaggtcagtttagaatgagctgtgagcagcagataatattgtttttctgaagtgcacagcatttatagtctatccgttgtcttcagagcaattgtttattgctattttgcttcttgtcctcatccttccttaaggtcacaggatcccaacgcagcaaggtaaaactatatatatgtgtgtatttgtctgggtctgagtttcggtttcttgtgacatttacctttgttagacccaacatcttggattcttttgtgaaaaggaggtcttgaaaatctttctacaagtttgtagctccaatgcatttggtctcttcaggatcccttcctttgacacaagtttattcttcttgcaatttaaatgactcataatttgaaattttatcctccagctaactttgagctgcatactgtgctgggatmaaggagtccagccctttggatgacaaactttttaagccagggacttctcattttcggtgcaatgttctgaccttatccctcttgatgtttttcaacaccagttttattacttgaaaacagacatgataaatggtattgctggtgagattggaaagaagcctgcttttccattgtgctagtaatcacttcaattagtaactggagattatattccatgatttcaatattgatttcattgttgcattaaagggaagaactagatgactatttctctcttaatattttgaatastgggaacatttgctaaaagaaaacattttgatatagaattacaaaattacttacattaatatgaaccttgttaagcttatgttttattttcataaggctatatggtaggaaaatcaatcataaacattctgtgaagatgatacctataaagactttagttttgtttgtttgtttaaaaaaaaaaaaagctttttaggtggccaggtgcagaggcttacgcttgtaatcccagcactttgggaggctgaggcgggtggatcacttgagatcaggagtttgagaccagcctggccaatgtggtgaaacctcatctctactaaaaatacaaaaattagccgggcgtggtagtgcacgcctgtaatcccagctactggggaggccgaggcaggagaatcacttgaacctgggagaaggaggttgcagtgagccgagattgctccattgcactccagcctgggcgacaagagtgaaactccgtctcaacaacaacaaaaaagctttttagtttgtaagtgtaaactattctactttgccttctttttttaaaaaaaaaaaaagtgaaatatttgctgccaaaatgaattttagactgtcttgaagaaactattttaaaattcctttgtaattttttttttttttttttgagacagagtctcactgtgtcaggctggagtgcagtggcaggatctcagctcactgcaatctccacctcctgggttcaaacagttcccctgcctcagcctcccgagtagctaggactacagtggcgcgccaccacgcccggctaagctaattttttgtatttttagtagagacggggtttcaccatgttggccacaatggtctttatctcctgacctcatgatccacccatctgggcctcccaaagtgctgggattacagtcctgagccaccacgcccagccactttttaatttttttaactcactgttatagttggaggaatatatagttcttgtatcatcatccttgcaaatttcaaaatgtaaatcatgtatatactatcagatgcagctctgatccgatggatataatggttaatggcatacaatgggcctaacacttaataatatattatgggcttaaataatagataataatgggtataataagaatttggtagattttgattttttatcacgaattatttcatataaaatttatgtgaattgttgagggatgaaaatatgaagggctctcctaacattaagtaaagaactgatttcctaagtagcataaaagttaatgcctcaagaatgtgttgatagttgtatgatggggctggatggcagagaaggtgttgctagccaagaaaaccattttaccttgaaagaggaatgcagtttcagggagatcggtttgataaatagggtcaaatttagtgacattagaaaggctcctcattcagaaaagaagtccgaaagacgacaagtgatggcatcttaatatttagacrctaggattcaggccagactaaggacaagaagtcaaatgacatatggagcatgacctgagagaaagggctacctttgaacttagaatagtggacaagttcacatggtggtgaaacctggcaattaatcccaaaacagaggatacagaccagcagatatgactgtctcagcaagagacaggcttttaaagtgctgggaattgccacacatttataggtgtaatgcaggacaccagatttggggatttgcgcttcctaatgagatttttttttttttagtgatctccatctgatttgggactataatttataattcacacctaatttatgtaacatgctactcttaacaaaatactgtgtatgtggtatgaaatattacaaagctgagaaacagagatatatataattaattccctataaagatactcttctctgaggttgactatgtgacaccaacaaaaccactgaaaaatttattgtttataaatgtagtaatctaccatacttttacattgagatgtctatctgacataatttagacatagtctaatagtggagttattcacataagttacaaatatgaaaggctatttgtcagtttcaataattcttataacacattatatcaaataaatttggaaataacataaagtgtgtggtaattgaattctatccctatacctggttaattattaatatttgctatagtttctatttaaattctttccctgtaaaatattccataaagtcattgagaagagaaacgaagtaggtaaaaagaaaagtgctattatagggaaattttccatgaagaatgcagtaaagctcaaaaaacatggaaaacaaggaaagaggaatgatttgccagctcttttcttcttccatcatatatatatatgtattgttcatatgatcctgttaaattaaaacgtgcctgatttaacctgattacaaaattccctgtttcatctgtaatataggtaaatatgctttcctgtaactacttattaaataactttattgcatatttagttaattattttttaggtttggagctacttctctatcaaaagcattaaaaagaacagttaaatcttataaagaggccgatgttaattgaaagggaagaaatgttttaccagttacctgaaaaaaataattattggagttgaatgctagatttagctttttaatttttgctaagggaaataataataaataataatgtttcaagtcaaataacatcatttttctgagcattatgggtttttctcacctagatcaacaaagaactttgatactgcagtagaacacatttattaactatgattttattaaaaaaactcagaaacattctttagatggttacttcttttattgctcttctctaaaatctgagcatatagcattaaataataatttattgaaagcatttctttagaatattaaggtactgtagtatagatttgttgttgactgtgaaatctaaattaatgacagtgaagcttagataagcaagaggaatggaatgttaacttgtcttccagccatctttctcaaatactgggcaagctgcatcttccttttggcgaatgcccagtttctaattgacagatgaattatctgatgagtctgaggtcctatttttctgtactattgattaaagagaatttcttgtgtgttaaattctaaatatgcctgtggcagagttggtaattctgtaataaatacttaggaaaccagcatattctctcagatggatctgagacacaaataaaatattgtcatacctgctaacatactcaaaccaatacccagctcgtatcccacagtatgcaccattaagtatggaagaaccaatttaggtccaaaatgttttaaggattaatattatatagcactaccccaatgatgaaaagtttttgtctgacccgcccatgaatctaactttcaatagaatacaatgttttggtaatgctacaagaatgaatgggctgtaagatatactgccctccatggctacataatttgaactttgaatgggtttatttggtgcttttcatagtaacagcattttaaattaaaaagtcttcctgaatcttagcaaagagaatttttaaatgcataaaaattaaagatatagctacggatataaaatattgaaacaattattccttatatcaagaaaatttataattctttagttcctactgcaggaggtatatggtatccaaaatatggactaaagcattaagagttgcttttcatgctattgaatcatagaggggaaagagggaaggaattctgagggccagtgttctccagtactcacgctgattgccgcaatctgccaactacatttttatacaataaaattatgcatctcaagtgattatctcgtgtcttagctcagatttcctagaaaacacaggcaaaagcttacgtgctaacactttattgggggaaggggtgttaaaatcccagggaatgaagagttagggaaatagagaaacgatatggggaatgagggagggcaagtagaagatagagtgttcttgagctgatcacagctgttcagcagtacagtgtgttgctcagttgtgtgggatgcctcctgagagaccatatgcattacagaacagaacagtgcctccccggggaaggaggataggcactttatatgcaggttccttacatctcctgtcacttactggtcacagagtgttaatttcatcatacttcctgttgatattaaccagttcttccaggcaacccctggggaagccagagctgccttgaatacagcctgttgagtgtccaggcaccacagtctctccttatccattaacatggggtctccttggtgagtggtaatgatggtagcagctggctttcataagtacactgtgtgggggcagtcatttctagggccattctggctcagaagcaaggcaagtagccaaggcttagaaagaagggcataggttgggctggggggtcctggccttgacacaaggaagattcccagaaagcacaaccctctatattgtatatggtaattcatgcatatgagtatgtggaccaaaatagcagtctgtatagaagacatgcagctggccctctttatctgtggcttccacatccttggattcagccaactacagatttaaatattcgaaaaaatatttgcttctgtagccaacaagtacagacttttttcccttgtcactgttccctaaacaatacagcagaacaactacttacataacatttacrttgtgtattaagtatttattataagggatctagagattatttaaagtagacaggaggatgtacgtaggttawgtgcaaacactatarcattttatataagggacagatgttaatatctgtaggatgtcctggaaccagtcccccacagatactaggagacaaacatgtattgaagcagcatatatttgtgcacttttcatgtgcacagtaatgtaacttcatgtgttgtcatttaaaaaataatctcagttgaagcttatacaggagcagattatgtacagtaaatgcaaggcagcagactcattaagagcagacactcagatggacttcctgtgtttgaatcccagcttgaacttctagctgtgtgagcggaagcctcaatttttctatctataaagtgtggctaattatagtatctacttcacagggttgttatgaggactaaattagtcaatatatataaggcactcagaacattgactatcacataaccatctctaaatatttgctattattattattattattattaatcaatttcactttctctgctgaaaacaagtcagggaagcccatagataaacttttacagtgtggtgaacataaacaacacaacacaggagacctggattatcagccaggtgctgtgtgacctcaacctctctgtttctcagctttctgttctttgaacaaagagttttcaactagatgttctcagatgtcaaatctacccttaacagttgtgtggtttgctatccaggcataaattctcttcatttttaagggcaatttcgcagtttctctaattgcataagtattgatgaaagcatgcaagtttttatcactttttatcatttgtggaggattgaaaaagaaaataaactccctgtgttttagaacaggaatgtgacacaaaaatgttttatagaaaataatgtcagccaggtgcagtgtawcgtggctgtaatcccagcactttgggaggccgaggtgggtggatcacctgaggtcaggagttcaagaccagcccaggcaacatggtgaaatcccatctctrctaaaaatacaaaaattagctgggcatggtggcgggcgcctgtaatcccagctactcgggaggccgaggcacaggaatcgcttgaacccaggaggcggaggttgcagtgagccaagattacaccattgcactccaggctgggcagcagagtgagactccatctcaaaaaacaaaaaaagaaaaaagaaaagaaaatgtcttctgtacatacatacgtatcccaccttttcctagtttagtatttaaagaatcatggaactatacataacacagtaagctgaaggggaaaaaaaaactattgaaagacaaagagtagggccttccaagaatagaaagaaacccatgccatggagtcttgtcagtttgatgtgaattgtcagaatatttgactccaagctttctaggagccaacgtgaaattacatacatttcacataaattacatgaaatgacataaatgtaaattacataaatataggagccaatatgaaattacataaatttaataatataatgaactttatataatttatataatattcataaatttcataaagttcattataaatatcaatatcattaaatatagtatgtaatatataaaacattgatattaggtatattaaatataatactatttaaaatatagtcttcctgactgggaaaaacaaatttctraagtaaaattcaatagcatttttttcccctgaggatgacaaaaaatgtcctcaacaattcagttaacaccattttttgacaatttatacaatagagtccagttgtgcagatgctacctgaagatggattagcataaaatggctaccaagtatctggaagaattgaagaaatacatatgtaccacctttccagatggtctccagaaaaatcctcttcccagctagacagataattcttggcagggaatttgggactgtatcaaatacttggagtacagctgtttctcaagagttgatctggggtagggttaataaccattcatgaagatctagaattacaaagactagagcttctatagttgtgagttttcaaaattcaagtaatgagctgctgtgatccaatctatgatcaaagttattctgacttctcattttcccactaagtagtccaacactctggcgccctcatgacctaaccatagctttgtattcttagtggtcccaagttttcttcttgttcttattctctcttttgtcaggctatgccaggagagaaagaactgcatagtacttgctttctgtattccaggcagtatccagtgctttttaaggcttaaacaaataagtgggtaaatgaccgctgttttaaatcaatattgcatttagagataaactacattccctctaatgatgagtcaacttaactttgctaatttgatagcttctgattttagagtttctcattcttttctttccttgttataccttgttaattaagctttcagtggtatagtgtaaattgtgtcaactggaccctgaaatagaaaattatttcaacttagttgagttttattgcttttgcatagttttaaattagttctaaatatgctgtatccctgagaaataatattccacccaaaatgcaagtgtatataatattggaagaattaagctgtaaagtcacattacacagtatatctaacgtcaaagcctctagtgcattaactgaattacttgaccctggtttagtgtttcttttgtctctgtaggttagtcaaactttgataccatttttacagagtgttaaagagacagcattagaaactttgcttatcctatcaagaagcagaattctggaagatcattacactgtttgaaagatcagtaataaagagagtggataatgatgaaagatctgaacaaaaaattaaatgagctaaagcccacaatttgattattatttgtatatgtataattctgaagacctctttaaacatgaactgaaagacaaacttttagagctactaattttgtagcacttcaaacaaaaaagataacatttgtaatattttagattgtgatcacaaactataggatatcacatcatttagttctgtcatttattcatgcaaattttcttgaatacctattattttcagagaactgtactggatgtacagtatgtgtgtactggtgtggttaaaacaaagaaagcccgctctcttcatggatcttctaggaaacttcatgtttgtttgtttatttatttatttagaggcaatgtcttgctctgttgctcaggctggagtgcactggcgcaatcctggcctcaggtgattctcccacctgggcctacaggtgcacaccacgaagcctggctatttttagttttttgtagagacagggtcttgctatttgcccaggctggtctagagctcctgggctcaagcagtcctcccacttcagcctcccaaagtgctgaggttacaggcatgagccaccatgcctggctcatttatttaattaaaaaaaaaaaaagaaaatttaggaaccactcgttttaaacaaagttgtagtcttagtattttcccatcactgtgagtcaactctacagaaatgtagctaatctacatttttcaagaacttaaatacaacagaaaaaaataattgaagtagataagttgtctcttatccatacttttgacttcccttagtctgagttgacctgtttgtgctgcaaaccaaattattagtacaatttcactccctttcttcattgtccccattgttatccaattaaatcttctatttttctgtctttttatttcgtataatattgatattcaacatcaccttgtaggtcgtaactctcagatgccaattaaaaatatttcatgttgacttatgacgttactaaattatgggaaatttaaggagttttgttcctggatatttctattctcttataacttgctaccacctacagtttctgaggaaaatattatgaaaaccttttctacacttgttgaagtcatggaaatacaaacaaacaaacaaaagaacacaaagtagatgggctcattttgtatgatgcacagatgatagatttggtagattcagcctgtcagtcgctcaggttctgccccagaggtcaatgtagctgaggcaggtccttcagaaacaatgtaaattcctttcctgtaaccaggctgccctggtttaaaatatcttttcatctccattacaaagataaactattaggtcagtggcaaaaaccacaattacctttgcaccaacttaatattttctccatcgatgacgagcaagggacaattgtaattccccttatttcaatatttttttctcacataagacaagttgtcgaagaactaaatatagttgtttctcttcaagcctttctacttgtttccccaagtgttaaaagcttgacacactcttagacaaaatgaaataatattagcaatgttattacaaacttcagttataaccaaaagcaaatcatgatgtaaaatacttctgttcattaccagtgatttgaacatgggtctgaaatatgaccatattcgaccttggaaaaacctcctaacaagcttattaggatatgcactgataattcttggttgctcttggcaatcagaatgttttgcctaagggaaaatttaaattctggagctgctctttttttcctcaccttactgtgtaaccttgaaataaccttgaaataacacaaagactaaactgcaggtggtgtttatttaagagccttaggcagtttaagcagaagctggtgtgtcagagaactctattcttgaaaaggtgccttcaaggtgttattttcctgagtaagatgcttataaaagatctatctacaatttgtttagaaaagctaatctgcagtttaaaaaattgtttttacataattcatcttagtatctgaaaattttctggtttagctttcagagttttttttttttttttaatttataataaactttccctatgacagattaaattacatgcccagaagctgttctcaaagggcaaagtactggaaagaaataatattaaagaatcctgaagggagagcttccaatttcagttcaacaaagaataaattcaacagagaggttgacttgatctctatgaaatacagtatttttctgcgtctagatcagtatgtctttttggctcaatgtttttttttttttcaaatgactttcatcatcttcctcaaaacattgattattaaaatttagatgcgatgttaaaaaaaatgagtgacctgtccagggagtttatttttaagcaaggtagtctgagatcctgtctatttcttggtccttgtaaggttcatacatcatgtgttgatttcagttaggttaccgggaccttacaggctacactgcaagttgttctggcaggtctttaactgatcttcccccttttggagcacaaatggcaaattgttgttttgttctgttttttctcaagagtgtgtggcatgttgccatcttccatcttctgtgagtttcctgatgactgtctttatgtgttctattaggtcaatagaagaacttcttcctgactcccttgcctctttagttgatgaaaatgataggacagtttcatgagcgaataatttcttatcattttcttactgaaaaactctctcacaaaaggagctggttaagctttaagcgaaagttccacatggagctctggcaatgggaggaacataaaagattgttgggtctaaaaggaagaatcagatgttgctcatcagttttaaacaacacctgaagagcagacgaaagggtcctctttcagtttttctgaaactgtgttgtaatgacaaaatggttttgtgtgtctgtgtggttctgtttctgttttgtttttgacttcacaggaagaggtttaaacatgaaggcaaaccttatagatgttagcatggctacatataaagcaaagctgcctctttttttttcttttctctgcttccatttaggcctatcacataatttaagaaaacataaaattaaccacaggagcgctaactatagtgtgacaaaaaaaaccctgatcaattttgttttcgcagcacgatattatcaaagatttaagaaacaaatttgccagcctcggcgagaactctctggtaacagcataaatgtctgtgttggttgcttttgatttaaaggtttcttttttcatttgtttgagcccatttcttttccccctcctttwagttcactttatttttcatattctgtaactagcaagccttcattttttaaacctcttccatcttccagtgtctattttctgtattttggatggaaagtttatggcagcaaagctgtcattctggctacctctgctgcagctcttcctgctcttaggtcatatatgttttggccgttgtgtttatggacatgatactaattgactgtttcatgtcccattgactaagcttctctaccacgccatttgatggactcactgtcatagggctctatgcaactttcattctgcaacttatactgcttagttccttctcaattctccagtgaactggattgctcaagtgaatggtcataccagtcttgaacttgctgtgcctttatattttatttttattttcttctttatgttttcagtggtagcttaagtggaaaagaataaactccagccattgctccagcagtaccatgcagtatcgtttgttaccaccagagaatacaaaatataaaggcacattgcatctcttattctttgggggtgactggggagatctgtatcataaatccactacttcgttgaagcctaccttttgattcatatcagctttcaattttacttaaacttcaagacatctcagttaatgtttttctgtgattcagtgatactttgcaactcgagccatttgctgagcagtatcaagttatggccatggcatgggagattattcaaaacgtgacaaacttatgcacaaatgtataaatcagaaagtgcaagtttcattgatgaagtacagtacttcaaaactgtgatacaggctttgaatgaatcaaatcattaaaattgagaaaaaaaaatccatgctgataaaccagtaccaaaaacatatcaagaaaactataaagggggaaaaaaamcaatagttgaatatgttaataatatctgttgaagaacatcgttggtgttgaaatggtccataatgttgtcatagagcccatacatgaagagatgactaaaaatatggtctgtagaaatctgttgtgcttactgataccctcaacataaatggttgggatttgtgttcaggaaaaagaaatggaaaagcaaaagcttctataccagcaagcccgactccacgatcgtggcgcggctgagatggtgctacagacaatcagtgccagcaaaggtaaggttccttgagttcccctcacgagtgtctgttcttcagatttcctcgttgctctcaaggtcctccctcatttcaattccactgactcatttagtcctggggtttctggttcatgactatatcaggtgcctattcacaaatacgagctctcattgtttacggagaccaatgttaattttttttttcagagtcttactatacagattcattttcattctgttctttaagttttggaaactatgttataactaaaccttagcagactgatcctataaaatgggggtgcacgagctttttctttaaggctggagagtcaatatgttcagcttcgagggttatgcaacctgtcacagctcttcaactgtgccatgttagcaggaaagctgccagacacaataagtacacaaacagcgtggctgtgttccaaaaaaactttatttacacacactttgtttacacacataggtggcaagctgtaatttttttatgtaatttatggtattttgccatagtttgctgactcttgatacaaatatggagacttttaaagtgagacttttttaacaattaagatgctgtcatatatctcagtagccagctgtttcaagatgattttttgtacattcataatagcttctttgtgaaaacattttaaatataatttgtaatggaatggaaaagtaatggtggtacattctgttattaggtacccttgtccttgaatagaagattatttatatttctaggataaatagargtgaacaatgaaaaatgaaatatgttacactaaataaaattttgttattatccgaattacttaaaattgagaatagtctgcctaataaaccagaygtcaaacatattaaaataaaagtgatacaatgaaaatgatgaaagttcttcatatataatactgttgagggaagagggagagaaattttctttaaagaaacttttaagtagctcatacttattttaatgtttattaaacacataattaatcttgaatcttaataatttcaggtctcgatatttcaaaatcagttgtcttcctattctgttacttctatatcttcttatggtttcagttcttagatattatagagaatttattaaaaatgttgatgccaaatatgcattattattatgttagcattttttggaacataagtcagtctccctatgccattaaacagattgcctgggggggcataataataattttaaaagtgcagcattggaggtagaataggttaatatagaaggcgaaatgatataaggaacactacttttttatatttcttaggtgaaactggaccaatggtagcagctactctgaaacttggaattgctattttaaatggtgggaactccacagtacagcaggtaacagcttccagtcattcatataatgtacttttcagacaaatggaccatatagtaaagaactatttgttgtaaaatgttttattttctatgtacaatatggctcaattttagtttaccacagtactgaagagagagcaaaagagggaaaaagtaattatgtgatagtgttacaaatccaaacataaaatgatgtcaaaatatctgaaaacatcaagtgtgaccttttatcatgtcaaatgaattctggtgctgaggtatgaaccactctctcaccatgcgtttaccaaactgtggctctctggttatggaacctggcaggggtaaccagctcgttctgttcccagaataagtgattatatagctttgaaaaaagaaaaaataaaacacttaatctctccaaaacatttatcaaaawataatgtctcctgcttatgttttacttaagaagaccctcattacttagtatgtatattcagaagtccttagatccagagacaggagtgagagatcctgtaaygtatacttcttgtctatgtggaacttgtctgttttctttataacttcaaatatatatcccaccatctcctttgatcctgyaagccacatccctttgtttgaaaaaaaacaatgattgtttcattttttatttgaccaaaagttatcacaccccccgtaaatggctatatggttttgtgtctatgtgcgtatatatgtgtgtctgtgtatctgtgtatcatacctacactacgtgtatatttgctatttgtgcatttgtgcgtatatatatatatgcatatgtgcatatactttgtgcatatgtatcctttacatatttagtttgtattgccttcgctatctgaaaaagattactactaaaatttagtctgcttaactgagccctttttagaacagcattgataacaggaattgttctgctcttccagatttgtagagaagcagtattcttatttccttaaacctttgagcatgctttctatcatcttgtatgtgcttttacatttgaaatctctaataaattttaaccatgtcagaaatagctgtttcgttatgctatgtaacagtaagctaacaagacaaagcattgctttagcgtttttttacatgtatgtttaaccaaaattttgaccatagattctggacgtcattctgagaacaaaggagaacattttaatagccaaatgattcctattgttttttcaatttacagactatggtaatggaaactgaatttccgtctatagcattagcatatggcagtcacaactctcagattgtaatgctgttcggggttttttgttttgttttgttttgttttttgagatgtcacccaggctggagtgcagtggcaccatctctgctcactgcaacctccgcctcctgggttcaagcaattctcctgcctcagcctcccgagtagctgggactacaggcacatgctaccacgcccagctgatttttgtattttttagtagagacggggtttcactmtgttggtcaggctggtctcaaactcctgacctcatgatttgcccacctcagcctcccaaagtgctgggattacrggtgtgaaccaccacgcccagcctgtaatgctgtttaatgacatcaccttggtatggaaacctgtgaataacatctataggaattttcttcccagttaacttgcactagagtatctgaatcaccaaattactttaagagtgaccaggagagaattaagagtaatatattacccctgacatttttggtgcttgtggtgatgtgtaaggcaactaaccctcttattccaagtttgcgtaactatcttgcttcgaggtgtgttcctacttcatgataaagatggcattagtcatgtttgtacgcagtgaatattttctgtctattctagaatggaaagcctgttttggttgtttatttatttaacaaacaataagatttttgttcagtggccacgtggtttctataattcccatagaaaatgcttgactacctcaaggagaaaaaggatgtgggcttctttcagagcctggccggcctgatgcagtcatgtaggtaaggactcacttccttcttgggggttctactcagtggttgtattttttcgaagcatttgtttcttactctgacgataattgcacatagragaatagttaatgattaacaacactttaaagtgggataatcggcagtgtcttgttttctatcttgttttaaggggttggtaatatcataattaataacttacagaatggtaataatgtcttaaaatagctttcccatagtactataatcccagagctttgggaggaagagataggaggatcccttgaggccagcaattcaagaccagcctgggtaacagggcaagactccatctctacaaaaagattaaaaaaaaaaaaaaagctaggcatggtggcaacacacctgtaccatagtcctagctactcaggaggctgaggtgggaagatttcttgagcccagaagttcaaggctgtagtgagctatgatagtgccactactgcagcctgagagacagagtgagaccctgtctctaatttaaaaaaaaaaaaaaaaaaaaaaaagccttccccgtgtttaaatagggatcttggagaattagcgtatattctgcatacttgaaaatgagttgtgtatgcttttttaaaaaagaaaattctatttagttttatttaggagcttgtaggccatttctcattttgtgactaaatgatcactaactcatttgcggtaatcgttttccattttttttcaagatttaaaatcattcagacagcatttgactaaggaatctgacacacatktaatgtaasaagctattccaactgcaaaaacataattattagaattttatttctgcacatctgctrgctttgtaatgtactccccatgttgaaacctaagaatgctttcatgtttgacttycacatggatcatttcagtgtaggcccaggggagacactagtctgccactaagaaaatacggttggtamgcdatgaatggagacatgttttcagtgtacgttaacatttgcttcatcttccaagatatatggtgtttagatgtttgctctcctgagcaaagaaaatgttctattagtcctctaaatgtttttttttcccttgttattatagtgtccttgacctaaatgcatttgagcgacaaaacaaagctgaaggtcttgggatggtgacagaggaaggatcaggtattaatgacttacattaaaaggatcacctgtctcccttccctccctgaaacgagtcaattatcaattacctttcaagtagagagataagaagttattttaaagttgatgaaatgcttacatgactcatttcaaagttcatagttggacaccggtcacaccctaaaaccaaccttccacgccggtcattaactccttgtgtgccagccccattgccagctgcctttccccttattgggttttcaatgaggaataatggttgaatgaaggatcaagatcctttattagagaattttctgggaaatcataaaccacatagatgaacctttcaagaacatttgactttctttggccactttagcaaagtcgggctctcagattcttttatttccttaggatagtgatcctttgagctccttcagtctactctcattcctattccctcctcttcccttccagcacagtgatcctcaaatccatacatgtttgcaagtctagattgatgaaagaaattagagaccagttatttcgcttaaataattctgtgcacaaaagcagagatacacgtgatcttagaatttttctctctctaaatagatgctggtataaactagaaagtttagcatacaatgcatttaaagcagaaataacctttgctgccctttcattttagcagtatttattaagaaaaaaatcttcagtagtttttggtttgatttgtttttattcttttgtgtttgatttttaaactagttttactcagggccccgtatgtttatctgtttttgtttgttttgtgtggtttggatatgtcttcttgtcaattattagttttggaacattgggtcttttattggactaatcttatttcaaaaaataattttttctcccatctgccatttgtagtctatgtttatttctctgaaatattttaggattaactaatttatctatgtatttttttsttctcacaaataggaaaaacaacatttcttattgtattttaaagtttattattaatacccattctgacattgctaccactatgtggctcccgtgtttattttattttctgcttgacatttggatgtacaagtgcagtcaacaaaaataagtcatatggttactaaactgagttagctaccttcaagaacaatcactgacaccattctataacttcttaggttttctggcctaaggttctggcctgaggttcagaaggccagacctttgagaaaagtcaccagtgccactctaaaccgacttaggttttctggacccatctgcagaacttggagccactgcagatctcagggcctatcacctgcctacctccagcatctctccaaagtcctaagcaattttcagctataaaatttctaaaaatgaatgaagtctctgtccaaagcctgacttccctgtcttggaattagaaatcaatttcattttcccctgtagttattacctaatgttccaggggctcctaccrcaaatccatagtcattcttagtcgctgttcatatcagctcccaaaaggaatagcagccacttaggttattttcctcagcctcctttccttcgtcaggcggatatgggttggaataacattttcgagtcccaagtcagaaagaactttgtgagagtgaccattctgatgtgagaattctttatatctctcaaaaggagattgatttaacttgtgcattctttttcaacacataagaaaataattactcaaaccgattaacacgttttgtattatttccttacaaacagaaaaacaaaagcaaaatctcaactttttttctttttccccatttccttttctttcgactactgtaaatgtactaccctcccttcctcagtcatcactcatgagcgtggtaattattaaaaatgaactgtcttttgtttatttgctcctttatttgttgttagctttgtgtacagacttgatagtgacaatttccgtgcattcttttttgttgtagactgttttaacaagtagattatttaatttccatcattatgcatcctgttattttttacatttacacatctagctttcctccttttctttcttgtttctatgaggatgtacagttattagtatgtcagatatgaaggggcaacaagcatttcaattacattttcggattggttttgttgcttttcagttaaaaacctttctggtgggcccagcgtctgcaactgttgtgtcaatgaatgatcctagaatgtgtgccctagtctccctgtggcgtttctgtcttgaacatgctgtggctttatggctgtactgattggtgcacgggaaatcggtgacagattcaaggaggacgtgacaagctgagtctcctcctcgccagtgtgctctgccagttgccttccaagtattgggaggcctactgagtttttcctctattcctttgaaaatctgacagattacaaatcatttaacatcaaaactaatttttatttttgtgactgaattcaaagagcagtagaaacaatagcaactatttgctcctcaaactaatatactagcaaagatgccattagtaattcaaagtrgtttctgaaagacattctatgcagtggaaataagggatgagattttagatagtacttaggacgccaacaaggcttccaagattaaattgtgctttctgaatacatgctattgccttaatcaagagacctattaggagcatatgtaagggccactcattagctctattaatattacagtatcttccagattgttttaagaattcctatacagacacttttggcatgtttaaatatatctgttttgagatcactcttttgtttaagattctgtaaaagttaaaaaagcctacatacactcacaggagaagaaaaatcaatcatccctcttggaagggatagaaaaggctgaaaaagcaacatctgttagtgatgtcacttgcttcaacacttgaggctcagagagcatgggcttagcactgagaaaataatctgttgtayctgaatcttctacatccttgcccactgtttttattaagctaagtctcttcctaatgacgacaatatgaccataaattatatagccatggaaaaygtataagctcaaatgcatgaacttttgatacccgcaaccctccaatgaggtagctattaccttgattttatagataaggaaacagaggaacagaaaggtttcttgacttgtccaaggtcacacagctaagcggcaaggctgagactgaaatgcaggcattctgcctcccactgtttaatttacagatcccacgagtgaagtcacttccctcccatctgttcatattcttcaggggcttacttcatgtctaccattgccttaggtagcatttttttttttttttttttttttttttgccccttgacttactgtttgtttatttaattctttttgagatggagtgtcgctctgtcgcccaggctggagtgcagtggtrcagtctcatctcactgcaacctccacttcccgggttcaagcgattctcctgcctcagcctctcaagtagctgggattacaggcctgccaccacaattggctaatttttgtatttttagtagagatggggtttcaccatcttggccaggctggtcttgaactcctgacctcaggtgacccacccacctcggcctcccaaactgctgggattacaggcatgagccaccacgcctggctgccccttgacttattgttctttgtccctttccgggacacaaatctcttgccaaattttgcatttattgttaagtttcaaaattgcttttgaactttttatggttacaaatgttcctaacctggtattgagatgccatgaggaactgtgtgtttctttgaggtttgtatctacagmtttcagatgaattatttatactgttttttttctgctgccattattgtcatgcaagtttgacctctgtctcctttttatactaagtttctctcatttctgtgaaagcctgagcctcccagttttttttttttaaaggttcttcaggaaatgtgttagtttgtaatatgctcaatgctgtctgtgctgtatattttatatttatatgtgttttcttttaatgacttaatcaaattcaaaaacaaaacctgtatgaatatttaaaatgtcattccattcttggatttttaatttgcttttttatcagaaccattaaccccattaccaaatcattatgacattgaaagtgcaatttttctgctttcaaaattcttcttggaatatagcagaagatactgaattttttttttttgatcatgaggtagtcctggacttcataaaagcaagacaaagttttgaagttgatcygatttcttaaaaatagtttgattttttaaaatcctcactacaacattaactaccaattaaccttccccacctttctatctgtatctgataatttgtttcactgaggttcttactgatatatttataatcatctaatcaaatttatgtgaagttgaagcaacacaaattgattaagcaaagagattgaattgatctttaagtattggttaccctaactttttgatactcttgattgcttaattatttatgggctaccttttcctcaagattttccaaatactttcacaagtgtagtttagtattctgtgtaccttattctgccattcttgtgggtaaattttctcttcaaggaaaacttgtgatgttggttcgtggcaccaaatacattttcttaacatccttgcagtttttaaactttgaagcgctcatttaaattagagtgactattatgtgctagatggtgtcctaggcattggaagcaatttaggagctcagtactgtgtagacagacttgtaaacaaataaattcagaacaatgctttatgcatataaaggaatttaggtggaagtacttagcggctgggatgttgcggggctgggggagacgtgtagtctgaattaggaatcaagggggtggataaggaaggcaaagacattccaatgcgagggaacagcatatgcaaagttcaaggtaccaaacacggcagagaatggtgactaagctgttatgaaggaaaatgatcagactagaggatggaaacatagtacctgggaggccacgaaggaccttctctgccctgccaaggaatctacactttatctgaggccacagagagccattaaataccacttaagtgatactatgtgtaktgttaaatgatccacctagaattgagttcctaacgtttattgttcaaataatgcttctgctagactccactaacagtacaatgtagatttcccatttctcagtcatgctactaaatagaaattgactcctccaaagatagtgaccagcattattatttccttcatkgcagtgggagagctctgagttatgcctaatgatagattagagggaattcttcagagtagacttttcacagttaaagaaatccatctgtttaccagggaagtaggataattggaatggtgcttttgaaaaattactcataggcaacattgtgtgagataggtatcagagtctcaaggcagggagatcagtaaggatgctgatgaatggaatggatgaaaaacaataagaatttcagtgagagtcttgacagctgagaagcttaggctttggctataagagaaacaagatgcaatcacatttgaaagcaaagggattttttttccgctccagctagtttaatttgtttaagaagttaacagaatgtactttaattctgttatccgtgggacaaacctgatttatttcacatagtggtcattttcgttgtcttggcatcggaaataggaatgcattgtatacaacgctgtcagactgttaactaaattttaacaaatgcactctggaatttatagaacaaacaactgtcatacaacctacagaaattctgtaacttagaaatttaggtcatttgacctaaggcttcacatttatttcttttgtgctttgtagacttcaaagcacttttaattgtttgatccaattcgattctcccaacagtcctatgaaatgaggagttgaggagtttgttcatctctatatcaacatgatgaaacgaaggctcagaacagtgaactgactaaagtcatatatctagcaatggttttcctttgattcttaaattgatgaaaacaagcacgagttcacaattatttaaataacatatagtatatgtaatgataatcagtcaaagattttattagttactgatggtaactttacaacatttagaaactatagcacactgaattcagaaaggccatataatactgaaattatctgtttatttcctgtatcttccattagactgtgaacttcttcaggttcgagattatgttcacctcacaaggtgcctgccatagaagagtgaatgttttttgaagtttactggaatcatactctttaccagtcgatagctatatgacattggttatttaatttctcagttgttcactgaaccacaaaatggcattacatttagctaagttacaggattataataaacctgaattgaaatgatgagataacatatctagcacaatgcctagcacactgtagtcactaactaaatattaactgtaagcttattttttaaatttactttttaattgaattgtaatataattgaagcagtcatacttaagccgcttaaacagcaatattaaaacttcccacatggaataaaatacctgacttttcactattttaaaatatytgtagcatttttcagttttggcaagatgcagaatcgatcttaaggtcccctcaagatccacaatcagcataatttcctctatggcagcggggtgctttagagtcaactgtatagattataggggatcctttaatgtggccagtcctatgcttcatgaatcaccttttacctgtgcattattgtagatattgacatgacaggacctgataaagagaatgttagtcttttggagtctatttatcctaattcaccaattgtaggtagaatagtagcctttaaaaatttgttaactttattagatctttaaaataggacttactgtttcactcgtagcttggttaaataaaatctacctagattatttccaagaaaaaaatgtaattttgagaacattttaatccatgaagatggtgttcaggagatataaacacaattaataaattcaaatcgctttattcagcagcttggcatgatgtttccatattttttagtattattgccactgcacctaatatattaacctttccacaatttacaaaaaattaccacagattatgaagagccagtgacgtagacagggtacgtgttatctttattttatacaagagaaaatgaaggcgcaaagaatgaactcagaagcagcaacaatattgaaatacctctccctttattacagtattaaaaatcttaagcctcttataacaatgaaaccaaagggatgtccttcacaatatgtaccttgagccctcaagcagcaattacaaatcataatttaccagtgtaagmgcactttcaactacatgttactccattccgttatttgttattgatcttagtttccatcttacaatggaatttcttttgcacacatcacaaaatagactgctgatcctgtaccttctgcagacataaagccatcatccatctctgttactctaccacttatttgcagcatgggcaatggcagcattttaatcagataggaatgtcttcattaagcaacagtaccccagcttatacctggtatcacctgatggtaaacgaaggcctgactcgtcccctccctaacccctcccctcttcccattgttctgcgatgtacggtgtgtccttatataagtgaaattacttgtacgtgtttcggtatacagtcaagaaaatactgtgtgtgtcgacaataaataaaaccttatgttataaatcattatgcattgtgcmgagcatttttaggtacacaggtagattatatttatttcagtgtttttctgaatactttctagtaagggttacttctttcacgaatatatgaacacttaaagtgtgtacatggtttattgaattgatttgttttttgaaaaaaaaattgcagatgggctcacagggaaagaatcaataagcctatgtaatgaactcataatattttgatttaaatatcactttaaagactcttctgattaaggtgactcatgaaaatggaactaagtatcaccaatgaagagtttagtgcctttatttgcctaaaacattctccctttcgtttcctatcctgtcgtgaatttaaacactgaggaatggacttatcagccaattatgggagattcaacacaataatgtgcctataacacttaaacttgccacgtctgatttgcatacgtggtgattttcacatagtcaccaaatttcatatcttgtgggctaacagggaaatgagtacagtgattttatgtactttttttaatgtttatattagttttcaaaatggttttgcttcctaaccctaccattatatgaagcctctcactttgaaagtcacagactgcggactggtaagtccatcagctctctgtcactgtgatcattcataatttcacttaaagtaaacatacgatcattgcctcattttctttctcagccgaaagtatttatttccattctgtaaaaagttctttttttttttttttttaatatgtaagtccattcattcactggcttttttgtcattttgctttctaaacaaatttagattttggagcagctgctcgtaatgtggaagtgttttttttccccccacggacactttctgtcttgaaaatcagcttcatttgtgtggtgctgttctgtgtttgtttctttccttgtgtttttgctttcaaagtaacttgtgatcaagatacctttaaattgaaatacaagtaaactgagcccttttctgaggttttctccttgccccaaaaatatttgttagtgttggatgatgcagaggaacttctgtaactaggggacgcctttcttttcacctttctttattagttttagctctcacaacacgagccaccaaagtctgtcttttggtttcatatttagaattaaggttgtttgccatttcctcctcctatggaagtaatgctcaaaccagtcacatctctattttagatttcagaaatctttctttttattcagtagtcaacctgataacaaagttaattaaaacaagttaatcaacaattttctagtgatttacagctttcacaaaaatccatgaattattctttaataaaagaaactcttggccccgcttttttggatacacagaatgctttccattgaatcatttggtcataatccgggtacaaagcaaatttaacacgtgtgagagatgcagaaaaaggtcccttctatgtacaccttgccaaatacaagaacataaagaaagaaaaaagcaaagtttaagcctttaggtcatttgtaaaatgttgccaaacccatgctgctacttttaacagagaagtctgagttttaaaattcaaacgttcttttcttacaaagaaaaagtgcctctatctgccaagcgcatgatcttatgagcttcagatagaaaagtggctatgacttgtgactgtttttggttcagaacaatgctagatcaacatgcaagttgtatggaggtggggacagaaagggagcggcaggctggggtggctggtaatgtttgatccctctggatttcccacaggagaaaaggttctgcaggacgatgagttcacctgtgacctcttccgattcctgcaactactctgtgagggacacaactcaggtttgtgagtccccggaacttctgatgatactaaggcataaataatgttttcaagccagtaataacaagagcctgttagttccaattatgcatcgttctagagacaacaaatcattctagagcatgactctgcattgggaactgggacgttttatatattgcttccctgctttcacagtcctcggatatccatttcacttgagtcttatcaatagttttgatgttagggaagacacatgaggctgggtgcggtggctcacctgtaatcccaacactttgggaggccgaggtgggaggattgcttgaacctaggagtcccaatatcagcctaggaaacatagcgagacccccatctctacaaaaaatttaaaaaattatccagacatggtggtgcgtgctcatagtcccatctacttgggaggctggggcaggaggattgcttgaggccaggagttcgaggctgcagtgagctgtgattgccccactgcactggagcttaggcaacacagcaagatcctgtctctcaataaaaaaaaaaaaagacagaggatttatgaaaaacatataaatagttatagagtaatatagagtatcatttcttttgcaccacttctctttaccttgagcgtatacatacttcattgtactagttaacataatgtatctccattacttgtttacacatctaactctctactaggcttgtgcacccctgaaggcaggaactccatcttaattttatcttggctgaccccagcactttgcacagtactgaggaacaagtgattaatgaataaataatttccttcttayatcctcaaggatagcaaccttttttagtcattcgtttgcccagagctctagaactaggaatgaagaaactgatattagcaatatctgagacaaaaattgaatattgatcatcaatggagcacccagatacacttttggggtgatcactttttatggaaaatataaattattttcatagtaaaactattagataaaaacactgcactaacccacaatgattttgccatagaaagcatttgcctttggagttcttagaatgactcaacttgaacttctgagcaagcattaataacatttttttatcttgcatagattttcagaattatctgagaactcagactggcaataatacaactgtcaacataattatctccactgtagactacctactgagagttcaggtatgttgctttccatattagtaacaaattaaaagggttggtatgttgaaacaatacggcagagttttaatgtgttttggtttataactagaaaggagtttttgagatagtttatctctgatcacaatctctcagcaattcttagagcaaaacagccactgttatctctgcttctgaacgtgcctcctacttttgctcattattttatttctgtaagtagagatttttcgcctgtttttttagcttgatggtattttaaagtcattttcattttgtaaagcacttttatactctgctccttcttctacagttgttagacaaattggggaagaatatttggaacatttgtaggaataggaaagaaaggctttgcaactactaccatacacttaaatttgatagtctaaggtcagttcttttcagctgtcctaatatttgcattaattttcacaccacattgcttaaaaatctctgatattgtaatcatatttgagaacgttaatcaaactgaattgaagacgtaggcctcttaaataatgagagccctgtacaacttttttcccctcattttatttataagctaaaccaggcacagtatttttaaaactataaatgcagactttcagctttttccttaatctttgagtgtgtaaaatcacaactttttttttttctaactgaaagcttaatgtggtgggggaaggtgcattttgaagtcagtacaccaagaagtgttgctgaaaacacatttgtcattttaaaaattgtctgaaaacccaaatgtagttcacagctcaactaaattggattatttacttatccaaccaaaatatctttaaaatgtatgttattgttaaatacatctggtttatagagattgatcttatttagatatttgtttacaattgttagtatttacaaatttacaagcaatccaaccagtttcctcagggacagacacaaaagccatggatatcagcgagttctcactgatgcaatgttattagttttgttggagaaaatggaggccagatgtcggtaccccaaaaaagattgttccatgattcatctattttctgtgctcacatagtaaacatctaattttgctcatgcataaatatgctccagtcttaatgaattcttatgtttgtgaagttcaaggttatcagacagtaatttttaaagctaagttttcttcttcttgtcttctcttcagttgttagctatatctaagaaggaggttcacatattgtatgtttaggaaattcattgaagaatgatatttacttcacagatatttttgtttgctaccatatctattatttaaaatacttctcaggcataaagtccaagactggttagtcaatggtaactttagaatgtgacttgataataaataatatcatctctatttcccaggaatcaattagtgacttttattggtattactctgggaaagatgttattgatgaacaaggacaacggaatttctccaaagctatccaagtggcaaaacaagtctttaacactcttacagagtatattcaggtaaacatttaaacatggctgctatctgtagcactgaactccatagaaaaatgcagtatatctagagtagtttccatatctcctattgacccctttctgagtttctttgcaaattgctacaattaaaatattaggttgagatgtgaatttatatggaatgaaattgcttcaccatttggcaggttgagatatgattaactccttagaggcatgggctgtgatgttagctctattgtacctccagggcctggtatatgtattaagcacttagtaaatattaaggaaggaagggcgagcaggcacaacatttaaccattctttctggtattccactaaaagtgggaagaagtttcatagaaacttaagaaagagaagagtgtttgaaaacatcgcatatgtatattatagataaaattccaaatagcgtatagaatattcttttcttttttacatcgatttgttttatattctccttggactaagcttctagccttaacttcagattttttaaagattttataaaattctgggtttttctgcaatcaccaaaactttgcttgatgaccagtcatctttcctttctgtcttgtctcagtggacatgttaccctgaatcattcactatgtttgacgtgccccatgctaaggataaaacaggagggagaaacttataattggctttgtgagactaaacataagcttgtggggagaagaaaggttaagttaaaaataaattgtatcccaggagcgtaacagttacagctgtttgagtaaataaatgactcatggccaagtacagccaaccaagagtaagtgctgtagaggtaggaagacctcctccaggctcactcgcctctgcattcagtcccttggaagcatggcactttttctattttttgccttggtggggaagaggaaccttatttyagcatttccagatggaaacgtcacacttgataattctaataacatttcctttaaaatcaaataaaagtgaaagcttaagtcagttttggtctactcacagtcccatttccttacctctcctggcttccattattgccttagtattctcatgcatgcctagaatgataccagtacaacaacattcatgtgtcatgtcctgaataaataacaggattgactgatgacattagcaagccactggattttccagaaatgggaatcaggatgatttctataatatattccaaatgaaacataaccgccatttcagctaagagtaggcatttcttggttcctaaaataattgagattcctgaatgtatcgaaatctagaagcayccattgagctcttactatatgcaaaactctakggtgttgtcatagaacacagatttctatgtgaatgtttaaaggatattggataaagtcacatggcttattgtgcttggttcaataagamccamaaaaaaaaaaaaaaaaaacagaagtaacaagtaacttctcttattacttattttttatatgacattttaaaataacaatcgtatctgaaatatgtattttggaataattttagtattcagaaaagttgtaaagatagcacagagggtttctgtatatgattcacccagctttccccaatgctgacattttatatactcatggcacatttgtcaaaactaagaaattaacatcggcacatcctgttaactaaattacaggctttattttgattttactagtttttccattcacgttatttgttttttaaaattctgggatacaatccaagttaccacattacatctagtgaaatatattttagagaagcttgccttagtggtatatctgctgataaatattgatactatgaagataagcttatcattagcttcgtgctgcttctggactgccttttagattacagcattgcgtattgctttattattcaaacttctactaactatagaaagttatataagggggagatccaacaccattgaaataaatggaattacctataagattgtaatcccaatttaataaaaggggaagaattgtttgagtaagaggacgttgtattgtcaaggttcctacagtaagaccatgaggtagttgttgagaaaagagaaagtttgatctgtccttggcacaggtccttctggtagttagcaagggttttccatgttgcaggtacatacgtcatgagaaaaagaaagcaaggcaccagactagggagtttacagctcccagaagctgaggacctaaggttgagcaagccctgcaaaggacattctgtgtgtttcaggttttaaaagaaaaaatgggtactttggctttgggcttgcaactctgtcacatgagggttggccaaacaacttttggtcacctaggggttgcaggagagcacaaccccttgtaatgcttcaacttttgatttaaaccttaactatcacgggaagaaaattatttctgacttgaagaaaaaacaagtttattttcctaaaaatggctatctagtgttcacctcttgcacttttcctcctccctaatttatatgccattggaataccaagctgacactgaacatcgaccacaggaaaatcctaaagatctattgctttcaaaccagagctgtaatagccagttgggactaattataaccagggatgaaggaaactataaagctactatatctggtacattaaatgagctggatttaatgacctacagattaaaataacctgattccttctcaccactgtcccttcagacttgctttgtcgaccatttctttaccactagaaggaatcttgtgcactggccactttcagataaataaaatcatgtcagtcactttgtcacaagaataatctcatttcagtaaaacttccgcttacccttgggcctgattttcagctggaaaacctagagtgagggtgcaggcaagaactcccatctggatgttgttcattctggaaggagtccaatctaggcwttttttactctcccccctgaaggttcttytctctctctctctctctctttccctttcccctcctgrttaaccccaggcttcctctgggttgttgctgtgggagagaggaggtatggggaaggaaaggtctcttccggggcacatgtaatcccagagtgcaccacggagctggccctctggtgtggtgtgttgtatttttttatctaacgtgcgagcctggccctcttagtcctccagtgcctggaaatgactcttttcccatccagtttaaagttattcaatcagacctcaagcatctggtggcccccatccaccttggaattatgttaccatttcagactgatttcagatggggcagaatggccccttcctgagtagtccatataagaaacacatctttcttgtcatatgctgtctgtcacactttctaataccagaccttatgctacccaacttcagaagacagaaactgagctcacatgatggttctcctgaagcctcttctctcacttggtgtaaggggatgcagaagtaacgaaatggagaggctcagcacacggagaaccccctccaaagtttcccccttttcaatttcaacccctttgtatccttagagtggaaatatctatttttagtcaccccttttgcaggtagtgagtctactgcttttgtagacagtcagtcgttctcatagtcatctgagaatacatagtcagtatctcagctgtagggcctcaagagatgctgagacaggaaaaagttctatttcaacatcttggatctggccatctcttccaatcacttgtttctagcataagatctgaaatgtttttatgtggcctgcaatttaaaggtattataagttatttgcctaaaggaatgaaggaatttgaagttaagaacggtattttatgtacttttttcctttctaagtaaaatccctgttatttattttcatggttgatgtagatgggtttacaaaactgaatgatggtagaattttttcattggaaagtgaaaacagaaattggctccatgaaaacagtctgcgtgctacagcggatccaccctagtattgatacttcagaagtgtcagctaagagaacaaagttaggtttgttaaaagataaacttaggcacaataacatcttaacaagtttatctgagcattcaactatttatgaatggagcaataccagaacactaatggttcagcacttcaccaaaggtgggggcacttttataaggcgttcctggaagcaagacaagaaatttgattggtaaaagtgcaaagtccctagttagaggttagttggcagtttctgactggtgaactctctagttagaagttagctggcagtttctgattggttaagcttaaatttacattgagttgggatttggttttcttagggaggaacgcaagacactggagccatctcagcctaatgactcccaattagttattttaaccacttccaattgccttggattctggattcgtgaaattaataagcaagtattactcttttaaaacacgtcattggttgtaccatttgtaaaatagttgttcaattaagaaaacgttgaagaggattttttttctctatatgaatgctttatccaggttactatttaggagtaagaggtaatcacctctcatctaaagcatattctcagattcttttgaatacaaaatagtgactattgattgatttgactaaatagccaaagcacccagaccttattttttttcctctaaatagaggagatcaaagccagaccaaaaaaaaaaaaatgattcacagaatataaaaatccttgagaaactttttttggaatatattaaatgttttaaagaggaacgtatttctctcttaaggatcattatcatcactgtatctccttctttcactttgagttcctatcttttcagataacgtgctagcagtgaaatatatcagcactaagtcaacttttcccctgttattgtacagtttgttttggcaaataaattatgaggaataattgccgtttgtctgtttatgctccagggtccttgcactgggaatcaacagagtttggcacacagcaggctgtgggatgctgtggtcggctttcttcatgtgtttgcccatatgcagatgaagctgtcgcaggtaaactaactaactgccttcctctctcttaaatgacaaactggagactgtaatcatcagcaaattaaacatgctttttgatgttagaatattatctttttaaaatcactttatcacttgtctttttaagatcattttatcatgcctcttttgctcattaaaattttttaaaaataaaaaccgttatgtaacctgagaatagacaggagtcattattcaaatttgagacaatggatattaagaaattgaatgtaatggacaaatgaaacagtcgagtccccaaacattgtacatttcacaagcttcatcttcctggccattgctcactggaattttccttccccttacagataattgaaataggttttataatctgttacaagggagacaattttgttacagggtcttaaacaagcagatgttctcagtrgggcgatgcttacccctaaccagtgtatttaattttgtgacagagaaaaagtagctattatatggataagcaaatgaagaataaacagattttctaccatgtttaatgttaacttgagggctattgaaaaatatcagcttgtttgctcactgctgtatttgtttcatttgaaacaaaaagatacacaaacagaaaagttcttgtgaatgtgtctcttcaatgcagtgaattttgatggtataatctgagaccttcagagtgtgagtatttgccaggcggtcaggtagaagaatgtcagattaaaagacagaatgctgtcattctaattcctgagctgccatgacttgttccacccgtgtgggccaggtctctcttccctsaggccttgtttctctgcagtaaagtgaagaacctatccctcaggcctgcaaatgacaatatgcaggatatattgtcaaagatcagcagggctggatgctagtaaaagtggtaaggatacatcttaatgtcaaagataaacaaagctggatactagttaagcgaataaggacagattttaatcagtagtgctattgcaacaaggaaaaagagttcagcatgaactgaacctgatttgatttgtacagaggtgactgggaatattaatgggagaatgaagattagagaaggggcgagcaggagctcagtagagtcagaggagtgaaaagttacaaaaggttcattggtgtaaatgtgattagaccagctatgtctgctaactggcaattgtcaaagttagttagttaggattctgtcctccagagtccttatccttagatgttgtctggaactgttgatttttttatcagcctggagttttcccaggcaggtactttagtggagggctgggatcatccttgacatgcagtcttgaacagttagaaactatatttattagtgtttgttcaagtctttatagaccaaagttgaggccaagttgagaagagggctcagaggtacctgactagagtttggtcaaggagagaatgtcagtatggagttattggtgacttcagcccaatagggaaattccagtctttcatttaatcactagggatattttggtaagtaaaggaaaccaacatatgaaccaaatgtagaccctcacaagagagttctcatcctgatgtttttccatcagggtattaacatctggtgctacctagcacttgttcatggtttataaagtttccataacagctatttagaaagaaaacgtctcatcttcccaacactgtatagcttcatatgtaccaaaaatgccttgtacaaattttttaaagaatagtttaaaaaatggatgagatgtaaagttgtgcagatgtaagtatgatccgtatttccagggactatagctaagcgtagtgatgtttagacacaatatgtctttgaaaaagaatgtttctttatggtaaaaaatcaaaagcaaaaacaaaattttaaccagagtaatactggaaagcttaatcaaattggtaaataagatacattgtgtaatatttattagtacaatgttgtactaataggtaatacctgtgtaggtttttggttaatttatctaacaaatacatttataagtttatcttctatggtgcttatatgcctatatttcttctatatgaagttgatttttacataatagcacctagaagaagttagaaagttagaagaaaaaaatgcaggcttttcaaataaaagataagatagatgtcaaatgtgcagaaggtcttgagtcttgcttggcattggagaatattccactgttgtggttctttcatattattgctatatatgttcattgtcggtacaaatactttttttttttctgagacccagtcttgctctgtcacccgggctggagtgcagtggcgtgatctctgctcactgcaacctccgcctcccaggctcaagcaattcttgtgcctcagcctcctgagtagctgagactacaggtgtgtactaccctgcccagataaatttttgtatttttagtagagacgggtttttgccatgttgcccagcctggtctcaaactcctgagctcaggtgatctgtgcgcctcggcctcccaaagaagtgctaggattacaggcatgagccactgcgcccggcctacaaatactttaaagaacatgagttgaaatcagtaatactttttaattgtaaagtataactatttttaatatttggccctcctttagttccataatgcttcaagtggttactatttattgccagagcagcatcctttttgtgagaataagtatgatgttcctgctgcatagttttcttgtattatctcaaatgcaatgttcatattttcaggattccagtcaaattgagctattaaaagaattaatggatctgcagaaggatatggtggtcatgttgctgtccatgttagaaggtagttttgatttatacttttaaattctctttattatcttatttaaaggatcagcatgggcttatggaatcagagtgtagcatagaataaaatagcactcagatatgatagatgccttggatttcttgctggcttattattctttttctcacattagtttttttttaaagggagatcctgcatatctcagtttacatatctacaaaatgaaaatagtagtactttataacagtacttttcatttcatagtgatatcgtaaaaagtaagctctccagtctataaagaatattttatttgttagtgtgtttgtccataatcagtgggggtttcggacatttgggtaacagtcagctgtgtaagctgctgctttgaaaagaccacagagtcactcctttgggttcttaaagccgtggcactgctgggaaagcctctgtcccccagggcagctggcagtggtagtcttgttctccccaccacagcctcagttttaattttctctttttttttcttcccagcttattttgttattgcttttttttttttttttttttcctgtagcaggcaggaaatgtagcagttaagagcttgggctccaaatccaccgccagagtttaaatcctggcttccttacctctgggaggtatgacccttggacaagctacatctccattttttcagtttcctcctctgcaaaatagaaatgatagatattgatatgagaattcagtggaatcctataaatacaaccaaaacaactaagaaatgtttggtattacggtgcctatcactttttcttaacttcttcctattttctctccgtgtctgccatacatggcgtaactccacttcagttaactgaggcagctgtcacgcctcgtgctaggactttgaagtggcagcatctgcttaaagcccttagtcggtggcaacagtagccactttataccctttaaacacaggatccatttttccatgcatggccccgattcgaattttgggttaaatrctaacaaacagcaacaataataactgcagtagcagcaaccacagcagtgacttaaaaccagcctcataacgtgccagatactgaattaagtacttatttaatcctagtaacaagtttatcagttcaatggtaatattatctcaagtttgcaaatgaggaaactgaggtacagagaggctaagaaatctgcccaggttgctgagcacattaagcctggattcaaacccaacaatgtggctccagatcccacactcttaacaccacggtgcttactgcttctccgattgactctgtggacctctgaccagcgacctttcttctcctgcctgtctttatgwtatatagcacgttctgttcaatgaataaaagcattctgtgatcctgtagttcaggaatctgccattttctaacaactatacacactgactcatgaagaaatgtagaaaggtgcttttcattatgaatcagaaaaagcgtacagtttgctctcaggatctggtctgaagacctggcactaacctttaataaktaagtcacaatgggcccattaatttagtcttgttgaacttcaatttcctcatcggtaaaattagggttaacaaaaagtacctgccttacatatgaacattaaatcagatattgtctatgatagtgatttttcaactctaaagggctgagcaaatgtttatttttattattaatatgaaacgattttagtttctggctctttggctcattttctttatctaaaacatgttgcttctttgattgaggggaaaaatgtcaacttttgttgaaatattttatgtgtgtcagtctaattgctctgtaaatagggttatgcatgtttgtgtaatcattttttaaactatagtttataaataattatctttttatagagtgagagataaacagggacatatccttgattcagatgttattaaagatctacattgttatcttctgtatgatcactgattttgttagtttattttaaacaaatgcaactgcyttaccaccaggtaatgttgttaatggaacgattggcaaacagatggtggatatgcttgtggaatcttccaacaacgtggagatgattctcaaattttttgacatgttcttaaaactaaaggatttgacgtcgtctgatacttttaaagaatatgaccccgatggcaagggagtcatttccaagagggacttccacaaagcgatggagagccataagcactacacgcagtcagaaacggaatttcttttgtcttgtgcggagacggatgagaatgaaaccctcgactacgaagagttcgtcaaacgcttccacgaacctgcgaaggacatcggcttcaacgtcgccgtccttctgacaaacctctctgagcacatgcccaacgatacccgacttcagacttttctggaattagcagagagcgtcctgaattatttccagccctttctgggccgcatcgaaatcatgggaagcgccaaacgcatcgagagggtctattttgaaatcagtgagtccagccgaacccagtgggagaagccccaggtcaaggagtccaaaagacagttcatatttgacgtggtcaacgaaggcggagagaaagagaagatggaactctttgtgaacttctgcgaggacaccatctttgaaatgcagctggcggctcagatctcggagtcggacttgaacgagaggtcagcgaataaggaagaaagcgagaaggagaggccggaagagcaggggccgaggatggctttcttctccattctgacggtcaggtcggccctgtttgcgctcaggtacaatatcttgacccttatgcgaatgctcagtctgaagagcctgaagaagcagatgaaaaaagtaaaaaagatgaccgtgaaggacatggtcacggccttcttttcatcctactggagtattttcatgaccctcttgcacttcgtggccagcgttttcagaggctttttccgcatcatttgcagcctgctgcttgggggaagcctcgtcgaaggtgctaaaaagatcaaagttgcagaactgttagccaacatgccagaccccactcaggatgaggttagaggagatggggaggagggagagaggaaacccctggaagccgccctgccctccgaggatctgaccgacttaaaggagctgacagaggaaagtgaccttctttcggacatctttggcctggatctgaagagagaaggaggacagtacaaactgattcctcataatccaaatgctgggctcagtgacctcatgagcaacccagtccccatgcctgaggtgcaggaaaaatttcaggtaatttatctctaagtcacagcagcattctctctggacttcaggtgggtataataaatgatcattagaccaggtttcatgctagtgccagaacggtgttacctatgtgacttgaatttccaaagagaaatgctttttggtagacaaagttagtgtttttaagagtccttatgaattattaaattatcttaaactattatggtgtaagcttcagtacccaccctaactgtagcctacatctttctccacgtttatataattttatatgcacatttgaaaagttgggaaaagaaagaaaacttttagatacctgtaagtggcattattctcacagagcattgaaattttctcctctgttctgtgattttctttggcatgttttcattgtatgttctttgtagtcattagtccatagagccatcattccatccatgaatatggcatattttccaagtgtctgacagacaccactgggtatcatagggaattcaaaggtaagatggggtcactgccttcaaattaccttaaaaagtttattccagagataaaactaacacacatgaagaaactagaaaagggttaactgtgaaatagtataggcagggcagtaggggttgcttatgttgagaaaatggcaatgccgctatggtttaaagtagttagataagaatgaagaggtaggacttaaactggcattgaaggatgagtaagattttagtaggtgcttaagataaagaaggatatttctgaaatgagaaaagagagtgaaaaggagtccagaaagtttgtccctgctgctggtgcagtaggtcagtgtgcagaagaagcgggagatgtttggccctataaaatgaaaaacacgtggcgcttttatcgtggtataagcaagagggtatcttatataggttatggtttgacacatggtcacatggctccctcaattcattcaaaggtgatgggtaatcctggttttcttttccccattgactcattcaaggaacagaaggcaaaagaagaagaaaaggaagaaaaagaagaaaccaaatctgaacctgaaaaagccgagtatgtatagtttgcatatacttttccttcgtttcagtttgtcattacatctctttttcttgtactctgtctttgggagctgcaagggagaatctcatattgtcaaggagccacagaactaattgtgccatctccgtggagaggctctgacagcgaggacctcaggccatgggcagggatcactgtagacgcccccggggctgccagtctagtcttttcctctcattccatggggacctccatttgtgtgattccctctcagcaggaaagactccagtgattgcatggaatgctgtttgtaagaggactcagggccacaattctgtctttaaaaatcactcatgtctttctgtcctttccaagaagggaggaaacaaacattccaaatgcgctttcatagaatcctgtggagtggtgctccttaaaccatagacccaggaccacatgcataaaagtccccgggagagttggttaaaacaaacattcctgggccccaagccatagatcctgcctcagcaggtctggtgtggggcctgggagccttcattttcaccaacactcctgggatcaacgcagcaataaaaaagagctggatgtgaggcgatgaaaatgcataactccctcataacaccaggtttctctgaataatcgaagcctacatctttctccacgtttatagaattttatacgcacatttgaaaagttgggggaagaaagaaaggaagcttttaggtgcctgtagtgccactattctcccatagcattgaaattttctcctctattctgttattttctttggtctgttttcatcgttatgtttttgtagtcagcactattcattgtcatagatctcacactattgggtcagttgtaaaaatggccccataaaaagtagacacaaataacagcaagacaggcatttcaatggcaattctttaactaatatatacctcatatgagttaagattaagtatagcttatatatattaatatttctggtttatgtattaatacatatgacttcactttaatttaatgaaggactgatattttgcacctaaaggatatcaaatgtcaattcttctaattccattattgttggaattaatatatcattactataattcactttattttatttaataaaattaattacaattaatatatgtcagagtataatgatacactttatacatgtgaacaattaagtgtgtaggcctctgattttaaatcttaatggaaaatgttaaaaattgtgcattaaaattataggctgggcgtggtggctcacacctgtaatcccagcactttgggaggccgaggcgggcggatcataaggtcaggagttcaagaccagcctggccaacatggcgaaaccccatctctactaaaaatgtaaaaaaaagttagctgggcatggtgtcacatgcctataatcccagctacttggaagactgaggcaggagaatcacttgaacccgggagctggaggttgcagtgagctgagatggcgcccctgcattccagcctgggtgacagagcgagactctgtctcaaaaacaaaaaaaaaaaaaaaaaaaaaggattgaaattataatttaaaaatagggtatgtgggacagtcatagcaaaatcattcatcattcttcatttttttaatgtttcattgcagaattggaaggaatctgctatgcataaagattcttcaagcctataaaatgtcctctatatttcaacttcacagaattacccatctccaggggactgtgatcaacagaaaatcctacccctgattctaaaattcagaatattatcattcaccggaaaagaaattagttttcaaaagtaatatgatggcctaaaatatttgttcacttgggtaattttccrcaacacccgtttagttctttagtttctggagagcttatgttttgtttgtttgttttcataggggagaagatggagaaaaagaagagaaagccaaggaagacaagggcaaacaaaagttgaggcagcttcacacacacagatacggagaaccagaagtgccagagtcagcattctggaagaaaatcatagcatatcaacagaaacttctagtaagatgttttagartgaatattgttactgatatagtgcaataccrtaataatttaggctcagtaaatgtttgctgacctctccctgagtggcagttagggaaccaggttagtccagcacatgtttgatttgctcattgtagtgtgtttatcttttatagtgaatgtctctggcccaccgctccctactgtcaaacccataacctctactcatgttcacactccctgaaaccctttcatttggttcctgccaggacagtgctcccagtgtctgcccacaaagacattaggacaagtgaataaacatagtctaaggacctgcaacagattttaaagcaagatgtgccttctaggacacaagtaattcaaaaatgttccagaactagattagtcagtatttctataacatcaccgttttacttaaaaatccaggtataaaaatattagctaattgagccatagtcagtatttctataacatcacccttttacttaaaaatccaggtataaaaatattagctaattgagccactttccattgataataagaaggtctattcaaaattgttctttaagagagggattacagttctttatatactgtcctgtacattttacagaggtgttcccctaattagtaaagcacacattcatatttggaaaacaaaaggtatagctctctctatgtctattcatatttatcttgaaattcttaaaaatattgtttgaaaggcctttattaacatgcatgtgtaatgtcacatgtatacacatatatgtgtctcctatccttttcctccatgcttatctcctatccttttcctcctttataaaaattaaacatatgtgtatatatgtataatttttataattatatgtgtatatatgtataattatatgtgtgtatatatgcataatttttataaatttttataatttttataagggaggaaaaggataggggataagcatgtagaatccacctacaagaggtactgaccagtgatgttagacctagaatttaagaacaacaaccctcataagaaagccatttgaacagcagagtcatatttagtgttttttagcccttgrgaaatcaaaaattgacaactcagaacctcaatgaactatagaatttcacctataaggaaagtggactgtcctcagtaattatatattctaaatgcttatctttaaacatggttatgtattatatattttatgcaaatatattttaatttagttgtaactacatttcctaaaccatcttgtattttccctatattgtttaatacagagttcactgaacagaaatgtttcctagataactaactctgaataattcctaatttggtatgccataatggcttccatggctgcaggtatagttctattataggtcatggctgcaggtatagttctattataggtcatggctgcaggtatagttctattataggtggtttaaaggttgaatgggcgctgcagcaccccagtgggttcctgaagaatgtgtttaactacagttgtgtaaaccaagtagttgagattttgcttccagctttcactgtgtcagggttcacatgttctgttgtctctgcacagctcctcccttttcctgcatctctttgctatctttctcggctcaccgatttgcatgcacatgaccagtcatggccacatccgtctaacaaaggccccttttcccctaagtgagagctcagcctagctaactcagcctctgtgacccagatccaccttccaaggacaaccagtgaaactgacgcagtctgggtgtggtggacagccttgttctaataagctctggcagtaaagatggggtcctgtgtggggaaatgacacgaacagagatgggctgtgtacacagaggggaatatcattctgaggtgttacattttgatgtagctttattatggtaaatcccctgacatatccacttaaattatattgacatctcccacttaatattaaaacaaatgcttaatgtccaccataacctattactttaaacccacttctctaggctttattttttcccagcccaataaattgtaccagctgttcccttagttgctgaggctcccaaattcagaaggtatcatctttgaaccctctctttcccaccttaaatacaacccaacgataattattctcagttgttccaaatacatcgagtctgcccagttcttgccatctccacaggtaccattaagtccaatccaccaccatgaacctcacctctgcctgacgtcttgtactaactttctaacgggtcctcttgctttcactgttgttccactgctatcagttttcacatagtagctggagtgggccttccaaatcataatccaactgcaccaagtcctcctgaaatcctctaatagcttcccatcccacctagaataaaataataattatactggaatattacatttattatagataatcaacataataattatattaataacgaactttccctatattaactcatttcatcttcaaagcacacttaagagttaaggtcttttgttattcccacttcgcatgcagatgagcagagtgatgctacagaaaagattaagtcatttgtccatatcccacactaggaaatggagggaggcaggcttcatatccaggcaatgaggcctcggaggttgtaaactgaaccaccacactgtcaaagacaagacaaccttttatcagaagcctacaaaaccctgccccctgctcacctgtctgatcacatccccctgccacccccacacatcagtctcccttcttctcactgtgtttccttctatttctcaaacacaccaacatcactcctaactcagggcctctgcccttgttgctcctctctttgacacactctttctttccccaaatatttgtatgacttgctccccgcttgtgcattcaggcctctctgttcaaagcttacctcctgagataaaccttcccagaccaacaccatctaaaatagcacccctattccctaagctcctaacccgatgtagttttcttcttagcatttaacattctctgaaattatgtttttcacttgcgggtatgcttttttattctttstctcctccatggtggcagaaatgttctccctcacttttaggtctgcagcaccaagaatggtgcttgaaacagtaggcttgcgatcaattgtttggggtaaatgaatgaatgctttatttaaattgactgcaggtttcaagcctgttgattcagtgaccttttcataatgtttttcaccctcagaactattttgctcgcaacttttacaacatgagaatgttagccttatttgtcgcatttgctatcaatttcatcttgctcttttataaggtacgtacatctcactgttttaattactggtataaaactccaaatagaaatgaatgtaaagatttcacgatgaacgtatctactactgctagtgaacatgtctaaacctattatgaaatactggtgcctaggcactgatatcactgttatctaggaaggcaagatagatttgttcctgagaagtgagaaatgcctcaactgaagggcatttgatttagcagagggcttccccacagtattcccagcctaatttagctgaatatcttatttgtgactatgcctgggtgtggcataccgtattatattacattcttttgtaattgagaagagagcttagccatctaattttttagcatgcattggaatcctcagaatttttggttgaataagaatgaattttaaaagtatgttcattacttgcctttggtttttgaaaagctatcgtttttagcctttgctattagtcctttcattatgcagtgacttcacatccaactatttgctgaaaaggctgtatttcttttgtcttttgcttgcaatggtatcttagatgcagcaaactgactctactttaaatgctttgaatcaggtctccacttcttctgtggttgaaggaaaggagctccccacgagaagttcaagtgaaaatgccaaagtgacaagcctggacagcagctcccatagaatcatcgcagttcactatgtactagaggagagcagcggctacatggagcccacgttgcgtatcttagctattctgcacacggtcatttctttcttctgcatcattggatactactgcttgaaagtaagatagtaaggcaccaaggtacctgtgtgtgtgtgtgtgtgtgtgtgcgcgcgtgtgtgtgtgtgtgtgtgtgtgtgtgtgtgtgtgtgtgtgtgtgtgtgtgtgttttgcaggctggacttctggggaagcagattctgagctggaaactttgtgcacaaagtttctgagggaatgctccatgaatcaacatgcatggggcaaatggaggaaggatgggacagaggggaaagctgggctactgtagacagacacagcaggtgccgtctccaaagctgggatgccccttcagggctgtcctggcctggggcattggagcctggcctttttatgtctacattgactagtctgccctgggaaggggctatggccatgagctgtcttaaagtagctttctttcatatactgataattattcacatagagaatttcgcctataacttggccctacagaagtgagctcacccacccactatgtctcatggtaatgcagtgatacttggtgtattaagacttatagaaatatattgtgtcaatcctgggagtcattttattgttttattatgagggaagtatctactgctattcttggcagaaatgcctcatgatttgtcacacttcacccagaaaataatgcagctttatccccagaggcctgccaagggaacaatataatttggtgaatagaacccaagataatctctctgagtgctcagggctgcccattacctgtccaaacctctttatcttttcctagcaaggtgcttttttactgtaatgcctttatttcactttcactgtcctctgcctctggttataaatcttgcagaagacgtgtgaaaaaccagggctcagagtaaaagactagaatgtaaagagttattcaggaactcctttcctcccgtttattctgttttatgggagtgcatattcttggctatttccagaatatcagtgtctatctgctatctgtgccttgtgtaaagtctgtccgtgtaaaaagagaatcattatgttctagaraatcattatgttctggaaatattttgacaaactgacagatttttgctgatgtcgaaattaaaatttatctcaaaatagtatgtggtgatgctgagcatgaaattattaaagaggtttctcaaataaaactgcactttagtagcatgcatttgggaacattgctgcaattgctaaattttatttcattcattcatgttgagagatatatgtaaacaaaatgattttgcataatcatcttttcatctttgaagtttaaaaatgatttcaytagtgtaattatctataagaccctatgtgtttaaaaacatatgcatatatgtaatatctattctatcttctgtttttccaaaaccttctagatgcttcttcctgcttgaatatagctgattcattttcattccatttttaccttcctagaagtacacaggaaatatttctttccaaaagctgttttgtaaagatagtgaccacaagatatgccagtaaatctaaactaattttaacatatttatttttcctgtgtaggtcccattggttatttttaagcgagaaaaggaagtggcacggaaattggaatttgatgggctttatattacagaacagccttcagaagatgatattaaaggccagtgggatagactcgtaatcaacacacagtgagtaaatacttatatgagactttctgcactcaaaaatttcagacatgaaaatatttggttggagttcctgcagatttgtcaaaagtttagcagaggtgaataatagttatatattcagccaagaaaaatctaaagactcagtgctgtccaactcttaatggtggatgtcctcaatttttgccctctgagttctgaattccttaattaaaaatggcttagagttcatttccacagcactgatggaacttcacatccattactcagcgttcagggatgtgtgtagcaggaagtgcatgacctgcaggcagggttatctcatccaaaagcggaggaggcaaaaattattcattaacgaaaaagttgtagcattaaaggaaaatacattgaattttacaccttgaatatatctgagttatcaactttcagtaccatcaagcaccctagcatgaaactaactaaatattaggacacggtgtaaaatgtaagacagaaaaacaaatgctttttctatccaataaacatttagccctgtgagatcaagacccaaactactagctgctgttctgagtataagtccatcacaaaagtataatttttcactgtaaaaagaattagtgcaatagttgtaatagtttatatttactattcgagtgaaatctttttaaaattgtgattagttttgctaattaaaaagtcatttgctaatgggttccgagttgtcaaayggagattatttatacatgatacatgtttatcctaaatgctaaatgttttgtttagcaattctaccattaacactaatttctaagcaagtcagtccctttaggcaaactctctatgtattagtgaagacgctagagttgtgctttgctgctatgctcgaagtttctgtgaggataagtggtgggaaagagatttttttcttcatgggaaaaacaatgacaggtttctagatactttaatttttaaaggcaattgataaacaggtctatgtactgatatgttataaacaaataaatataacaatgctacctaataaatatgctcatattcttctccattaaagtatcagcttataatcttttgtatatatttacatgttaatatttaaaataatattcaaatacctatgatgcaggaaattatgtgatgttagccaaattcattgtaagtttacgtggcaggatatatgtttacatattattttaagtatgccatatatcccaaatgatatgttattatttgtcattaaaaataatactatttacttctatgcttttgtatattttaggtcatttcccaacaactactgggacaaatttgttaaaagaaaggtaatattacttggaatcctctacatttttcttaaagcacagtttagatttttatttgatgtgattcagatgtagaataagatattgaggtataatttatctgcctattaatgtctccatttttttttttttaatttttgagatggagtctcactccgtcacccaggctggagtgcagtagcgcgatctcagctcactgcaacctcagctgcccagttcaagcaattctcctgcctcagtctcccgagtggctgggattccaggcgcctgccaccacacccggctaatttttgtatttttttttagtcgagatggggtttcgccatgttggcctggctggtctctgactcctgacctcaggtgatctgcccgccttgacctaccaaagtgctgggattaaaggcatgagccaccacatccggccaaatatgaatttcaagaatagcacataatggccgggcgcggtggctcacgcctgtatgtatatacaggtatgtatgtgtgtgtgtgtgtatatatatatatatatatatatatatacacacatatatatatacacacatatatgcacacatatcacgtacatatgtatgtgtgcatatgtgtacatatgtatgtatatgtgtatatacatatataaatgtgtacatgtacatatatgtatatttgtaaatgtacatatatatttttttactttgttagaagcaatgtgttcgatttttatgtggaggaggtacaagtgttttgttccctcgtgacctggcatcttgagtcgcactgcgctagtgcatctgaggacacccaaattaggcaaaagctgtgaaagaataattttaaaatggttttaaatagataatttgaacattttattcctattatttaatggaataaggaagaagcttctaaattattaaagcaagagtttcttgctttaatgaagaaaactctatatctgtagtcaaataaataggtaaaccataatggcagctaatcctgttcctggatttcccgctatggtacctaatttgtcctgcagggaatgtgaggacacagtcccgagagaatcccccggctcaaatcagcccagcccatttttagcactgtgagaataatgcaaaacaaatggttttaattaacctaagtagttcatgttcataggctctttcttttggtttcttttaatttacttgattgcatacattcagaaaaagccaatttttatatctgttaatcccttcttttcatcagtatatttccttcttcattcacttcaatcttgttcagtatatttccttcttcattcacttcaatcttgtattttcacattctgtctccttttctaatcttttctcctgtatagtggactccttttttgctaccagtgatctctcctcctgcttgtctttaattgcttttcctgttccctccattttctttttttgtttttgagacagagtctcactctgttgcccaggctggagtgcaatggcatgatttcagctcactgcaatctccacctcctgggttcaagtgattctcctacctcagtctcccaagtagctgggattacaggtgtctaccaccatgcctggctaatttttgtatatttagtaaagacaaggtctcaccatgttggccaagctgtctcgaactcctgacctcaaatgatccacccacctcggcctcccaaagtgctgggattacaggagtgagccaccactcctggcctccattttcattactgtgtaagactcactcaggaggtatatgaaccagaggccaagaagagctgtatcccagagttggacataactgagctcacaggggagctgtgagcacatccaagccctgctctaaaaacatgacaaatgggcaaagccaggcagatgggacagaagagaaataagcaaggaagctgaaggggattgttaagaattattctaatgattgatagacatggaatcaatactagatgctaattaaaatgaggatggtgacaaggttgcaggtcctggtgttttactgaagaattgctggggtcaggatactcaggggagtgggttagaaagatgggcattgtggccagagagttgaagggttgaaattgagaccatggaaggatgccacccctgtgatgtgccccctattgkcatgcagaggtctatgcagaagatcattggctggggagtcaggcatggcctggttgcttcctggacccatctcttgctgagtttagcaaacttaggcacattacatgaagttttctaaggtacagtttctttatctgcagaatatcaataacrtgaaacctacatattgtgacagtcacatggaatgaagcataatttctggcacaaagtattaatttagtaaaggtcgttctcattccatttccctccatttcttatgcttttatttcagctcatcatcttctttggtatgactccctctcttgaatgagagagaaatcttgttcctcagataggtattatgtaagatgctgtgaatttgtttagaccttaagcagtgtgatcacagaaggtgagccacacactagattttaagtgattgttagggcaaatatacagtaagtataaaaataattagatgttttatacacacatatagatgatgttacttaatggttgaagccaacaaaatgctttttctcataccccaaggttatggataaatatggagagttctacggccgagacagaatcagtgaattacttggcatggacaaggcagctctggacttcagtgatgccagagaaaagaagaagccaaagaaagacagctccttatcagctgtgtaagtgttacttcggctctatcctacagacttagattgaaaggggaaaacattaatacatttttaaacttgtgcattgatttcctttccttcaatgtcagaagaatagatagatgaggaaaacagaaagtatataaagtctacttttacacttcttggtatttggaactctggaattattggattttttttctattaatttttggaggtaccttttaatatttataagagaacagaaagactatttatgttttttacttaatttgccttttccgtctttaaatgatccttaaatctaagtaaaacacatgcaaaaactcaacatatggctgttttctggtaattcctgtttgaaaaaaygttaattttcttatgttttggaaaagggaactatgtagcccttgtatttaaaatgttcagaggaactcatattactttactataagtattgtattgttttgaacagcaaaggcttagtgcgtcagaaataatataccgtcatagcattacttgtaaagtttacttcaaaatgaaacactctttgtatactgctttcatggaataatatgtttctaaaccagttgagttgaatgcacctgaatttaaatgtcacacacacacacacacacacacacatatatagtgtgagtgtacagatatatacatacatccatttagcaaatttgatcaactgaatctctggaataaaagtaaaacatgcttttaaaaacgtaattgcttattgtagtcacttaatgattttggaagaaacataatactttctcttaacatgagtagggatgtgatggttactttgaaaacatatttctggttctgtgaagcagtattattttcttaatctgttagctagcattaaaaagatagtttagctggcctatctcattggtcatattgtttttatctatctgaaaacttattaaggtgaacttgtttttgaacttactgaaaacaacttggatcagcaaatatgaattaagttccaaaatattacttgagtactctaggaaaacaaatgtatatttaaacgttgtgccgctgcctgtaaaatgaaacaccgatgggcaatccttaggatctgtgttccttatgttagaatatcatgaaacaagaactagggtgtgaggctgagcatcccacaaacattttcagatccttaacaagcaatatagaattaaatagttttactgagttatgcattttctgtggtcatatttgtgactctaaaaaaaagtctgaaaaaatagaagggaagtttagactgtttttctactatgaagaaatagttttaaattggcatagttttctaccattatacatagtaactgtttgtaagtaagtttgacccctagcaaagtaccaagaagttcatatggcatttaacaccttgacatatggagaataaaattagaagaataaagttctggtaaataatgtacaactaggaaaaagatttacatataatgtctctttactaaagcatttaggaaggtcaggttttaaaagattatccgatttctatatgaacgctatcttaatgggaacattcaaatacaaaatgatttatatatttatttatcaaacacataaggcttggtatgtgcacctttaaataagtggccagctccattcctgggggtggaatagctgcaagcagtctggaaggctgcaggtgtcttcatttgcgtcctcactggggaggaaaggagctcatgtctcaaaacatctccaaaactcaccttcctggttatagtttacccttgactggagctttggagtccccccgccccccaaccaggaaggccgtgttctgattggcttagctcagccatggccctcccccagaggtggggtcagcctcaccgaaacaaacagcatggctgccacctacgggtgagaaatgagtgctgtgtgatactgatggtatattgtcacactaatgtatgctagagatggaaaataactcataagaataacttttaaaataaaataaataagaaaccaccataggaaattcatacatcctgatataaaccattattctgttttagattgctttaatgtaaaataattatgctcccatgcaaactactacattttttcccccaactcttccttttttcatttaagaaaaaaaattcttatattgaaacctgttgtaaatatttgtggcactttttttaaaggctcctgtgataataaaattaattatagttcaaagataactttatttaaggaaaaaaaaattgtttttaatcctggagtaagttaaatgagccttaacccttagtgaaaaaaatctcctaaaaagtcaccttcgatttgcaactacttagcatttataatttaagaaagattcgcttaattaaaagaaatgattaaagaagtcaataaagactaaaacattaaatctagagaaaccctttagaaaataatattgccattatgttatattgcattatttcatatcaattacttagagctggaatattggaaaggctgggaaagttacaatttctagcctataaatcagtggcaagttctgaaaaaatgaaaattaacacatatattttaatatacgtgtttgtaatctgcaaagatcacaaatatttactttagtatttatccattcaacatatatgtatttagacattcagtgtgtgagctggggagttcacagacaagtgagagaggcatataaccacctacatgcatataccagcacccacaactgtaagacaatgtggaaaataataataaaaggaattgtctacaaaatgctatgagaactgaggggaagggctaaattcctgcctggatgtaaaaggaaacagagaaggtgaattttctggaaatgaagtaaaaacaatttaaaagctctttcatttataaaataaggtagttgtaaaataaatgtgtatatttatgctagcttttattatttgaatcaaaagttattctgttggaatgcaattgcaagtgcatatgaaagtgaggaaatgtttgatgtgtacatatgttggccaatttagtacagtttcaaggaataaatgttatatgtagctgggcacaatggtgcatgcatgtaatcccagcacttcgggaggccaaagcggacagatcccctgagatcaggagttcaagaccagcctggccaacatgatgaaaccccatctctacaaaaaaaaaaaaaaaaaaaaaaattcgctgggagcggtagcacatgcctgtaatcccagctactcgggaggctgaggcacgagaatcgcttgaaccggggaggcagagattgcagtgagccaagattgcaccattgcattctagtctgggtgaatgagtgcaactctgtctcaaaaaaaaaaaaaaaaatgttaatactgaatgtaggaaagggaaaggtgaaaaagaaaggactatttttaaataacataagacgaaggtgatgrtgttttgttttccaagatcctctaagaacacatcatgaaactctaggatacagtgtcagagttggctctcagctcctcccttggcatctgggatagaactmgtttcccragaaggtgtccaagtcttgtcccattgaatgtgaaggccgtcaggctctckcaagcctatgagtctttggttaatgtgcataactacrcatttttttttttttgtcattgcagactgaactccattgatgtgaagtatcagatgtggaaactaggagtcgttttcactgacaacgtaagcctacttcattatcacaaaagaaaatgcactctgattagataagactgtgggagttctgcagatggaaggctggttatttagaaaatgtttcgaataccaattcatttcatacagaccagatctggagagagacccacagaatgatatgattaatgagcccatctctcattccatttctttcaatagctgaaatagtaaaatgaaaatatatgaaaaactgagatgcagatttgtgagtacgttcattaaggttttaattggacaatggcatacttcagttttatagatgttaaaaagaaactcctaaataattttaaaagaacattaattgtgctaaatttaggttttccccaaattaagtacattaacttatggagttttattttattttttttattctccttttaccaaagagcctttggagactaaatatagggccgtaatatatatccaaatagaaaaaaattacctattactaaaaaccrcyaggtgtctcaagatttcactctttaattttagcactgacttttatagttcacgttagttccattctcctatttagaagcatttgatagcccccaaattctcctgcctctatccttaycccttccctcatccagccatgggcccagaactctgggtgtcttaggagcattctctaagagttcaaaatcaggtcttccaagtatctttcagaaccataaactattaatacactatcttacaactaatttctcatccaaatgggagcaactcccctgaataacaagagggcaacctcagctttggctctagttggcattttccactgaagtggccagtccatcttaagttctgcctgctaagctcaatcttccatgccacagtatttgcatagcccacttttgcccagatgcagcttctgcccagatgcagcttatccataatattcatcttgctttgtagtttttttgtcctcttgataacttgggcatggatagatccaggatggagtctttccttagacagcgttctgctayyttagtaggcttttatccacctgcagtttcatggcttctgtttggccaatcacctctcaacatgcattcattcttcactattactgtgtctctctgaaacatagccatggttaccagacgaaattcagaattcctagttaaatgtaaattttagataagcagaaaataatatttagcataagtatgtcccaaattacttcatgggatatacctaaactaaaaatcatttattctttctctctcattcaaatkttactgtgcagcaagcacatgtgtagaccacacatgcacctttggcccagcttgtcacttaggtcgttactcatcttatgcccataaattttccttttcctcagtctttgcatttttcttttttttttgagacagagtcttgcactgtcrcccaggctggagtgcagtggcacrctctccgctcactgcaagctccgcctcctgggttcacaccattctgcctcagcctcctgagtagctgggactacaggcgcccgccaccacgcccggctaattttttgtacttttagtagagacggggtttcaccgtgttagccaggatggtctcgatctcctgacctcgtgaaccgaccgccttggcctcccaaagtactgggattacaagcgtgagccaccgcgcccagtcttgcatttcttaatgcctccttagattagctccatctgaatgtcccatggcaaattttcatcttccttctcctctgctcctccccaccaaatccagtcttcggtctacaattttctcttttagtatttttgttcttcttactacctaagcttaaattattcatatggactcctcctcttctttctccctccaatgcatgtatttgattatttgctgaatcttggtcctgtttgtgtcctctgtaattctcccttctatctttaccacttttgctgctttttttggctctggtaacctcaccctggggtttgtccagtagtcttctaatttaatggctttgccacttacaatgattttagacaatagcttaactagagcaagctcacttcctcatatataaattggggctaaacgtgcctattcatcagagatcttgctaaaataaaaaagagaccatgtgtgcaaatatattgaacgttgaccagcacttagtaggtgctaaagaaattttcctaaaatgccatttttcacaaaccgttatccttctcatggtactgcagtggcactcaagttcctgtggggtacacaaatgtccttgaacttgccctcaagcctctccaacactgccacacttttccaacttggtcttgcaaaacaggaacccaccactcaaaccaaattttccttcccaagcaaactctgtttagtcttacctcagtgtgctttttaaaaatgctgttttcttttctgccacttgacctctagcttcagttccacatggtccttgaaatccctttactagctcagccccctctttttattctctgtgaaagattaagatatcttacagtcaaaatgaaggtgtccgccgcttccccaaatgggtggtttctgactccactagcaaaacattccttatggagcagagactgtagtcccataagtaagagcagccaccatatttttattctgcattagtcctggccctcccccaaaagtgtattcattttccagcctatgtgaataatcaacattaattataacccaggagacttctacaacagtaccaatagtattattaggtgtattatagctttcagtgacgtcacatggtatttgggtttctcctagacttactgtggctcacgtaaagtgagatgcttggttaataaaacacttcatataatttcataactagtaggtctcagcaaacactgatttagtcagtgaataaatgaaaagcaaagaagggaagaaaaggagggagagaaagcgactggttcttttgttggctgtagagcaagggttcttctctactggggaacagttttgtctgctaatgatgtttggcaatgtctggagacatttttggttgtcatgactcaggggagaggtggggtcggtgctattggcatctagttgatgctgcttgccatcccaccatgcacagaacagcacccataataaaggattatctgaaccaaaatatgaatagcgctgggttgagaaagcctgctgcggagtaggaagtcaataaatgtttctctgtcggaggataaataacaacgacaattcctgaaacactttaaaactgttttaaaggaggatgacactgaccttttcagaacaaattaagtaaaaataaaattcacaaagaacaaactgatacagctaactagaattgtaaaaatgtatagtgagccaggcgcagtggctcacgcctgtaatcccagcactttgggaggccgaggcgggtggatcacgaggttaggagatcaagaccatcctggttaacacagtgaaaccccgtctctactaaaaatacaaaataattagccgggcgtggtggcggacgcttgtagtcccagctactcgggaggctgaggcaggagaatggcatgaacctgggaggcagagcttgcagtgagctgagattgtgccactgcactccagcctgggcgacagagctagactctgtctcaaaaaaaaaaaaaaaaaaaaaaaaagtatagtgtacgaagatgaagtaaatggagtaattataacagagtgaaatcagagttactttttaattgtatttttttaattgacatattcatggggtacctagtgatattttgataaatataatgtaatcagatcagggtaattagtatatgcattatctttaacatttatcacttctttgtgttgggaacatttaatatcccccttctagctatttgaaactatatattattgtgacctgccgtcatcctacagcggtatagaaccccagaacttattttttctatctagctataactttgtatcttttaacaaatctctccctattcctacctctcctttttctccccaatctctagtgtcctctctcctactttttacttccatgagattaactttttaagattccacatgtgagtgagaacatgtagagtttaactttctgttcctggcttattttgcttaacccataacaatagtcatgcgttctgttttctgacatgttctttccccccgttttgtcttaatagtccttcctctacctagcctggtatatgactatgtctgttcttggacactataacaactttttttttgccgctcaccttctcgacattgctatgggattcaagacattaagaaccatcttgtcctcagtaactcacaatggcaaacaggtaaacagtttatctttttcctcccttgcagaaaataaaaaagcaacaaataaarcaaagaaaaataaaactacccctcaaatgacaatgtacagttttaaagatttttttgaagggagggtctgcacctgttctaaactgcagggattagtagtttgwgggtctcctaggcctatactcaagccttggcttgactttggataaattaactgaaaataataaaagtacataccttaccagatttttgcgaaaatgaaataaaaacaaatgtgtatgccttaacacagcccctggcccatatcaagcactcaggaacttagttattattttgttcctagtatagtatttgctccacttgctattatggagaaccaaaataggttacagaatcctgacccactcattgtattcgttgtaaaatatgagatgctgcattttaatgtagtatttttaagctggatattcatgtactctttacttttaaattgagcaaaaaggataacgtttcatatttgacaaggtcatgctgactcggaagaaaactggtctaggtccagaaaatgcacttacgttccaatggaacctgttcttaatgttaagacttcccattatcctgaagcatattgcagaagtgtgcactgatccgttcacttgctatttttcaagtgtccactgggtggcgacatattctgtgttagttatttggcttaacagactccttcatttccagagtcttgtagcccagcacattttaaaataattgcctctctaaaagctttgaactgggtccacagttaagtccacattatcatcagttttctaaatttcagcatgattcttacatatgtcactttaggttctgagtatgactgtgacgtgcacggcaagtcatgggtctagcgacaaaaaagtctatttatctgtcagttaataagatgtgtttgagctcccaggatatgcagtaaagaactggagatgccaaatgtatgtgtgtttctacataaaaggtccggcactactttccatttctgagctttgtggggtttctttttgagggatcaaattttctttgtttgtttgtttttaagacagagtcttgctctgtcacccaggctggaatgcggcggcgcgatctcggctcactgcaacctccrcctccctaggttcaagtgattctcctgcctcagcctcccgcatagctgggattataggcgcgtgccaccatgcccggctaatttttgtatttttagtagagatggggtttcaccatgttggccaggctggtctcgaacttctgacctcaggtgatctgcctgcctcggcctcccaaagtgctaggattacaggcatgagccaccccacctggcctcaaattttcatttgcagaaatatgtagagctttatagtcctaacaggtgaaacatgcagaaattcacagtaaccttgcacttcatttatagaaatgaatgaaaccctctgttaaggtaacatgttttctccagataattataaagtgattttgtaaagacttaatcagcataagcagttgcagtcaagaccataaagatgtgctgtaatcagaaaaagtacacataaagataaagcactgttagtatggtcgaatttctgtgatgaaaccagaaatacattttcaccaactgggtgaaaagccacatttttagcatatacatattctatcaaaaatactctacaattctatcatatacttatagctatccaaaaattaaagtataatttggaattaaaaacagattacatagagctgaaagacctttcaaacagagacatttaattatagattgagaaaaatagccttcaaaacagtgttggtcactagctgtggtatttttcactttggccattgtttacaaagcaagatttctcagttttaaaaaatatttatattataccttattactagttgtgtgtccccagatttcaggggcaatacaaatttctatttagtttaggatatgattgaaaatttaaaaataatttacagtcataacaaaaacgaaatgcattttattaggaatgtaatttatagaaaatagccctcataaaatgaagaaagggccgggcacggtggctcacgcctgtaatcccagcactttgagatgccgaggcgggcagatcgcctgaggtcgggagttcgagaccagcctgacaaacatggagaaaccccatctctactaaaaatacaaaattagctgggtgtggtggcgcatgcctataatccccactactcgggaggctgaggcaggagaatcgcttgaacccgggaggcagaggttgcagtgagctcagattgtgccacagcactccagcctggtgacagaaactctgtctcaaaaaaaaaaaaacaaaataaaataaaataaaataaaataaagtctgacaacttgataaagagaatatgaaaataaatgtctgcatgagggggctaagaaaggtgagaaataagttatggatcccattagcttctagtaaacacggctgtgttctcactagagcactcgccgcccatgtagatgtcacgtgtcaattgtatgtcctacatttctaatacctggtccttgtcacattgttttccagctcgtattaaccgttggcttattagctgttgttgtatacctatacactgtggtggcattcaattttttccgaaaattctacaataaaagtgaagatggtgatacaccagatatgaaatgtgacgatatgctaacagtaagttcataacctttgatctcacataaacaaaaatgtctcctgcttctgcagtctaagtaattgtgtatttattctctaacagtacaaaatagaaaatagtctaaacaaataaaaagttgcagggctgtttaaagattcagcagttttcaattttagcagaacataaaggagcatttctgtcaattttccatatgtgctgcacagcctaataattagaattgctgagtaatgtacttagaactcgaaggagtaatgtcatcacttaagcctgttgttcacatatcccaggacaacgggtaaaactatttcccagagaacatttggaagccttagttttttgttcaccttaawgactttaactgaaattactaaatttcaaaaatatatctcttcctagaactactggtttttgcttttatattgagtatcttggcttaaatgtcttttttggtcttggttttcaaaaatcaacagctgttaaagctttcatattgctttatatcgctgttctacaacctgtctctctaatattggcagctgagaggtaatcatacatgagatcttagatcaggaaggggaacatgagacaaaatatatatcactagctggaaagagatgtatccttcagtaagctcctcaygaaaatacctacatcatttgtgttggggatgtaggtatagaggctgatataatgayacataaattactctagaaaaaatagcccaaaagattgatgagaatgaccagtattacaaagactaacaattaagataattttatactaaagaatgacaactcagtgggacagagtagttcagaaacagatgcaaatactcayggaaattaaaagatgataaagatcttttgaagtaatgaaatgaaaaataatttaataaatgacattagtaccatggacaagctatttggggggaaatgataaaaatggatgccaaccttgctttttaaataaaaataaattctgaaatgagcatattttaatgcaataagaaggaataatcacaagacagaatttgatgccttaaataatagtaatactcatttttacatggagaacggtctgagtatgacataaaactcaggatctatgaaagcataaacattatttgaaaaaagagcaactataaataaagtygtaaaggcaaatggtaaactgggaaagatatatttaacaccataacaaagggccattttccttaatctaccaagtccttatcacatcaataagaaataagccaatagaagaacaagtaagtcacatgaccagacaattcacggtaaaattaattcagtgggcttgcaaatttgaaaagacgctcagcctctgtcaaagtgaaagaaatgcaaattaaaacaatgaaaaaaacactttttacctatcaggtttgcaaagtattcacgtttgttaaaacccacagttggtgaattgatgggaaaaatcagcattttcatgactctggttgggaggttgaattgacaacaattttagagaagttttgtgacacctatcaaatttttaagtatatatatcctttgacctattaattccactgctagtactttacctaaaggtttactcacaaacaagcctctgtatgttcaagaacattagctgccctcacaagctaggaataatctaaatgatcattagtagtgtcctgattaagtcagttacgataaatccataacaagtatgcatctgtttgaaaatgagagaaattcatgtatacagatatggagagatatataaattacattttaattaaattacatttaatttaaaaaaacaagatcttggatcagtaatgataggatcctaattgtgtgaaattatatatacacaataattcatatttttgatatgctggaatatgcataacatttttctggagggatttattcataggacactgtgaacaaggattcctacaggggtaggaccatagatcacaggggaaagaaacttgtttgcttttcattttatagactttactcctgtctgaattattgatactatttctttttaccataggtatttttttatttttaaaagcctaagacagttttttccccaccatgttatagaagataatctgccttcagttattcccacaattagtataactacatgcagtractgttccctggcagggaggagagaacagaacatacaggtggctgacctgagrgaattaaargacagaggttgagggaagctctgctgaaactcgatgttacattttgatccactgcctgttcttgagccatttatttatagcccaaatctcttatttgtgtaaagaagtttttctgtatttaaaactttatcataaatgatcattmatatagaattgcccatccttyctctcctttaaacaagtattcttttatttactaatttagagagcttcagacaagattgtcattctttagcttttcaatattaagcattttgttctcttcccaactttctttttaataaaaaaaatcttragaataaataactctcaaatgaattgcaggttagttaaaaattggggatacataatagcttgctgacataaaaatattcacttttcttaggtcaagattaaattttcgaaggcttggaacttcaaaaagggatgcttttgatggagaatgcagggggaaaaagctttcaactcatccttccacacatagttgacagcagagcaaatcatattgttcatgtgaaaatcatctgtaattttcaacatttcctgtcacgattgccgttctgaggtgtttcacatgtgactttgtggtttccacgtgctagtgacctacttggaggacacggagtatcagagctgaaaggactctgatgttcatggttgttcatccataaacttaattcctcaactggaagaaaatgccatcccagttacaaatccacagtcttgtagattttttttatttgtcaagtgcttatatagcacttggctataaatgctattgtcccaggcattgtctcaagagctttacaaatattaactcagtagtctcctaccaactttctgctgcaggttggcactgctatcattcccattttacagatgaggaaactgagctaccaagagtttgagtaacttgtcataagtcacacagttaggaagaggtgacactcttcaaccagtactctaagttacactacctcacagatagtaacttcattcatgcttctgtcattaattttagtgctatttttataccaggcactcgttaaggataaggcttgagtaagtacagtccctgccttcatggaatttgcatggtaagcacctttctagaaattctgctaagctcgttcttttttctgggatcctccaagaaaagagtgccccagaaattccagaagttttggaaaaccttgtggatcagtattcctatcgcatacagaacatttaatatactatacaaaaatagtggattcaacatcactgctcaaatattgcaattgagaagttgctttaggtggctggctactagacagggaaatagaaataacttattaatgtcacatgataccacagggtggaagatattgatacggacatagatcaagtgccttaatacttgagatccattttagtcatcataagttgtcatgactgagatgtaatacttacttacatttgctagtcttcttctccgattaattgctggacaaataattcatgcaccttgcctggagcctcctccctgactgcctttctatcaccccctgatttggcccacctgcccacttcttaaaaccatctcctatccttccttttgctgcttttctcgcaccacaaagcagagaaaaatgtataagttttktttttttttttaacttacagcaactgtaagaaaactggattcaatgcaataagactgacccgttactagtgacgactctccatcagagtcactaacatgcaacactttaccccctcctcccacgcctattcattcattccaggcctagggctgaagatgtgttaaggatccttcatctcctcttccatgcgctgcctttaatatcagctgtgctcagagcctttctaccctgtgaccctgaaggcaggaggggagtgggaggccaggaaaggctacaaggcacaagggaggtgcagaaggtagcagtagcaggtacattgcctgcagtgacttccaggaaattcagttctattctaggacaaacacccgacaaaatttataaatctcaatatctaccagcctcagggcagaaagtttacttaggttatgtattcctaaaggctatgatgctcagagaattgctaaaaattaatagaaaaataggaatgatttcagataatggcattcagtgacctgtatcaggtagtgagaacaatatgtgactttagatcttccttttgtaccacagggagaccccagcaacatcctggtctctccttttattatgcagtcgtcatagttgaccccattcaagttgtaatcataggatccttaaacgactacattttgaacctcactctcagtatgcatttccattacttttgttaattttgcttaggaagacaactgccttcacctggttgattttgcctaatttcatgggggcatgaatacagaagacagagaaacttggttccggtgaggaaatacggcctgttgatgttctgaactatggacttagctagagcctagatttttttcagtttgagggatttctgtcctcatgagtaagactatttatgaccagctctgttgtaggtttttatatctctacacataacaataaacttactatcttgtctttgactgggttgagtatatgtcttagatgtttcttccctgcaagagaaaactcagttccaagacacaagccactttttcatccctagctcattcacagtgacgggctgctgccaatcagtcaaaccagacaggagtctgtgtagcattacacacgctcatatcccagtrattgtccctaaaaactcccacatgggaatggaggccacattacctagattgacattccaattgtagcgtccaaacacttacttttaatttgcttcttaccagtacttgtgcaggggcttctttaaaaagccaacaaaatttaaaatataactgatcacttagagtagtgcgctttcaaagtacaggcttattaaaaccagcctgccagcaagaaagcagcacagaataggaaacaaagatttaatttctttaatttagttctcaaaagatgatcctttctttatgacagtctcttgaacgtgtcctttcacagggcgatgtctatattctctcttgagataaattttcctcactcatgtcacattttattcacttcatcctgagtttctttgttgtttctggttgtttctgtggctctgagagaacatcttaggttttgcaaataggcaactcgccctcctgtttttcataatttacagtagggggcgccatagctgcagtgttatagacaagtcacagggggatttttttttttttccagattaggatgttttgagcctgagaatctaattaaaccagcagtatcctgatagaatttgaacctcctctacaagaatgtaggaggagaaagagaaaaatgatgtaaagtccaaggtagaaagatgattgtsgctagatagccagggagtctgacttgacatataggacgatgttcatctcagatggagagggaccccctgaaccagaggctgcaggggaaggtgtcaagacttatgcactttgggaaaaatagctttccaggtgattaagatgaaaagtacactcctagggaaataaacttgcttaggtaattgttctaaattacctcacttaattgttgtcacttactttaccctactttcccaacaaataatctgctccttttttcttttttcttttttttttttgccaagatgaaggcctgataaggatcttcaccagcagctgaccctcagtgttccctaaagccaatagaaactatgatcaacctcagaatgaatctgtttaggagacggatgagggagggaagccacagactataacatcttggaaatcaacaacttcctcttctaaatttttgtaggaccaggcaccttccttcctcattactcagattgtctgaaagaagcacatctttttgtctcacagcattacttctttccacctccagctctcattatcaggtttaggctgattctatgaaaagaaaggtggataaaaggattttcagttgcagcaggataatttggtagctgaaagcctgacagccatgtattggaagttattcaccacatacctcctattccagcaccacagccaactacatacagttgtctaaggctgaccaggtagtaaaggatgaagctgggaaaaccagtatcaacatcccacaggtgaactgtacattttattctttttaaatttggtaatttattaagcctaaataatcaratgcacaagactgtcttttcagcatgactgttaagtccactaccgatctctgctggaatcccttcatcacaatgcataaagctgatgtaaaatgaaggagagcagtgaggaagggtatttccaggaaaggttgttagatggctgacaagagatctgcaaagaaggagacattttctttggtaatttagcctcattccttggtcctgtcttcaacattacatgtctagaaactacaagtgaatcattcttttggggacagactcacattaaccagtattacataagcctgatgtacgagtcagaataccaacatgctactcattaaaagttaatgcaacaagttggcacattctcttccctagacaaacacctctatgggaagccaaattttaacccaagacccaaagactcccaagtgcaagaccaagagtcttggtcagcaggaatcaccaagaggaactgatggatgatcagttcatccatcagttgctgggcaatcttagccactagtgctgtcacacgcagttcctcaaagaagcagggatggagagctaggacattccaagacctggactgggaactgcacaatccactgttggctcactgtggggattggaatggggacccaagagaccagaacttgacatggaggartaccagtccagaaccaggtatactatccaaactgagtccccagagaaatcccyggaggagagttgcaaacacaaagctacttgtgaagtcagagaaacgtgggcaatgggaaagatggtctaactaaagaggaaagaagctgtgttaaccactctttgttgatttcctgtagtcacaattaaatacatatgaagacacagatttggagaaaagcaatccaggctaggcacggtgactcaacgccagtaatcccagcagtttgggaggccgaggcgggcggatcacctgaggtcaggagttgttcgagaccagcctggccaacayggtgaaacyccatctctaccaaaaatacaaaaattagctgggcatggtggcggacacctgtaatctcagctacttgggaggctgaggcaggagaatcgcttgaacccaggaggcggaggttgcagtcagtagagaatgcaccattgtactctagcctgggagacggagcgagactctatgtagaaagaaaaaaaaaaggaaaaaagcaatccagttcttaataaaartaagaaatgtgtggtaaaacaaattcaaacagtatgcctgagtatatggtgaaaatagtttccccttctcacagattcactgttagcagtttcaagcaccaagttttgaaaaactacagcagtagcttcaggatatttttttaagtgatggatggtctgtaagattttacttccagagattgactcagtaggtagtaccaggaacccagaatgttgccacgtccaggagactctgatatgaggttaggcttagaccctatcagcctaatctggctctaaggatctcctgacctttctgcaaaagagacccctaacctgggctccagatcagatcttgggtgggcactggctgagctggccttayaatgctctttattatatgccaggctgagtctacaaccatacgaccctgaatgtgcccaatctcatccttgtatgccaggctgataaaacgtttccaaatgacacatttaattctgttccctaaattccagccatctaacccaggagactttttctcctctgcatctaacagatccatcagctgttgaactcatagttgaactatgagcattttgatatcaccttgttgactgctctttgcctacacattgtgctttttaaagtgtcctgagaatgtgagatctgtgggttgaggcagtgaaggctcctcattcatcccacaaatgatttgaggacttaccatgtgctggacgttattttaggcactggcaacagagtaataaccaaagcatttcttgttggaatgcagtcagtcctactggaatgagatagacaccaaaaaataagcaagctggatacccaagtgtggaattcaagaaaaagatccaggctggaaatagaaatgagtataattggcacagagatgatacttaaagccatgaaactgggaaaggtcccccaagggagtgtcctaaaagtaaaaagctcaaagaacccagtcctggggcatttgttcatgaagctacagggagatgaggaagatttggcaaaggagactggaaagcaatggccagaaatgaagcgaagcagaggagtgtggtgtttctgtgttaaggcttttgtccccwtcattctggtcagcagcaactaactaggttttgaattgatgggtgacacatccattaagtcagggtatctggaacagtctaagaaaatctcagaggaaggattattaatttaggccctacaggatgagtagaaatggagtaagaatggaaaagcctattgcaagagaaggagaatgtacgagcaaagatctggaatcaggaatagttcacttggaggaggtatggggagagcggagagagcagagagggaagtttttgggaaagctgagtgtggctaaattcaaggcctgaaaaaggagttggaacttagcttaaatgaggataaaatattggatgctccaagccagtgactcaatccagcatgacttcatttgccaccccctgccccaggacatttggtatctggagatatctgttattgtcactatgaggtagggtgctattggtatctaaggggtagagatcaagggatctttttaaaatagcatacagtgcacaggatagcccctgcccaaggaattatccagccaaaaatgtcactggtgctgargccaagaacactgccctaaaatgcactttagtgaacccctcattttttagcagtaggcacaggcagctgtacttgttggtggctttgacgttttagggtttaaacaataagatgctatttcctccccaggtctcctctcttttgtattctagatattaaagtagaaaakaatttcagcatcatatttcatatatactatgtgagggaagggtgttagtatgttttcttctagcttaatttctaagattccatcttattacctgacctttccaatgtctgttatgtccaaaataaccaaacaatacaatatagttgtatgtccctgaatgtgttcgtaatatgattacctcattagcacagatggttcagagccaagatactagatacaagatgctagaaaattttccattttctccaaagtgagagagaaagtgctaggcggagtatgcagtatacacttttgtttaaaagacagcaacatgcaaaagccaaatgtttgcttcacaactagaaatactgaaacaaaaagaggcaatatagaatgcaaaaattctcatttccagagtgaggattaggaactacagagataactcgggtttgtcgagaaaaaaaaatgggtaatgtccctccaagaagtgataccatgtcttttttccagtgctatatgttccacatgtatgttggagttcgtgctggaggagggatcggggatgaaatcgaagacccagcaggagatgaatatgagatctatcgaatcatctttgacatcactttcttcttctttgttattgtcattctcttggccataatacaaggtaagtatcctcctcactgaagctgatgaacatctagaatttgagccacatgttgctgaagttaatattcaaggtagggtaatgacgtcaagtgtttcctggcaaagccaaatcaaacttttccttccagtatttcttcatcatgcaatctaccgggggaaatataaagcggtatggaaccctggtatgaagggaagatacagtgttattttgtcttctttcaaataacataatggaaaaggcactttccttggtttgattctcacctctgggtttcagactcatgaaccccagctttacaatcttgggtgggtgagccatttaaccctttaaacttctaagccagctgggtgcrgtggctcatgcctgtaatccaagcactttgggaggctgaagggggatggatcacttgaggtcaggagctcgagaccagcctgaccaacatggtaaaccccatctctactaaaaatacaaaactagccaggcgtggtggcacacagctgtaatcccagctacctgggaggctgaggcaggagaattgcttgaacccgggaggtggaggttgcagtgagccaagatcacgccactgcactccagcctgggcaacaagagcgaaactccatttcaaaacacacactcaaacccaacaacaacaacaacaacaaaaacttctaagccctgtggttgttgagatttttaaaaatgacatacaggccaggcgcaggggctcacgcctgtaatcccagcactttgagagactgaggtgggtggatcacttgaggtctggagttcaagaccagcctggccaatgtggtgaaaccttgtctctactaaaaatacaaaaattagcctggtgtggtggtgtgaacctataatcccagctactcaggagactgaggcagaagaatcacttgaacccaggaggaggaggttgcagtgagcagagattgcaccattgcactctagcctgggtgacaagagcaaaactccatctcaaaaaaaaaaaaaaaaaaaaggtgggggagggagggtagctggcaagatggccaaataggaacagctccagtctgcagctcccagtgagattgacgcagaaggtgggtgatttctgcatttccaactgaggtacccagttcatctcactgggactggttggacagtgggtgcagcccacagagggtgagcagaagcagggtggsgtgtcatctcacccaggaagcacaaggggttgggggatttccctcccctagccaagggaaactgtgagagactgtaccaggaggaattgtgcactccagcccagataccatgcttttcccatggtcttcgcaaccagcagaccrggacattccctccactgcctatgccaccagggccctgggtttcaagcacaaaactgggtggctgtttgggaaggcagcaagctagctgcacaagtttttttcatataccagtggcacctgggatgccagcragacagaaccattyactcgcctggaaagggggctgaaaccagggagccaagtggtctggcttggcrggtcccacccccacggagcccagcacgcgaagatccactggcttgaaattctcgctgccagcacagcggtctgaggttgacctgggatgctccagcttggtggagggaggggcatctgccattgctgaggcatgagtaggcagttttaccctcacaatgtaaacaaagccactgggaagttcgaactgggtggagcccactgcagctcagcaaggccgctgcagccagactgcctctctagattcctcctctctgggcagggcatctctggaaaaaaaaggcagcaatcctagtcayttacttayagataaaaccctcatctccttgggagagagcacctggggaaaggggtggctgtgggttcagcttcagtagacttaaacgtccctgcctgacagctatgaggagagcagcagatctcccagcacagtgttcgagctctaataagggaaagactgcctcctgaagtgggtccctgacccccatgtatcctgactgggagatacctcccagtaggggccgacagacaccttatacaggagagccctggctgatatttggtgggtgcccctctgggaggaagcttccagaggaaggaacaggcagcaatctttgctgttctgcaaccttcactggtgatacccaggcaaacagggtctggagtggacctccagcaaactccagcagacctgcagcagaggggtctattagaaggaaagctaacaaacagaaaggaatagtatcaacatcaacaaaaaggacgtccactcagagactccatccgaaggtcaccaatatcaaagactaaaggtagataaatccatgaagatggggagaaaccagcrcaaaaagactgaaaattccaaaaactggaacacctcctctcctccaaagtatcacaactcctcgccagcaagggaacaaaactggacggaaaatgagtttgacaaattgacagaagtaagcttcagaaggtgggtaataacaaactcctctgagctaaaggagcatgttctaacccattgcaaggaagctaagaactttgaaaaaaagwtagatgaattgctaactagaataaccagattagaggagaacataaatgacctgatggagctgaaaaacacagcrcaagaacttygtgaagcatatataagtagcaatagccgaatcaatcaagcagaagaaaggatatcagagattgaaggtgacctcaatgaaataaggtgagaagacaagattagagaaaaaagrgtgaaaagaaatgaacaaagcctccaggaaatatgggactatgtgaaaagaccaaatataygtttgattggtgtacctgaaagtgacgggagaatggaaccaagttggaaaacactcttcaggatatcatccaggagaacttccccracctagcaaggcagaccaacattcaaattcagggaatccagagaacaccacaaagatactcctagagaagagcaaccccaagacacataatcgtcagattcaccaaggttgaaatgaaggaaaaaatgttaattaagggcagccagagagaaaggtcgggttaccgacaaagggaagsacatcagactaacagcagatctcgctgtagaaactctacaagccagaagagagtgggggcaaatattcaacattcttaaaggaaagaatattcaactcagaatttcacatccagccaaactaagcttcaaaagcgaaggagtaataaaatcctttagagacaagcaaatgctgagagattttatcaccaccaggcctgtcttacaagagctcctgaaggaagcattaaacatggaaaggaacaaccggtaccagccactgcaaaaacataccagattgtaaagaccattgacactatgaagaaactgcatcaactaatgggcaaaataaccagctggcatcataatgacaggatcaaattcacacataataatattaaccttaaatgtaaacaggctaaatgcccaaattaaaagacacagactggcaaattggataaagagtcaagacccattaatgtgctgtatgcaggagacccatctcatgtgcaaagagacacatgggcttaaaataaagggactgaggaatatttaccaagcaaatggaaagcaaaacaaaacaaaaaagcagggattgcaattctagtctctgataaaacagactttaaaccaacgaagatcaaaagagacaagggcattacataatggtaaagggatcaacgcaacaagaagagctaactatcctaaatatatatgcacccaatacaggaacacccagattcataaagcaagttcttagagacctacaaagagacttagactccccaaaataatagtgggagactttaacaccacactgtcaatattagacagatcaatgagagaaaattaacaaggatatccaggacttgaactcagctctggaccaagcagacctaacagacatctacagaactctccaccccaaatcaacagaatatacattcttctcagcaccaattcacacttattctaaaattgaccacataattggaagtaaaatgctcctcagcaactgcaaaagaatggaaatcataacagagtctctcagaccacagtgcaatcaaattagaactcaggattaagaacctcacttaaaactgcacaactacatggaaactgaacaacctgctcctgaatgactattgggtaagtaacaaaattaaggcagaaataaagatgttctttgaaaccgatgagaacaaagacacaacgtaccagaatctctgggacacatttaaagtagtgtgtagagggaaacttatagcactaaatgcccacaagagaaagcaggaaagatctaaaattgacaccctaacatcacaattwaaaaaactaaagaagcaagagcaaacaaattcaaaagctagcagaagacaagaaataactaagatcagtgcagaactgaatgagatagagaaacgaaaaacccttcaaaaaaatcagtgaatccaggagctggtgttttgaaaagatcaacaaaatagayagactgctagccagactaataaagaagaaaagagaagaatcaaatagatgcaataaaaaattataaaggggatatcaccaccgatcccacagatatacaaactaccatcagagaatactgtagacacctttacmcaaataaactagaaaatctagaagaaatggataaactcctggacacatacaccctcccaagactaaaccaggaagaagttgaatccctgaatagatcaataataagttctgaaattgaggcagtaattaatagcctaccaaccaaaaaagtccaggaccagacagattcacagccgaattctaccagaggtacaaagaggagctggtaccattcctttgaaactattcccaacaatagaaaaagagggaattctccctaactcatattatgaggccagaatcatcctgataccaaaacccggcagagacacaacaaaaaaagaaaatttcaggccaatatccctgatgaacatcgatgcgaaaatcctcaataaattactggcaaaccaaatccagcagcacctcraaaagcttatccaccatgatcaagtaggcttcatccctgggatgcaaggctggttcaacatacgcaaatcaataaatgtaatccatcacataaacagaaccaatgacaaaaaccacatgattatctcaatacatgcagaaaaggccttcgacaaaattcaacagcccttcatgctaaaaactctcaataaacctaggtattgatggaaggtatctgaaaataataagagctatatatgacaaacccacagccaatatcatactgaatggccaaaaactggaagcattccctttgaaaactggcacaagacaagaatgccctctctcaccactcctattcaacatggtgttggaagtcctggccagggcaatcaggcaaaacaaagaaataaagggtattcaattaggaagaaaggaagtcgaattgtctgcagatgacatgattgtatatttagaaaaccccatcatctcagccccaaatttccttatactgataagcaacttcagcaaagtctcaggatacaaaatcaatgtgcaaaaatcacaagcattcctatacaccaataatagacaaacagccaaattgtgagtgaacacccattcacaattgctataaagagaatacctaggaatacaactttcaagggatgtgaaggacctcttcaaggagaactacaaactaccacttgaggaaataagagagaacacaaacaaatggaaaaacattccatgctcatggataggaagaatcaatatyrtgaaaatggccatactgcccaaagtaatttatagattcaatgctatccccatcaagctaccattgactttcttcacagaattggaaaaaactactttaaatttcatgtggaaccaaaaaagagcccgcatagcccagacaatcctaagcagaaagaacaaagctggaggcatcacactacctgacttcaractatactacaaggctacagtaacaaaaagagtatggtattggtatgaaaacagatatatagaccaatggaacaaaacagaggcctcagaaataacaccacacatctacaactatctgatctttgacaaacctgacaaaaagaagcactggggaaaagattccctatttaataaattgtgttgagaaaactggctagccatatgcagaaagctgaaactggatcccttcattacaccttatacaaaaattgactcaagatcgattaaagacttaaacataagacctaaaaccatgaaaactccagaaaaaaacctaggcaaataccattcaggacataggcatgggcaaagacttcatgactaaaacaccaaaagcaatggcaacaaaagccaaaactgacaaatgggatctaattaaactaaagagcttctgcmyagcaaaagaaactatcatcagagtgaacaggcaacctacagaatgggagaaaattttttgctgtctatccatctgatatacagctaatatccagaatctacaaagaacttaaacaacttcataagaataaaacaaacaaccccatcaaaaagtgggtgaaggatatgaacagacacttctcaaaagacgacatttatgcagccaacaaacatatgaaaaataggtcatcactggtcattgaagaaatgcaaatcaaaaccacagtgagataccatctcaygccaattagaatggcgatcattaaaaagtcaggaaagaacagatgctggagaggatatggagaaataggaacacttttacagtgtttgtgggagtgtaaattagttcaaccattgtaaaagacactgtggtgatccctcaaggatctagaactagaaataccatttgacccagcaatcttattactggggatatatccaaagaattataaatcattctactataaagacacatgcacacgtatgtttattggggcactgttcacaatagcaaagacttggaaccaacccaaatgcccatcaatgatagactagattttaaaaagtgccacgtatgtaccatggaatactatgcagccataaaaaaaggatgatttcatgtcctttgcagggacgtggatgaagctggaaaccatcattctcagcaaactaacacaagaacagaaaaccaaacgccacatgttctcactcataagtgggagttaaacaatggtaacacattggggggcatcacacaccagagcctgttgaggggttgggatagcattaggaaaaatacctaatgtagatgacaagttgatgggtacagcaaaaaccaccatagcacgtgtatacctgtgtaacaaacctgcacgttctgcacgtgtaccccagaacttaaagtataataaaaaaaggacatacattcaagtacccagtctaatamctgatgcatagtcagtgctttataaataattataaagctattaatagtatcattgttgaatacctactatctgcccagcacatgtattaactaattttaccatttcaccaaccttatgagaatggtgctcttattttatgcrtgaagtaactgagccacaataagtctaaggaacttggccaaagtgcacagctaaacagggctggaatccatctatacccaggcaatctgcatccagaccccttcaaccacggtgctgtattgacccactagctcttccttttacttccgggcaacttggagtgtggtgtttttctctctcagaaaagtcatgttatcttttccgcttaacacatktatcctggcttgaattaaatgtctgtaaatgtgacaatctcttttaagttccacagacatcaaatgacactattttttagtcaaataccatggacaagcttaagggactcataattcattcattgtgctcttattgagtgtaaaaataacgtgttttctaagagggcaaagttataacttcgaagaaagtgtgaagccagcaggtctcaggagggaaaaggagcttaaaacagctcaacacagtgtttctgattgtcacagtcaatgaaattatggaagcttacttataagggacttgtgaaaaaagtgatttggggcctggcaccatggctcatgcctgtaatcctaccactttgggaagctgaggcgagaggatcgcttgagcccaggagtttgagaccagcctggtcaacaagacgaaaccctgtctgtacaaacagaaattatcagggtgtggtggtgtgcgcctgtaatcccagctacttgggaygctgaggcaggaggatcgcttgagcccaggaggttgaggctgcagtgagctgtgattgcaccaccgcactccagcctgggtgacagagcaagactgtctcaaaaaaaaaaaaaaaaaaatgacttgactgggcatggtggctcacgcctgtaatcccagcactttgggaggccgaggcaggcggatcacaaggccaggagatcgagaccatcctggctaacacggtgaaaccctgtctctcctaaaaatacaaaaattagccaggtgtggcagtgtgtgcctgtagtcccagctgctggggaggctgaagcaggagaatggcatgaacccgggaggcggagcttgcagtgagccgagattgtgccactgcactccagcctgggtgacagaatgagactccgtctcaaaaaaaaaaaaaaaaaaaaaaaaaaaagacttgaggcagatttcttcgtttaagtggtgatgtttcatttctacattagtacttgaaaaatctgattagtggagttttctgtacttataaatctcagctgctctttttcggcatgaagtatgtaataacatctgtatatgccaagttaacaaaaggtttttcctgctgtcacttcattttaaaacactcttttcagtgagtgtatgtcccagtaactgcacatacttctgtccccaaagacagaacaccgcctcctttctcctaggagtatcggatatgtagtcacgtttaccatgttctgagcattttgcaaggtagttgtacatctcccctttccctggggggattagccaaggaactgaattattcattgcttgataaagattaaattgtgtttttatttaacaccaggtctaattattgatgcttttggagaactaagagaccaacaggaacaagtcaaagaagacatggaggtaagcttctccattcatgactcagcttctttgttgtcctgggccctcgttttcctcactacctttatcaatagaatcatgaatgtgggaaggaggagggggaagggcacaacttgtggtttcactggcgtgttttccattcaagcaatacatatagttgagctgcgtggtcggctgaaattgtggtggacgccacatgcatgcaaacagcgataggacaccatcctttccctccagaagtggagagactattcattcgaaaccaaagattcaatgacaagtaaatagatgattacagagcagtgtggtgagtcctttatgggagtaaagccctggagtggtagggtctctagggctggtatctgattcactcctggatggtcagggaatttcctagaagaagggatgtctgagctgaggcctgaagactgtggaagtctgtgggtttgataaggagagaggaggacagtttgggcaacctcccaaccccttctcccacaccatggacatctccaggggtaccattcacagtgggacctttgagcccatcaccacctgaaattatataccaagactgattttagggaagttgatgtgcaggtttttttcttagcagcctcagtgctaccagatgcagattaaattctgatgatgaggctggaraggaataccagtgaatgaagaatataatcactcatttgagaaatttacagtttaatatgtgggctgtgggaagcaagaaaagggctttaagcagagcagccagatgatcagatttgcattttaaaaagataactatggtttaaaatgtgaggcatgaagtagaaactggcaagaacagggacagggaagtgggctgtcagcattttccaggtgggagattctgaagcttttgctagaggtggcacatgggagttgggcaagtactgcctgaatccatctagtttctgcatcctcagcgagggacttggtgactgaccaaatggagaagatggagcaagcaaggggatatccaggcttcaggcattagccaccagatggatggtggcatagttagctgacctagggaacccagaggaagaacaggttcatcggtaaagctgatgagtgtgatttgagccacttcaatttaagagacatcattggagtggtatgaagacctgatcgattgttctccccagttgctcaatgtgacctatcagctgtcagcagttgttgatcagtaaggcaggaagaattttatacactattataatcatcttgattgtagttcctaaaatacrgggtctyataaacatgcttcagatggcataaaacagcttacaactggcagggaaggatgagcaccagagtcacatgggacaattattgaatacattgcttctccttgggttttgtggaccaggcctrtctgcaaggggcagacctaagcaggtgcccctctacagggtgcttaggagaggcgtggtccagagaaggtggaaccaagaggaccaggaatctggtccctagtgccgaaagttgttctccattcacatccactggctaattctgtacctagcacagcacctggaagacccttgctaaactgtagatgggatgtctcatagcttggtatttgatttggccttttctaaaggaaagtaatctgtacctattcccccttggtcrtccgactttgtttgggtgggtactaagtttgtagtttcagttgaagacacagttaatcctgcttagataactttagtcaatgtcatgaacaagagttgatcactaagcctggacattttcacctaggctagagaaaggaagagacgttgcttttcagccatcatcatcatcatcttgttccctgtctgcgtctgctacttcttgctgctggtacctgtgtcatttaagccaacaccaagatatagttacagcgacagttccatttatattcgtgggcttggcacagcctccatgtgatgatctttgacgtgtattgagtgaaccaaataatagctgcccctacatggcgagttgtgttttccttttgttttgctttctgaactctgacgttaatatttccctttgttttctagaccaaatgcttcatctgtgggataggcaatgattacttcgacacagtgccacatggctttgaaacccacactttacaggagcacaacttggctaattacttgtgagtgtgcccgtttcagaatcttccacctctccagtagacgccactggtccctgcccatctcagaatagagaggaagtttttgtttattgtttaaaaaataattgctgcagatactttaaaagaaagtccaacagctaatggctctcttttcctctggagtaggttgacttaagaggttaagttgcagctcttcatgtaagtgatgctttctagaacttgaaatgaagaggtggacagggaggagcagggcctctgtgggagtcttggtcatgtttctcattttagataggaattcttaggctgcttcctagggagatgcgagtctccgtttttcttcttacagatcttaagaggactttcagatctygtcaggcactgttggataccaacttaaaagctkcatttaaaaaaatattaatacatagaaatctttccattactcgagattagccaaaagtatagtttggtaaaatgctattcttactcattttccgacccaattttagtatcaaacagaagagatgccgagtagcattatagggaaaaaaaattggcttaactatactcagtggaacttgatcagtaaattacaacttctcattaagctagtcttcagttctaattcatcagtgttgatttgattctgaccagtgtgtatattcctaacttgaagcctctagggtcaaatagcaacagatcagaaaagtcaggtccacagcctttcctctttctggtacactaatttttccaaaaatttgcatgtggcgttttctctgtgctggccataattgattgcaaccatacaatttatctaaatatgccctgtttatcctaatatttccataccgttcatttctgatcagtttctctgtatctgtaggttttttctgatgtatcttataaacaaagatgaaacagaacacacaggacaggtaggtaaattattacatgtcatcttctgaaagaaatgatagagaagctctaaatatcagaacaaaatgtgtgcattaaacagtgaggcacggaattactttcagatattagttgtggtatcttgatgtaaagttcctgttatgttgaatgagtatggaaaagattgcctttgttaaagtagaattctgtactaagtttatgtaacacaataagcttttactaactgaaaatgctggatttgagttttgaattccattattttgaaaaattgagttcttaattattgcataatgtctttgattgtttaatcagatagatgatttccaatgaacttcaaagtattatgtacaatgcatgttaaatgcctaaggtgtttaagctatttgaaattcctcttccactgtgcagattgttagtagtytgaatttgaaggataygatattttaagagaaccctcagaagcataaatgtatrtatatacacacacayatatattttttgagacaaggtcttgctgttttgccaagttcaagtggcatgatcaggacctactacagccttgacttcctgggctcaataaatcctcctgtttyagccccacaagtacctgaaactacaggcatgcaccaccacacctggcttttttttgtgttttttttttttwaattttagtacagacaagatctcttatgttgctcaggctggtcttgaatgcctgaactcaagcgatcctcccacctcagcctcccaaaatgctgggattataggcttgagccagtgtgcccagccaacatatttttatcattatratggtcaggatgaagattattatgagacgttaaggtctggtatagttagttaggaaccatctaaattaatgtggacttctctattccgtgcgatataggtaacagaattgagtttctaccttatgttttgttagcacacactttggggaaaatgttaatacatttccttgacttttgcaggaatcttatgtctggaagatgtatcaagaaaggtgttgggaatttttcccagcaggggattgcttccggaaacagtatgaagaccagctaaattaaactcagacccaatcacctctaaaaaccaaaaccctacccctctctctccctctctcaatttctctgctctcttggaaacattttgctgattttgtgaattgccagcgttgtgtgttttctgggagcatcraagctctgtttcggaagagctgtttcctccccccaccttttgtatttactttgagactaaagactgaagaataatctaaattcatactcagacaaaaaaaggaattctggaaagaaaaccattctggacactgtcataacacacatagatagattttcttctgagactcccggagtcttctcgagctacgagaccttcacagagacacgtggcagccacactcacccagcctctttatttcaccatcctggaaggaaactgtctgtctaatggtcacagagcactgtagcacttaacagattgccatggacaccagttgcgaagggaaatagtgccttactatatgtgggttgagctatgcagaagatacgtgcatgaaaaaacatctttattttctttatgtcgacctttcttttcttagattgattttgtgaggttttttttttttcctttagtcttttctttagtgggggagggtaagaaaagcagtttgcacttaaaaagaaaaaaaaaaaacgggtggtgtgtctcaggacaaaaggaggctcttctcattcagctaaattcacatttgccccccccccccgcccccgcccccatatgctcctgctattattttggtaatgctctgatgcaacattgcaactttatgaaatctttgtatgaaaacaaaaagactgcaaaaaatacactttcaaaagaaaccattcattgcatgtttattatgcaagtttaaatgaacaaagaaaaccttcagaaacaagttgatcaacgtgagagaaatttcatgataattattcatagtaataaagtgtcgtgggcttaattgtatatctggagccagtgtcatccaccaacaatgtgatacaatatgaacttgacagtagttttgggttttgctcattctttcagccacctgtgatcagttttgttgattaaggacttcttgtcaggccattttttaatatcaaagctgaagcaatatccattcagggatttcatcagttgcrtcacaaaacacggatgataatatacatcactccattttttccattttgagtccttttaaatgtaatgctaacctttacaattaaaaagtcagattcagaatggaaacaaggtcattttgcaaacattggagctcttttattacaagtctgcttgttaattttagaactgtaaaaccgctctgattaaactatttaactaactttctcatcctcttctttctccatttaaaacttataactgggactcataaaatcttgagcttctaacttgaggtggatataggacaatcctaaacactgcactgagacctttaacgctgtcagatttcctggtacctctaagactgttgtgtatataattgtggggcctcagagtcaccaggcacctggcccacccctgtcatttccctgttatatgggtcagccagacctcttgaaaacctccaatgacagaaaaaaaagatcgctatctcccagattatttaatttttatatagctctcatttttgaaagctcttccttgctcagggcaaattcatttcctataataataggagttcattttctgtcttaatatgaaagagaatcggtaccctagcatgtggtgtattaaacattcaaaacccaattgaacatttgctgtgtgcaaagtgctgctgtgggtaccggtgacttctccgtcatcttacacctcaccagcacaacatcacggtgctagtatctagattttgccttttgtcttctggtatcacttttatgtgggggaagaataaatttggctgtaccataggaattttcaagactgttcagggcggtgatctgatgctctgaagactctgaataaaataaatgaggtcagctccacaaaacatcaaagagtgcactgccgtttgccaggaaacactgcagagcaagtatgtagtggaaaggaatgaatatttttccaggacataaagtccactgatagattcagatgttctagttataatgctcaaatcagaggtgacacaaagtaacagtacaggtgggaggtgagtaaataaacacatagctgcccctagattttgcaggcttttaaataggctttcctgactgcccagctctaaagttctgggagaaagagagaggctgggatttgggacacatacgtgttgaagaaagagtaaaggaacagctgattactggagaaagtcacacttcccagcctcctcactggcccaccattagaggaagactcctcttcctttccttctcaaggcctcaaaagagaagaggaagcttttctttatcagcatgaattcccccaggaaatgtctcagtgaatctcaaacacagtgtagctctccacttctctaatttaactcaggactgcgtgacccaaagtcaagaaatggaatccttttagaaatactaaatcaatactcaaagattcaccccaaaaaaaacataatgaacacacacatatccctattctcaactacaacacttacaaacatcattctgcccctatttcatctgttcctctcttttccttagaaacatcttttgcatctacgccataaaataagtttatattcacaatttaagttgaagatttccaaatgcccccggtcatcactgtccactggtactcctcggatggtcatttttcgtgtgcaggagacagtttgttctcagtccctcaagaactcatttaaaagtcatattgtaatgaaaatactttgactgtaaaaattatatcttgggaaattatacatgtattcactatcttgcttcaccagggaaatgttcatatttttctgaagctcctgttttcttgggtgaatataccaattcgatacctgttgctgttaaggtgtttgggtggctgtcagtagtgagtgcctcatttactctgggcacagtgaaagagaactttttgaaaattacacttacatggaattcaggtaaacttgacatggaacaggctggaacagttagacattccccagattatttcataaatctccattgtgttgtgaagggaatgacctgtcaccctcctgataaggtttctgcccagcactcaaaaatgtctggatagcgactggttaaatggcatccaaatcttgatacaagtgcatgggtggagctagggccttttaatagccataaatattaacagcacacatctctcacagaacaaagttcagtatcctttcatctaaaatggtataatttaattgtatggctaatatgaatctaaagcaggtaattaaataaatccttaaagtttcatgttcccaaaatcacagtttcacctaccaaccctgcatgcccataatatgttccaattcctttcataagttttatatttattttcttccaggaaacttatgaacttcatgtatgcgcattctatcttcattaagcactgctaaataggccttttaatttttattcataggaaaaaaggaatctttttataggcctggttaacaccataaagtataacaacaggtaatgatcctaacatgagcaatactatattagtgtgtaagcagaaactattatttttaagaaaagaccaaacctaaaagttgttccacataatttgaattacctgcagttgagcctcatactaaaaaatgtattaaaattagatatacataacattttacatgtaaattcagaaatgtagatataggccgatgtaatgtcaagaataagagtaacagatgaccttgaaatgataagactcttaattgccagaaggagaaattggaaatatctacttaagcttgtaatattatgaccaagctactcccacctacacaaaatgaagatgaatgaaacagaacccttgtcaacaggagttagtaaaaattcatggcccgattattgacagttgattcttcttttattttacatgcaagtagaagaaaatcaattacttaagcaagtttttttttttaaagccagtgagaaactggtagagactcttatggttttgtttaaagagtataaattatgaaatgaattcctacattttaaaatgtcatgaagagtaagtgccagaatgagttgagcctaaatgctacacacacaaaactaaatagtttagcctataattccagcactttgggaggctgaggcgggtggatcacttaagctcaggagtttgatcaccagcctgaccatcatggctaaactcccgtctctactaaaaatacaacaattaacgaggcatggtagcacatgcctgtaatcccagctactcaggaggttaaggcagaagaattgcttgaacccgggaggcagaggttgcagtgagctgagattgcaccactgcactccagcctgggtgacagagcaagactccatctcaaaaaaaaaaaaaaaaaaaagaaagaaaagtttgtattccatacttggcgtaacaaacaagaaaggaattgttccctgtttatcatgggtagtgtctacaagatatcctcttagctcgggttctcatgacgctaacctgaggcaaggattgaagtaattatgctttcttggggccactacaactgcaagtatgaggaaagcagggtataagtgaaagacgtgcagcaatgaaaatgaatgcatgagtaccctagctgctgttctaccacgagccaggaagagcaacagagctgttcagcagggacctccagtcggcacgctggagcttcacaaggcattctgtaaagagaaatagtgtcttggagtcgtccattggagggataaagaatgagaatgaatctgctacttgtctttcatctcttgtttcttrttggtcaaaggtcaccctaaggcacagcaagtccccatccaatggctagatggaatcatctgacctctaggagttcattctggatactggatccataccctgtggtaggcagttatagccaaggctggtagtagcagaagagccagaaaccctgggtgcagctggtcaacctagctatataagggratccaaagggcccaacatgccaaggacaagagactgggcagccccaggcggaagaaccatgaaaaatgtctggtgcaggaagcagaggtggaaccagtggctggaggcccaggaagcaggtggcaccaatgaaatctgaagaggcacaagaggtttgagtctgaggcaaacgtccctcacatgatttttctttggctttttatacgttttaaatatttaacaataaaaaatgagtgacagggaaaaaatagcttctaagtttggataatatggaataatgctaacatatcacagaacaaaaaaaaaactatcatctacttctatttcctcctaagagaatggtacaattagttgtataagaaaacatagatggtccactcaaatttaaaaaatacaaattcccaaagacatttcagaaaaataaaagtttcgattttgttccaagaattgatacaaccacttgttagaagcaataaaaggataaattttgcccaactttacaatggtcttctaatacttctgcccaagagtaggctaggccactttggatggtttagtgctcccatgagaagtgtttaagtacaagctacacagtaacgtttcagtattacagaaagcatgctcagtttagatgcataaaaatcatctggaggcagccagagggaacagctcccacccagggacctcgatgacaggtgtgttcctaacagatctgcagagggagggcacccagagtggatggagggaagacacaagctgggctgaaggggagaaagttgggaacactgtatgaggctactgtacattggaactcattcctggcccgcaaagactctgggggaatgggtcagttgaactggcaaggagcaacccagtcttgccacaggcctccagaaccccagcagaaggagaccccttgaccaccatgaacactcaagttggcagggagagctgcttagagaagtggtaagggcaacaagtcagctgatgtggagcccagagggtttggtgcaggagcatttgtagcagagctcaaccagggacggctatccccctaggcatggctcactcccataggagactttagccctaggggagctgtctgatctgaattccgcagggcagtcttgcccatcatagagggccagatcaacctgagcaccctttggtctgctggcctctcctggggccccagcctggccatgcctgcttgcagggcagtctcaggtgccctgggggcctgcatcataacttctgcactggcagacttgcctgaccagtggagagctccagcatggcggagcctagaggagggtccccatagggaccttctccccatactgcggcttcccctaggcccatggcaacttctcacatctccttgctgacacatgtctttgtgggcaggttttgccatccttgccccgccagcacacaggagtgcagtctgccctcccagcttcatcatctgccattgcagatgaagctttggtgggcagaaagccagccagccccaccatcaccttacccttgtgctaacactgtgcagagaacagcagatcctcccagctscctgaatgaccactcctgtttacagggcgcagaggggccacccagacttgggtccaccagcgccctccccctgagccaagaccacctctactgccactgcacacatagttgccagcaaaggcccccataactgggttgcctccaccactctggtgagtgcctgcagagaggcaggcaccccagaacccgctagcaccctggcacccactagtactgcagctgctgctacaaggaaggattctgctgtcaccacactatgaaacactttggctgacaacatccttcagagtatagtgatcagcggtctaggagcaccttggccccccaaacacagcagatttctaactccaaggagccagagaacaatctcggggcccaacacaagtccctcagagataacgtacagcagtttagtagttgggaactgagtgctggcaccctaaaaatcttccagaaatgaagccagttggctgaatccaccttattataccacaatcaaatcctcaagctcatgagataggataaaagaaaaaaaccatccataggtcagcaacctcaaagactgaaggtagataagcccacaaaatgagaatgaatcagtacaagaaccctgacaattcaaaaagccagagtgccttctttcttcca

SEQ ID NO: 10701 - DNA, 47459 bp, Homo sapiens
ggccagcagcatgacagtccccagaaggccttggaccacttgctaagtcccagcagctgagctgacttcagctgtgtgaaacgcagccccatctggagtgggggtggctcatgacttttttgctccgggagttccatagaggctgctcttgaaattggagaagcctgtagcctatgattgtccccatcccactcgaagagaatattttgagaagtctaattatatggtggggtttgcatgggatgagggaagagagtttagataaggcctttctaagggcaggttggcaaggtccagtagggagccctgggtagttctgtgaggcagcagcaccctctgtgggtagaccagaatggctgcaaccaccatgttcccacgagccttaggcgcacgcctgcagcccagcccatctacctaacagaagaggctgacctacttgctgggtgacctgcggtgagttgttgacactctctgaggctcagttgcatcaactgtaaatgaagaatagtaatccctactttgtgccgttgctgaaatgattacagagaggacatgtacccaaagtgttctgcataggacctggtacacagtaccaaatgtgtcctccaaatgtggcagttaccatcattagtcaccccaatatccccatgacccttagtatagatgaccaccgagtgccctagcataagggacaaggcttctctgagaaaaatcatagatgggactggggtgggggctagaaaggatctgtgccgctggctggttgacgttttgatttgccaattccgtctattccaattctgggagtccttgacatcggtcatgggaggctctgacaataaatacgttcataaagaattaaaaacagcccaggcgcagatgcacagtcctgtaatcccagcactttgggaggcaggaggattgcttgagcccaggaattcaagaccagtctgggtaacatagggagactccgtctctacaaaaaaaaaaaaaaaaaaacttttttttttttcagacagagccttgctctgtcgcccaggctggagtgcagtggcacgatctcagctcattgcaacctcagcctcctacgttcaagcaattctcttgcctcagcctcccgagtagctgggattacaggctcccaccaccacacccggctaatttttgtatttttagtagagacgggtttcaccatgttggccaggctggtctcgaactcctgacctcaagtgatccacctgcctcggcctcccaaagtgctgggattacaggcacaagccactgagcccagcctacaaaattctttttaaaagtagctgggcatggtggtgcatgcctgtggtcccagctactagggaggctgaggtgggaggatcacttaagcactggagtgcgaggctgcagtgagccatgatcatgccacagcacttaaacctgggtgacagagcaagactctgtttcaaaaaaaaaaagaattaaaaacaaacttgcagatagcaataagttatatgaagaaaatcaaatagagtcaagtgggtcaagccctcaaattgcccatagtctggggaggcagacatattcatgggtcattgttaaaacaggtgttgcatgcatggatggcatatgcagaggatattttgatagggacaatcaaggagggacttcctaagggaggaaaaagttggagctgaatcttcaatgatgacaagtcaaccacatgaaggaggaggaaaggacactccagatccaagacacggacgtacgcaaaggcttggaggtgtgaaatgaggcggggaatagagcaggctgtattacagggacagaagtaactggaagggcccgcgggggagccggggagccttggagctatggtgggagttgatggttgattggatatggggtggggagaagaatcaagatgacatcgagtttctggcttggatatccggtagatggtggtgctaataagacaagtataaactcctcaggtgagatgtaccgtttgggataggttgggtttaaaggaccattgggacgcccagatggagatgctcaggagacagccagggagacggaaaggacgaagcccactggccaaaggcaaataaaatcctaaattttggctgggcgcagtggctcatgcctgtaatctcagcactttgggagtccgaggcgggtggatcacgaggtcaggagatcgagactgtcctggctaatacagtgaaaccccatctctactaaacaaaatacaaaaaattagccgtgcgtggtgacaggtgcctgtagtcccagctactcgggaggctgaggcaggagaatggcgtgaacccgggaggaagagcttgcagtgagccgagatcgtgccactgctctccagactgggcaacagagtgaggctccatctcaaaagaaaaaaaaaatcctaaattttagatgagaaggccccagagctccaccacagcaatctgttgctgtgggtttttcccagaggcaaatgaatctcccaggcaacatctgatatttcctcctaaatccaaccctccttcaccctctggctggcagaaatcatccaggttgccctaaattacaagacaccagactacaattgattgtacaaatgacagttgatacaacataatgcttttttattttgttattttcatttttttgagacaggttcttgctctgttgcccaggctggagttgcagtggtgtgatcacagctcactgcagcctcgacctcctgcactcaagcaatcctcccacttcagcctcccaagtagctgggactacaggtttgcaccaccatgcttggcggattttaaatttttttgtagagacagggtctcaccatgttgcccaggctggtctcgaactcctgggctcaagggatcgatcctcccacctcagcctcccaaagttctgggattacaggtatgagccactttgcccagctggttttaattttcaattctggacatgatttccagctcttaggggagaaagacctcctaaagcaaaacgctcacctaaggctgctcagttttcctgctgtccaaagactgagagagtctggaaaacaggagcagcttttccaacccaaaagtgtggttatgaggactaaatgagactgtttatgtaaacacctttgcaagtgataaagttcagtataaacatagtgtctagcagactgtctggtgaaaagcaatatgtcactctctagacgaatggaaataaaccaaaaaaacctagggtcttatcatgaggacatctttggaaaatatgtcaggatcaggccatgaaaatttctaagtccttctgcagctgtgactttctggcatcccaaagtccagggcggaggtacagccgcccaggratttattcctccataactttgagctccccaaatccccacgaagcccaggaatgatgtgactgcagggcatgtgggcccattggcaccaacagcccctccataaatcaaggtctcacttatgctggcctcagactgctttttccaaggtgacctgggcaaactgaaagggtagttgcttatctaggggtggcatctgcctttgagatgaaagaaccctgaaaatgctaagaggaccaattctctagaaatacattcctttcaggaagagctttcttcagctcagacgacaattcagttaggagttagagacagagcggcagtcttcccatatctcagccagtttgggtgacccaagaggccccatggggcagaccagaggggccctgttccagtcctgggtcagcrccagtgaaagtcaaggtgacctcagcattgttaccagttatccacaagacagccacgtgaatcacagaatcttaaatcagagggcccaacaccctaatggttcaggcaaggaaactataggtcaaagatggggaggggcttatccaagktcacatggccttgaagagaatattccaggttagacctagaggttcaggcctcactacacaccccctttaatgaggccacactggcggtatagcggggttccagtcaaggactccagaaacagcccatccagccaattgacctggccatctcaatgtctccagtagcatccacatcggctgtgagagtggaaaccaaagactatagaaaggcgcccttcacatgtccaaaacaagcagacagaaaggggaaaaaaaaatcactcctacgaaaccccgggacctgcaaggttaacaatctacacaaacgcgtggagtgactgaagaggcaggtgccttggaggctccaggccactcctgcccaaggtaagtcccaagagtgaggccagctctgagcagatccatggagggggctggaaaaagaagctgagatgactaaaatggaaactcagtaaaaaacaaaaccaaaaaactttcttcacagaactgctgtggggattaagtgggataatggaccataatgtttggcacagagtagaaatggtttcttatattaaatggctaacaaagccaccaaggactgggtgtccttctctgggcacaccctctcgtacagaacagagctcacagtgtctagctgtctgctcacttgccgtctccaccactagagagtaaattcaatgagcagtgaccacctggcttgctcattccctgcagcatcccagcacttggtgcctgccacatagtagccactccattcgtatttatgaatgaatgaatgaacgaacaaaagaatggcacttttgccagccacccttgaaatcacctcagctcattcaccaactgcccagtttgtttgggactctcagtgcagaaacctgggcagcctcgggcaagctgcacggtatgcgacagaaagggctgactcaagccagtaagcgtcagagatgaataataagactgacaaattcttagggaggctaggtgtggtggctcacgcctgtaatcccagcactttgggaagttggagcaggatgattgcttgagcccagcctgggcaacatagccagactccatctctacaaataattttttaaaaaaattatccgggtggccgggcgcggtggctcatgcctgtaattccagtactttgggaggccgaggtgggtggctcacgaggtcaggagttcaagaccagcctggccaagatggtgaaaccccatctctactaaaaacacaaaaaaattagccgggcatgatggcggacgcctataatcccagctactcgggaggctgaggcagggaattgcttgaacccgggaggcggaggttgcagtcagccgagatcgcgccactgcactccagcctgggagacagagcgatactccatctcaaaaaaaagaaaaaaaaaaaaactacccgggtatggtggctcacacgcctgtagtcccagctactctggaggtgggaggatcgcttgagcctgggaagtcgaggctgcagtgagccaagactgcacaccggcctgggcaacagagtgagaccctgtctgaaaaaaaaaaaaaaaattggccgggcgcagtggctcatgcctgtaattccagcactttgggaggccaaggtgggcggatcacgaggtcaggagttcaagaccagtctggccaagatgatgaaaccccgtctctactaaaaatacaaaaaattagccgggtgtgatggtgtgcgcctgtaatcccagctactcgggaggctgaggcaggagaatcgcgtgaacccgggaggcggaggttgcagtgagccaagatcgcgccattgcactccagcccgggaaacagtgcgagactccatctcaaacaaacaaacaaaaattccaggaataaagaggttgaaatcggggcagggacccggataggatggctccgccccatctaagtcttagccccaccccctgaaagtcgccctgcctctcagactcctcccctttctgagaaggtcacgggggaagccaaatgggcatgcgccgctactgcgctattgcgcacgctcgctgtgcttgccccgccttccctccgcccacccgggaaacckgaagccgcctcccacttggttgctcgtacgcggctagtgggtcctcagtggatgtaggctgggcgccgcgatgttcgacgggacaccggcggagagcgacctcggggttaaggggtggggctgacgtcaggarccaagatggcggcggtggtcgcmctctccttgaggcgccggttgccggccacaacccttggcggagcctgcctgcaggtgagtcctggagcctcagagagggaaaagtcaggaaagccacagagactgcctggagctgatggggctgcggagagactgaggaagcatagggcaaggcctcagggagatggaggacctcctccccctggtgcagtgctttggtttggcttcgagcatccctgtcaagttatstttctgcgcctcgcagcagcttgtgagttagggcacgggcaattttttacagctaagggtgcggggggggggacgttcagaaaggggacttgaattgctcaaggtcacatggcaagcgaatgactgctggaaccagaatttgaatccagacattggagttccaagccctttttctgccaccaaactatcgcctctgtagaaaagggagacctgcggggtgtgaaggatgggaattgggaagcgaggtaattcctcaagggtgcgaggttgaggaccgggatgggtgaggaaaggacatgtgaattgttggggacagggcaggggaagggagagatggagggaaatgcacccagccccctacctcgaaggatcccggaggtgggtggtgggggttgcaggaaagactgggttccttaaagcagtgtcaccacagtttcactagtatcctctcagtgtttctgactctaaaggtcatataataatacggacctcatagagttgacatggaatgacaggtagagggcttggcgctgttcttgtttattactatgccgtgtgcagtaacagattttcccacgccccttgtatggccaagaaacaacacatttctgacctgccttctaagtgggaacatttagaaggggaagggaaattgcttttgtatacataagggactaaggatttgcaaatcctttctaagtctgttcctcttctgggattctcaacaacccctttaaggtgggcaagcaagaatccttaccctcctttttggagctttgaaaacttgaggcccccagaaagaaaatttttggcttgctcaaaatatcacattcccaagaagcagacctgaggcagttttttaacatggtaccagaaaaactccttagcatagatcttgggacatggttggtgtccaagaaattttagttcctcttcctctcttgcacttaaatgaggacatctttcatcttaagtgcctgctatggctgcataacacagtacatattgcccatgttccaatcctggttctatccagcatgctgtgtgtgaacttggatccactctgtctgcatcagcctttctgaaaaggggagatagaggaagaagacagcctaccagagcctcaagctgacatcctctcagtattaaattgatgattgataatgagcttgtttacctgttccttttatagttgctgagcaaacaattaaattgtgagagccccactaacgagagagttccaagcccctcttctaagaatgcattgtagaaaaggctaatttcataggtcatttttgtaattccaggcaaggtctttgcagggcctcctgagggcaacagaaaatagaagagccccaaggcctccccttccttgtgggaatgtacatgtatacccacaaaagccacctcaaaagaattcagtaatgagcttggtgtgttacctgtgggtaacattcaggttcaggttctgaattctttttatgcttatagtctgaccactgaaccacaattctgcctgtaagtatttgactgtagtatattaactattgtttgtgttgccttatttcttcatctggactatgaactcctttaggacaagaactacctacttaaaagtgtgtatcttgccagrtgcagtggctcatgcctgtaattccagcactttgggaggccaaggtgggtggatcacctgaggtcaggagttcaagaccagcccggccaacatggtgaaaccccgtctctactaaaaaaataaaaaataaaaaaattagctgggcgtggtggtgggcgcctataatcctagctacacaggaggctgaggcaggagaattgcttgaacctgggaggtggagggtgcagtgagctgaaatcgcaccattgcactccatcctgggcgacaagagcgaaactcagtctcaaaaaaaaaaaaaaaatttaaaaaatgtgcatcttgttccttaggctggcagggctaggatacctatttacaaatcagaataatacaaagactgataaggttgccaatcttgtagagcaaaaattwttttctgggctatgctagaaacttgaccccccctccccccggttatcttatgaggcagatattaatactacccaccctttacaaaggaagaaatagaatccgaaaagctaataatttgcagaagaatacacagcttgtaagtgatagagcttggatttcaagcatcaccaatcacacttttcagcaagcctgcaccttgtattttactcaggcttatcttcatacagtcctttttgctttcttcctctctatttccccaccttcttctctgkcctccaaatctttatccactccatccaactccaagcctgcaccctaaggacactttactggaggarcaacaaccagccttcagcaccattcagaattcacccttctcagttcagttgttgcttaccttgcttaaattataaactatgaaattcatactatccaagatttcctaggaatgtactttctgccttgaatactcattagtctttagattaacgtaaaaatgctttcaaggggccctctttccttttggatttgtagtataaattgctgggcaggtaacaaggggaaaaaaatcatatagtctcattgtatgattagagcaacaacttcttttgttccttggatctcattgtgaaatggaattatctttttgcactgttgcgttttatgtttgcrttttcaccactggttataatggctaaaaggttggatttttgaatcaagtgacctgtgttgctatatgatcctatcctcgtcttttaactgggaacaacaaaacatttttcatagagatgttataaagattagagattatttggcacygtgtgtgacagattataaaggttcgatgaatgaaatctggcaaatttttagatatatgtattcaacgaattttttggtggaacacagataacataatcctgagaattaactctttgtacagacctcaagatgagcaaagctctatcactttcagaaccatgaccactctggtgattttgatttcagaatcttctttcattctggtaaaccccctttgccccaccaaatattgtatgaaatacatttttttttttttttgagacagagtcacgctcacgttgttgcccaggatggagtgcagtggcggaatcttggctcaccgtaccctccgcctcccggatttcaagcaattctcctgcctcggcctcccaagtagctgagattacaggtgcccgccatcgtgcctgtctaatttttttgtatttttagtagagacggggtttcaccgtgttggccaggctgatctcraactcctgacctcaggtaatccacctgcctcggcctcccaaagtactgggattacaggcatgagccaccacgcctggcctataaaatacatttttgacacaaaacaaatttaaattagttgtactgaaaaaaaaaaaatgatgacattttrgggcactccaaaactgatgttgggatatgtcgacttagatattcagtgtagtacatcctggcattgctcttatttcacatcattcatatgataagactttttaaaaatttaaattagctctaatacaaacttagtctcttttggaaagataatacgtgatcaattatccgtgtagagtggatatgaaacagatatttaaatgttataaagaaatgttgaagggaaaacctcattgcaggtaaccacagtcatcccacaggccttgtggttctgataccsagcttgatagagcctaatgcctgttgcccactgacaatactaaatcaggctttagaactagggggttatgcctggcacagtggctcacacctgtatgtaatccagcactttgggaggctgaggcaggtggatcacgacatcaggagttcaagaccatcctggctaaaacggtgaaaccccatccctactaaaaatacaaaaaagttagccgggcrtgtgacacgcgcctgtaatcccagctacttgggaggctgaggcaggagaattgcttgaacccaggaggcagagagatctcgccactccactccagcctgggtgacagagtgagactgtctcacaaaaaaaaaaaaaaaaaaaaaaaaaaaagaactaggggattatrctccagtcccagattctgtttaaagcccggttaggggccaggcgcggttgctcacacctgtaatcccaacactttggaacgctgaggcaggtggatcacttgaggccaggagtttgagcccagcctggccaaatggcaaaaccttgtctgtactaaaaatacaaaaattagctggactttatggcacatgcctgtaatcccagctacccgggtggctgagacaggagaattgcatgagcctgaggggtggaggttgcagcgatccaagatcgcgccactgcactccagcctgagcaacagaatgagactctccaaaaaagaaaaaaaaaagtccaagttagggccagacacaatggctcacacctgtaatcccaacactttgggaggctgagatgggaggattgcttaagcccagaaattccataccagcttagccaacatggcaagaccctgtctctacaaaaattagctggacatgatggtgtgcacctatagtcccagctacttgggaggctgagtcaggatgatcgcctgagcccaggagttmaaggctgcagtgagccaygatctccagcctgggcaataaagctagaccatgtgtctataaaaataaaaaataaaggccgggcaaggtggcctgtacctataatcccagcactttgggaggccaaggcaggcggatcacctgaggtcaggagttcaagaccagcctggccaacatggtgaaaccccgtctctactaaaaatataaaaattagctcggcgtggtggcaggcacctgtagtcccagctactcaggaggctgaggcagaagaatcacttgaagtcgggaggtggaggttgcagtgagccgagatcgcgccattgtactccagcctgggggacaagagtgagaccccatctcaaaataaataaatamataaatattttaaaaaataaatgaaaaataaaagtgtccaaattagaagtaaaaacttgaagtagccccattttttaaaaggcatattgtcccacttaccctactatctgcctcaggcacagcagccacccactctggaaaatagttttgtcagttgcttaaaaaaaactaaacttgtagctaccatacagcccaacaattacacacctgggtgtttatcctgagaaatgaagatgtaacgttcacacagaaatttgtccacaaatgttcatctcagctttattcatgtcaccaaaaattagaacacccccaatgtccctcagtagttacatggttaagcaaattgtggtacatgataccttggagtgctactcagctataacaagaaaaaagctattgctgtacacagcaacttggatgaatctccggagaattcggctgaataaaaaaagccaattccaaaaggctacataccagatgattatattgatataacattcttgaaatgaccgaatttgagaagtagagaacagattagtgattgctagggcttacggagtacaggggaggtagggtgggaggaagtggacagggctataaaagggcaatgttagtgatcctgtgcttatgggaatgtcccctatcttgactagcactgtcagtattctggttgtgctggtgtgctacagtttgcaagatgttcctgttggggagactgggtaaagagtatgtgggccctggcatggtggctcatgcctatatcccaactcttcgggagggccaggcagaggatcacttggggccaggagttcaagaccagcctaggcaacacagtgagacccctatctctacaaaaataaatgtaaaaaaactaactgggcatggtggcgcatgcctgtagtcctagctactggggaagctgagatgggaggatcgcttgagtccagaaggttgaggctgcagtgagctgtgatcatgccactgcacaatcagtgacagagcaaaactctctctctttttttttttttttttagcttgagtttcactttgtcacccagggtggtatacagtggcacagtcttagctcactgcaacctttacctcccaagttcaagccattctcctgcctcagcctccctagtagctgggattacaggcacacgccaccacaccctgctaattcgtttttttgtatttttagtagggayggggtttcaccatgttggctgggctggtcttgaatccctgayctcaggtgatttcccaacctcagcctcccaaagtgctgggattacaggtgagaagagtatgtggagtctcagtattattttcttctttttgttttgttttgtttctttgaaacagcgtctcactctgtcacccaggctggagtgcagtggcgcaatcttggctcactgcaatctccgtctcccagggtcaagcgattctcctgcctctgcctcccgagtagctgggattacagacatgtgccaccacaccgggctaatttttgtatctttagtagagacggagtttcaccatgttggccaggctggtcttgaactcctgacctcaagtgattcgtctgtcttggcctcccaaagtactgggatacaggtgtgagccactgcacctggcctcagtattattttctataaatgcatatgaatctataattattaaaaaataaaaaggttggccaggcacggtggctcacgcctgtaatcctagcagtttgggaggccaaggcaggcagatcacctgaggttgggagtttgagactaccctgaccaacatagacaaaccacatctctactaaaaatacaaaattagccgggcctggtagcacatgcctgtaatcccagctactcgggagactgaggcaggagaattgcttgaaccggggaggcggaggttgtggtgagccaagattgcaccattgcactccagcctgggcaacaagagcaaaactcagtctcaaagataaataaataaataaatagkttaattttttaaaaaagcatttaactatggttatatgcagtaacatatgaatctcagaagcattatgttgagtgaaagaagctagacatgagactacgtaccgtatgatgccatttatatgaattctgtaaaaggcagactcgtgatgatagctgatcagttgctaagggtaggaaaaggggacttatgtttgccatcaagggcacaaaagacctttttggatggaaatactctgttgtaattgtggtaggattacattgctttgtcaaaactcattatacccttaaaattagtgaattttattataatgaattataccttattaaatctcacagaaaaaagaccaaaaaaaaaatgggacattaagcaagcaaagtccactggagttgataccttcaggaatctttcctctcacttcctcccaaataccacaaggtggcattagatgttcatgtcagtttacaaaatggggttcccggtgaaaaacatttgtagaaatggctttccttttgttgatgattttagccagcttggtgataaggtaaaacatagctttcatcttaactttcattttcttcatatrttttcttcttttctactgttagctgatgtttgtattttcagcttcagttaatacgggacactttaccaagaaataatgttactggtagacggtcttgaccacaagtcgtcmaggtttttagcatgttgaacaaaaaattggacaaaacacacaarcaaagcaacagaagacgaaagcatagatttattgaaatgaaagtacactccatagagtaggagtgggatygagcaagtggttcaagagccccagctgcacagtcttctgggattaaagtaccctgtacgggtttcctattagttacaccctatgcaaatgaagacttggcccgagacgaatcagaggctgtagtgaagactccctgtctctaaaccctgttctcctgcctcagtaataaacaccactgcatctttttgtaattagtcaattaaccttccgagtttttacttttctatatcagtttattttaaaaattagcagtcctggagtatagtcttttctttctttktttcttttttattttgtatttttgaaaaagagtctcactctgttgcccaggctagagtgcagtggcatgatcttggctcactgcagcctcaacctctcgggcccaagcagtcctcccacttctgcctcctgagacgcacactacgacacccagctaatttttttattttttgtagagatggggttttgccatgtttcccagactgctctcaaactcatgggctcaagcaattctctcacttctgcctcccaaagtgctgagactgcaggcatgagccaccaccctcagaccacaccccacactccttccccttaattctggtttgtcaagcctccacttagatgacatgtgaggaagccttstctgactcttcactcattgaagtctctgctgtattcatccagagctccctgtactttcccaacagtatcrctctttatattcatcgtgaatgtttaatttaactcttgttcactacaaagtaagttctgtgaagatgaaggtttttgtgtattaagtgctgtgtcactagcccctaataccatgtctgatatattagcatatgataggtgcttaatacttgttggatattgaatgcctgccttttctaagaagattatgtrtcagtaatgtgtgagtttatatccagcgttacatctgttgtgccagcaaaatggaattatcttgtatttctaatttttttttcctttttgtgaactttaaaaaatttcaggcctcccgaggagcccagacagctgcagccacagctccccgtatcaagaaatttgccatctatcgatgggacccagacaaggctggagacaaacctcatatgcagacttatgaagttgaccttaataagtgagtatctctgtgaaagccagctattgaagragagttcttgatttgatttagggacatgcttttcacatccttggaaggcttaaaaatctgagatcatccgatggctctgtttttaaaacaagaatgagcttgggccgggcacggtggctcacgcctataatcccagcactttgggaggctcaggcgggcagatcatctgaggttgggagttcaagaccaatgtggccaacatggtgaaactcccctctctactaaaaatacagaaattagctgggtatagtggctcatgcctgtaatcccagccactcaggaggctggggcacaaaaattgcttgaacccaggaggcagaggttgcagtgagctgagatcatgccattgcactccagcctgggcaacagagtgagactctgtctccaaaaaaaaaaaaaaaatgaggttgttacctgattcagaaraataataccaaaataattcccaaatgaaagtatgacaaatttctagaaatactggtataattaactttatgcacagtatttaaagtcatttaatatattaccatttttttaatgctgaatgtattgattatatcttatacatctggacctgtgttttctataataataacagaaccgccagaaacttgccttgaatggacaaggtagggatgtggttaaaatgttaaaaattggactggcgtgttagttttctatttctgtcagagcaaattaccacaaacttagtgacttaaaacaacctaaatgtattatcttatagttctgtaggtcaaaagactggtatagtctcatcagactaaaatcaaggtgtcagcaggctgcattcctttctggagcctagaggaaaatattttttgctcatttgcgctattggtggaatgcagttccttgtggttgtgagcccgaggtctctgtcattctgctgactgtaagctgagggctgttccaagcttccagaggctgccgcactccttggctcttggcctcttcttccatygtcaaaagcagcagcagcaggttgagtccttcttcacatcacatctctcaaaaccactcttcttccaacatctttcacttttaaggaactccacagttagccaaagaaaagaaagaatctrgcaagttagtctctagcctcctgctgctccactccacgcccccatataaccagaactgttctctgatctgttttatgtgtaagtgaataagtgttttatttgtttcaaacaaaagcttctgtggcaccaaaaaaaagtttgaataccacgaatactctaaatgcttaytttgactttctgtggtgacaagtaagtgctgttaatgaggtagcattaattgatatataaccttcttaaatagacaaaattttcaaatactcagcaaccaaaagtccctagcaaaattcaaaggaatagaaattgcacagaccacagttttggaccgaaatacaataaaactaaactcatattaaaaatataaacaggccgggcgcggtggctyatgactataatcccagcactttgggaagccgaggcaggtggatcactcgrggtcaggcattcaagactagcctggccaacatggtgaaaccccatctctactaaaatataaaaataagctgggcgttgtggcaggtgcctgtgatcccagctatttgggaggctgaggcatgagaatcacttgaacctgggaggcggaggttgcagtgagccgagatcgtgccactgcactccagcctgggtgacagagcaagactctgtctcaaaaaaaaaaaaaaaaaaaaaaaaaaaaactcataaaacaaaaaaccctactgcttagaaactaaaaaaaagtacacttctaactatttgatcaggaacacgtaaaaaatattgccagatacttagaaaataaagacgttgcaaatcaaaacttagagaatgtyagagaatgtggctaaaactggaagagttaaattcctttttttttttgagtcagggtctcgctgtcacccaggttacagtgcaatggcatgctcacggttcactgtagcctcaacctcccaggctcaagcaatccacctgcctcatcctcctgagtaactgggactataggcacatgccaccacacccagctaagttttgtattttttgtagaaattgagtttcactatgttgcccagcctggtctcaaactcctgggctcaagcaatccacccattttagcttcccaaagtcctaggattacaggcatgagccacagcacccagcccataacgattttttagtgataaaaaatttaaagaatctttgggtttacttccagttttgtcacagtagctctcatcagactaaccctcctacaaataacaatgatcaactccggaaaaaaatataagaaacaactgcctgaacagtagagaaggaccacgagtgggcagacattggaggggagttgatacttggaagaatgaaatggcattggacaaattaccattttactcttacatgattttgctgaggacaagtccaagttggtatgggaagtaacgggactaacagttggatggaaaaccacaatccgactgggtgcattggctcatgcctgtaatcccagcactttgggaggccaaagcaggycgacatggtgaaaccccatctctactaaaaatataaaaattagccaggcatggtggcacatgcctgtaatcccagccacttgggaggctaatgggggagaatcacttgaacatgggaggcggaggttgcagtgagccaagatcacaccactgcactccagcctgggcaacagagtgagactctgtctcaaaaaaaaaagaaaaaaaaatcttagcttgaataacgagaagacacattttgggccttccacaaccactaggaaatgagggggaaagcctagaaagaagagaaacacagaggaggagcactaaatgctgttcatgaactctgcccacatcttgcgtgcagccatattaattgcctgtgtaaaattttaaartccacacttttcagaaaaacataatgcaatccagattctctacagcatattaatttttcttttttttcttttttatttttttattttgagtctgagtttcactctgtcacctggactggagtacagtggtgcgatcttggctcactgcaacctccgcctcccgggttcaagcgattcccttgcctcagcctyctgagtagctgggactacaggcgcgcgtcacacaccgtctaatttttgtagtagagttggggtttcgccatgttggccaggctggtcttgatctcctggcctcaggtgatccacccacctcagcctcccaaagtgctgtgattacaggcatgagccaccgcgcccagtggaatttaaagaatttttaaatttcctcatagataaaggaaattatgctcataatgaaataggaaatttcagtggagaagtagaaactattgaaaagccaaatggaaaatctagtactgaaaaatataatatttgaaaaggaaaatttaccggatggccttaacagcagattggaaatggcaataagaagaatcagcaaacttaaaaatattaatagaaattatatagttttttgttgttgtttgtttgtttgtttcttgagacggagtcttgctctgtcatccaggctggagtgcagtggcgcaatcttggctcactgcaacctctgccttccaggctcaagcgattctcccacctcagcctcctgagtagctgggattacagacgtgcaccaccacgcccagctaatttgttgtatttttagtaaagacaaggtttcgccatgttggcaggctggtcttaaactcctgacctcaagtgattcacccgcctcggcctcccaaagtgctgggattmcagacgtgagccaccatgcccggccgaaattatctgttcttaagaaaaagaaagatttttgaaaagggaaagcgctcctgtgatctatggaacagcatcaaaaggtctagggcaggcatggtggctcatgtctgtaatcccagcactttgggaagctgaggcaaaaggatcacttgaggccaagagtccaagaccagcttgggcaacctgtgagaccttgtctctactaaaaaaattttttctttgaaaaattagccaggcgtggtggcacatacctgtagtcctagctacttgggatgctgaagcaggaagacagcttgagcttaggaacttgaggctgctatgagctataattgtgccactgtactccaacctgggcagcagagtaagaccatgcatgggtgagtggatggatggatgtaacacacatgtaattggacttccagaaaaaatggagagaaagaaaaggcaaaataaatatctatttgaagaactcatggccaagaatttcctgagcccatgaaagacataatttacatatccaagaagcttagtgaaccccaactaggtaaataaaaataaaactatgccctgttccatgaagtcaagttgctgacgaccaaaaataggagaaaatcttgaaagcagctggagaaaaacaacatgttacatacaaggaaaccaggtgaaaaattgctgacttctcatcagaaactagaggccaagagacagtgaaataccatctttaaagtactaaaagaaaaattgtcagcctggaattccacgttcagaaaaaaagattcttcaagatgattatgaaataaaaacattttcaggtaaacagaaaagaaaagaattcatggccagaagaccagtactacatgaaatgctataggaagttagtcaggctgaggaaaaataataccaggtggaaacttggctcttagaaaaggaatgaagagcgctggacatagtagatataaaaggatttttcctcttaattttgttaaaattaatatgactgtttaaagcaaagttattatattatattctgtaatatataactcacatagatgtaaggcatatgataactatagcgtaggggctgggaacagcaggtaaatagacctataataatgtagcaggattcttgcattacataaagttgcacaatagtaactctaaacaggtataaagagttaaagatgtaaattatgtaaagtataattctagagtaactttttttcttcttctgagacagggcctcactctgtcatccaggctggaaggcagtrgcacaatcatggctcactaaaccctcccaggctcaaccaagcaatcctccctccctgagacctcctaggctcaagcaatcctcccacctcagcctcccatgtccctgggactacaggcatgtaccactatgcctggccaattttttttttttttttttttttgtagagacagggtctcactatgttgcccacactggtctcctgggctcaagcagtcctcctgcatcagccttccaaagtgctaggattacaggtgtgagccaccatgcccagccaagagtaattatttttttaaatgcaaagagatatagctaaaaagccaatatataaattaaaattkatttctaaaaatatttacttagtctaaaaatattacttagaataagaaaagaagaagagaacagcagcaaaatgatggaacaaatagtaaaatgatagacctaaatccggccacgtcaataactgtattgaatgtaaaaactattaaatactcccagttaaaaagccaacagtgtcagaatagatttttttaaaaaaagcaaaacccaaccatatgctgttttaagtgcaagaaaaagcgcaagaaaaaataaagaaatacatttgaaaatcaatgtgattcaccatattaacagaataaagggggaaaacccatttgattgctttaatatatgcagaaaagcatttggcaagattcaacactcattcatgatttttaaaaatgataatgggttaaataattttcacagtgtgtatattttaacagaataaataaataaaactataaggaatttgaattaaaaggaatagtcctaattttacttaaataataactgctaataggaaaagaagggaacttcatcagccagatgaagactgtgaaaatcacagctaatagcatactttattgtgagatattgaacactttccccataagatcaggaataaggaaggttgtccactctgtatttgagttcaacattgtactgaaggttctagccagtccatgaaaggcaagtaaaagaagtagaaggcatatgtaagcttggaaaggaagaaattaaactaactgtagtcacaggtaacatgattgtttacatagaaaatttcagggagtctacaaaactaaaagaataagtaaatttagcaaggctgcaggatgtaaggtcaatatgcaaaatactatttgtgtgtgtgtgtatttcaatggctacagataattctatttatgctaacatcagccattcaaaattttactggaggcttagccagggaaattgggtgagaaaaagaaagaaaaggaaattggaaaagaagaagtaaaactgtctctcatagataacataatcttttacacaaaaccttgggcaggctcagtggcttgtgcttataatcccagcattttggaaggctgaagcaggagaattttttttttttgagacagagttttcgctcttgttgcccaggctggagtgcaatggcacaatcttggctcaccgcaacctccgcctcccggattcaagcaattctcctgtctcagcttcccaagtagctgggattacaggcgcctgccactacgcccagctaattcttttgtatttttggtggagatggggtttctgcgtgttggtcaggctggtctcgaactcctgacctcaggtgatctgcccacctcggcctcccaaagtgctgggattgcaggtgtgagccactgtgcctggcctgaagcaggagaattgcttgagcctgggagttggagaccagcctgggcaacaaaatgagacccccatctctacaaaaaagcaaacaaaaaattagccaggctgggtgcgatggctcacgcctgtaatcccaacattctgagaggccaaagcaggcagatgacttgagtccaggagttcaagaccaccctggacaacatggcaaaaccctgtctctactaaaaatacaaaaattagccaggcatggtagcacacacctgtaatcccagcttcttggaaggctaaggcacaagaattgcttgaacctaggtggcagaggttgcagtgagccaagatcacgccactgcactccagcctgggcaacagagcaagactgtgtctcaaaaaatttgccaggtgtggtggcacactcctgtagtccgagctacttgggagggtggggtgggaggatcacttgaacccaggaggtcgaggctgcagtgagccatgattccatgccctacactccagcctgggcaacagagggagacgctgtctcaaaaaaaaaaaagaaaagaaaatataagacattgccccctaggaactattagaactaatgaacaaattcagcaaggttggaggacacaaaactggtatacagaaatcaaatgtagtttagttttttattatgcataatttgtccatgtttatttcaacctatgtctgtcagtcttcattttatattgtaccatgttttaattatagttctatttccttctaatccgactctgaaaccctactttgtagctatgtatacacacacaaaaaatagctatattctttcattttcacaacagcataattctttttctgaaaatactggcgtgtagcagatattagcagataaatgtatttttctaggctaggcatggtggctcacacttgtaatactagcactttctttgtgaggccaaggcaggaggattgcttgaggccaggagttttgagaccagcctgggcaacaatagcaagacttagtctctacagaaaaaatgtgtgtgtgtgtgtgtatacatatatatttatatatgtatttatatttatatattcatatttatataaatatttatatttatatattcatatttatataaatatttatatttatatattcatatttatataaatatttatatttatatatgtaaaaccctgcttacctagaaaaaagcctgtaagtactgttaaaaaaacaaaaattggatttctatacactagcaatgaacaatcctaaaatgaaatttaaaaactattttccatataacagcatcaaaaaagaaattcttaggaacaaattatatgggcaacaagacaaaaccccatctctacaaaaaaagttagctgggcttgatgaccttcctgtgcctatagtcccagctacttggaggctgaggtgggagaatcacttgagcctgggaggtcaaacctgcagtgagctgtgatcacaacactgyactccatccagcctgggcgacagagtgagatcctgtctcaaaaatcaaataagtaaaagacttatatgctgaaaaactgtaaaacattgttgaaagaaatttaagaagacataaataaatggaaagacatgccctgtttgtgggttggaagacytaatgttgttaaggaggcagtgktctccaaattgatttccagattcattgcaatccccatcaaaatcccacctgccttttctgcagaagttgacaagttgattctaaaaatcttatagaaatgcaagggacccagaatatcaaacaattttggtatctatgtaaaatctgagaaaatttatgttgtactctttaatgagccctacctattaggaaatttagcatgaaacagcttaaagagaggactttgactttttaatatttttctctgtcccagtatgatctgcaggattactttttacctttgatttgaatttatttatttatttatctatttatttatttatttttttgagacagtctygctctgtctcccaggctggagtgcagtggtgcggtctcggctcactgcaacctccgcctctggggttcaagcaattttcctgcctcagcctcccaagtaattgggactacaggcacgtgcaaccacacccagctaattttttgtatttttagtagagacggtttcaccacgttagccaggatggtctcaatctcctgacctcatgatccacccgccaaggcctcccaaagtgcctcccaaagtgctgggattacaggcgtgagccacccacctggccaatttgaaatttttataggctgcaaatattagcctttgtaatgtaaaaaaaacaaagatgttgttgtcatttaaaatatgctaggacaagaacaggcagatcattagaataaaaatgtagcaacaaaacagactcaattttatctaagttcccagtattaaatatgggagaaaggtattacaaataagaagcaaaagaggatttagtcagtgatttgggacaactgatacagtttttgcagttttaggggagtaacttaaaattttttttaagtagaaaaaaaygtaaagtatttatcagacctcaggaagggcagtggtctgtttaggcttaaaagtgatagataatgttataaaagaaagaatagccacctttattaatgtaaacatttaactcatgtatgtttaaaattctgttaccaaaattagaagtcaaatagcacattactattggcagtgagggaggaagcagaaatggcaacagatataatatataagagcctcagatcatgaaaaagaatttccaagaccctggtaaacagaggcaaagaatgtggacagactgagtctctagaatgagtcctctggaacagagctttgtgcgggcaggtggtattcgtctcttttattctctgctacatccccagcatctagaacagaacctggcagagtaaatgttcaataaataattgggaaataaagaaaaattagtaaatttatgacaaacattcaacctatgtagtattcaaaagtctcgatttaaaacactgaaaacaataacacttctccagtatcagaatagcaaaggtttttaaagcttccaattcccagtgttagcagaggtccagcagaaaggacgtctacatagtgctgatacaaatacagataatgggccagacgcagtcgctcacacctgtaatcccagcatttgggaaggctgaggcaggtggatcacttgaggtcaggagtttgagaccagcctggccaacatgggaaaacctatctctactaaaaatacaaaaatttgccgggtgtggtggcatgcacctgtaatcccagctactcgggaggctgaggcaggagaatcgcttgaacccggaaggtagaggttgcagtgagccgagatcgcaccattgcctcacacccataatcccaacactttgagaatccaaggcaggaggatcacttgagtccaggagttagagaccagcctgggcaacatggcgaaatcccacctctacaaaaaaatacaaaaattaagctggatgtggtggcacatacctgtagtcccagctactggggggctgaggcaggaggatctcttgaggctgggatgcggaggttacagatctgagatcgtgccactgcactccagcctgggtaacagagcaagaccccgtctcaagaaaaaaaagaaaaaaaatgaaatacagatagtactaaagsaaatggcgtatttttaagtatatttttaatctcatgcatagaaaattagtgagtggaatgggggcagggtggcaaccagaaaatagatttgtggagcacttactgtatgccaggtactatgaaaaattacatatttttatgtaattttcacagtaaccctgtggtgtaaatattaactctacagataaactgaggttcagagagtaatttccgtagaatcacagtttctgcatgatgattattatagttaaactatgatttatatgtcagatgctgctgtaaagatctcgtgtgtattaactcacctccagcaatcctgtgggatgcaggtgctgctctctgcactcagtggattaaatgcctaggcagaaattaaatcatttgcctgcaagctggtaagtggctcagccatggtgcagaccagtctcttggctgccaggccggcactccaggtcccacgcccagggatgctccgcttagtaccatgtcactgcccttgtatgttctaggaggctcacagtgatttgactgggggactgtgagtgattgggtgtcttttattctctgtactatgtcttctcttatggttatgtattattaattactatttaaaactattgtctacatcctaaaaatcaaactaaaatttgaaataaattatttggaaaaactttgcagggagcttcagaagtaaaaaacaaaaactcggccactgtatggaagttgtgtcatacttgtctactactactttagctttccatttcctagaaatgtgtttgcactgtgatcatcaaaatagaactgtgcagtacttaaaatgtaagaatctgcaaaaacaaaactacagaacaaattccgaaggtgacctgagaagaccaaatggataagctaatacatccaggtgtctccgattatattatgataaagtgtagggaggttgaackttacataaataccactggatatttttctttgttagatgtggccccatggtattggatgctttaatcaagattaagaatgaagttgactctactttgaccttccgaagatcatgcagagaaggtgagcatttcattcctgttgggctccagatacttgtggtcttccaaagaggcttgggctggccaaagctgatagagacatctggaaaacagctgcagctctctgctgggtgaacttgctgtgcaacctaattccttttcttgggtaaatgcatccaaaattctaaccrtggtgcaagttctggtttctgagtttactttccttcaggagcattctatcctgtggttactgcatctggcggtccctgtgagctgctccacgcttcaaggcctagctaggacctgctggctggcaccttccatgctgctgagctcttttattaagggagcagtggagagtttctgtctggcacttatgcttgtccagcaggggagatgtgtgagtctccctcagctcccagcatgacatgtccttggtagctgtgttctggattggctggtacagtgtctccctcagcatgtggttacttgtgctgctggtgccacatgagcccatttgaggcagtgtgcagactaacattttctacatgaatagcaatgtattcattttctgtattagaaaaatataattactgccgggtgcggtggctcacacctgtaatcccagcactttgggaggccgaggcgggtggatcagctggcgtcaggagttcgagatcaacctggccaacatggtgaaaccttgtctctactaaaaatacaaaaattagccggstgatagcggacgcctgtaatcctggctactcgggaggctgaggcaggaacccgggaggtggagtttgcagtgagccaagatcacgccactgcactccagcctgggcaatagagcgagacagtctcaaaaaaaaaaaaaagaaaaatataattactaatgatggtataatagggatataagtggttttttaatgtgaatttaagcaaaacaagttaaagaaaacccaagagatactttaaagaaagttgattcaggtggttctcaggtatagcaaaaattgcacagggtgcagtgaagaccgactggcctgatgtccgtggagccagactgtgtgcccggctctgttctgtgcactggacatgaggtagatgactgtgcttattatctaccttcaatttaaaggtgaggcccagagagggtaatggacttccacaaggacacatagagagtgacttgagagccgggagtcagccaaagctgtcagactccagactccagatctgctctctcaggcactgacttggcttggaacacctgggataaaacaaaagcagagagtagcttgattctgtgaggacactgagcttttttctaagaaaaccttaaaaaaaaaggaaaagccagtattgataccggcccatggctttttatctgttcagctgtacatttcaagcatttcaagtcttttaagacatctgttttgattcagctaatcttatttagcgttgcaaatgctgatggatattatgatagttcggctgagtcctgctgttcagggaacattctgcggcagttaaacagcagccttccccattaagtcctggcaacacaggaaaggtagatgcttttcagtaacctttccctgtaggactctttcagagccaagaacataaggtgtgacccatctggactaaaaaaaataaagcagaattgtatcaattgctactcctttttattcccatcttgtttttcttattttttttttaattcccatcttgtaagagaattcccagggagcctttttgagagaaagttcattggatttatttttttaatttttatgccatttcttgtaaaagcaaactgctctagttggatgccaggtatacataaatgtattgataatatccagtctcttggggaactctaggagtatttgcttaagacacatctttgggttcccttacactctttctaagatttacaggagaaggagagtcttaytgtcttttctagtcttatgaaagtgataaccgactgggcgcagtggctcacgcctgtgatcccagtactttgggaggtctaggtggtaggctagcttgaggctaggagtttaagaccagcctgggaaacatagactccctttccatttaaaaaaaaaaaaaaaaaggtgaggccaggcattcagaggccgaggcgggcagatcacaaggtcagagttcgagaccagcctgaccaacgtggtaaaaccccgtctctactaaaaatacaaaaattagccaggtgtggtggcgggcgtctataatcccagctactcaggaggctgaggcaggagaatcacttgaacscgggaggcagaggttgcagtaagccgagatcgtgccactgcactccagcctgggcgacagagcaagactccatctaaaaaaaaaaaaagatgataaccagtgcaactttctcaagcaatcaggtttctctgacctaatgatcttcaaaaaacagcttcagaggactggcactagaggtttagagtacataatcatttttaaattccaaaacacccaggaaatttccatatacaggaagtaggtccaggctaagaaaattctcatgtcggggtcctgggtcagcacgttttttgtttagtttgctttgctttgcctcagtttcatattagttcattcttctcctctttggaaagtccatgctgagtcagcttttgtggatttcatagccccagggtactatgctgcgtattttatgaagacaatagaagaagccttacctctgtcaagtgtagtggctcaggcctgtaatcccaacacagtgggaggcaaaggcagaaggattacttgaggccgtgagttagagaccagcctgggcaatatagtgagacacctgctctacaaaaaacaattatttttttcttttttttgagatggaatcttgctctgtcacccaggctggagtgcagtggcgcgatctctgctcactgcaaccttctcctcctcagttcaaatgattctcccgcctcaccctcctgagtagctgggattacaggcacccaccacgacttatatttttagtagagacagggggttaccatgttggccaaactggtctcgaactcctgacctcaagtgatctgcccacctcagcctcccaaagtgctgggattccaggtgtgagccacttcacccaacctacaaagaatttttttgaattcgccgcacatggcggcatgtgcctgtagtcccaactactcaggaggctgtggtgggaggatcgcttgagcccagaagtttgaggctaaagtgagctacagtgagctatgactccaccactgtacttcagcctgggtgacacagcaagactcagccaagaaaaaaaaagaagaagagctatctcttaataatctgtatccaggtcacttcaaccttaagatgaccaagacaatgttgatttactttacttttgggtattgtgtctgttagatttgtgttcaaataacagtggctttaaaaaatctaggtttccaggcgtgagccaccacacccacccctactcaggaggctgaggcaggagaatcacttgaactggggaggcggaggttgcagtgagccaagatcgcggcattgcactccagcctgggcaacaagagcaaaactccttctcaaagaaaaaaaaaaaaataggcttgacgggtgtgtggtggcccagacctgtaatcccagtgcttcgggaggccaaggcaggcagattacttgagcccagcagttcaagcccagcctgggcaacataacaaaaccctgtctctgcaagtctcgtctctacaaaaaataccagaaaattagctgggtgtggtgggctacttctgtagtcccagctacttaggaggctgaggtgggaggatcacttgagctcaggcattgaggactgcagtgagctgtgattgcaccactgcactccagcctgggtgacagagtgagaccctttctttaaaaaaaaaaaaaaaaaaaaaaaaaaaaaacaggctgatttttcttcaaaacacgtgacacatggagctagaactgctgtggaaactccatggtgccagcagcgcccaggcctctggcctcctccagtgccatacttggcatgtggcttctaacctcaaggttgccacatggtcatagagtagtttttggaactcaagccattagaaccacattcgaggcaggaagaaggagggaagggagaaaagccaacaggcacctctgtcagaggaatgttgcatgtcagtgctgcccctgatggcacagcaaggaggatccagaagaaagtatttggggcaggactgattccggatatgggtgaggatgtgttaaatgtgtgtctctttcaggcatctgtggctcttgtgcaatgaacatcaatggaggcaacactctagcttgcacccgaaggattgacaccaacctcaataaggtctcaaaaatctaccctcttccacacatgtatgtgataaaggatcttgttcccgtgagtttctgcatctctctggttttgtttttatttgcatggggggcagtgctatgtgtgttacgctattagtttttcagggmaggatttgtttgagtatttaaggctcctcttctagtcagatagtaaatagatgggactgtttcctatattatggcaggaggaggaccacagtgtcactgagagattaggaaaatctccagatctgagacagtgtggccagagtttaattaaagaatttgaatggcagaagataaacgcctagaaaatcctccagcagctcatttggtgaggtttgtttgagaataatggggcacagaattttagaattggaacattcccagaaatgaataatttggccataactacaaagaaatcatgtggaaaatgccagttgggaaagcaacagctgtttatgagtcccactttaatttctacctccctatatttgaacacctttgctgacgtggtgttttcaagggcagaaargactgtgrgattggcaggtrtcccaagtaggtgagggagaggtttcctaaccatgcttaacattgtgaccatttttccttttgtaatctttgcatatattcatgacaaaggaaaagagtctggcttctgcctggcatagagtggacgagtagtcagtgtccaagaaatggggtaaataaagctgaggtgatgatggaatctgatccttttcttcttcttcttcttcttcttcctcttaaccacaggatttgagcaacttctatgcacagtacaaatccattgagccttatttgaagaagaaggatgaayctcaggaaggcaagcagcagtatctgcagtccatagaagagcgtgagaaactggtcattagtccctatttattgtttcaatctgaagaatttattgcaaagatgattgccaggagtgtggcttggcagggaacataagctgatgcaagccatttagtgtattctggagaggaactggcacaagggtggggcactcatcctcttagggccgggtgagtagtgtgaacccgtgaatggcccagagtggaccaaggagctagagccctgtgccccgcctgcaggggcgggtggttgctgtgtggctactccmtctttttcaaaagaaaccagtatgtaaattgcctgggctttaaaaagtgaccactaagtcagaactgttccctcactgggggcaaaatgaaacacatatgctggccagttgtaactaccaccgtcctgctttacaaatgggagtgaaatgttaatggcaaaacagagtcatcgatattctttcctgacaccatacttctggtgatctgtggggtgggattattcctggcctgctcactctctgggagttgccattcctgtgtacaagctgtaaaatcttaaagcggaggcatcattatcaagttttcagtctttcttcttctacactacttctactcctctgcgaagaagtcttctctgatttgcatactccctgcatacttgtggacgtgaggtaggaaggggaccaaatggagacagagccccacctgcaggtctgcacagggccaagggcaatggctgtgtcttcttcctttctggatccctaggccctggcgcatgttattttatccataaatattagttatgtaaatactgtaaaaatatatataaattttttaaaaggccagatgcagtggtgcattctgatagtcccagctactcaggaggctgaggtaggaggatcacctgagcccaggagtttgagagtctgagagtttgaggccagcccgggcaacatagcccaggttttgtctctaaaacatatacatatatgtgaatatatgaaaagtatcagttgtatgaatgaataaattaattctaccttttgagacttggtaaatatttagcatcctctcctgttgcccataaaacgttaagaaaggggagtccggccaggtgcagtggctcatctgtaatcccagcacttagggaggccgaggtgggcggatcacttgaggtcagttgttcgagaccagcctggccaacgtgataaaaccccatctttactgaaaatacaaaaattagctgagtgtggtggctcacacctataatcccagctactcaggaggccaaggcaggagaatctcttgaacccgggaggtggaggtttcagtgagccaaggttgtgccactgtacttcagcctgggcaacagagcaagactccgtctcaaagaaaaaaagaaaagagaaaaaggggagtcctagtaagtgtgcccagtctgtcaccatcaagatagtgagggtcagcacagtggcctgcaagtcagagtaagcctgggatgagacttcagagctgctcttctcagactgcagctctgctcctcagtttctacctcccagagtcttgtgcatcccagagtccaggctgaaccgggccctctggcccagcgagtcctttgcattcctaggcaaggctggtgcgtagctagtgaacatctccctgatgtggtattattagggattgaagagttcccctgagcatgtttggttttctagatacaagttgagtattccttatcctaaatgcttgggtttcagtgtttggggtttcatatgttttcagattttggaatatttgccttacacttactagttgagcaccccaaatccgaaatctgaaatccatgctccagtgaacatttcctttgagcagcatattggtgctcaaaaagtttcagattttggaacattttggatttcagattttcagatttgggatgcccaacctgtaatagaaatttactcatttactcatttacataccaaacatttaacattttttggcttccttaaattagtatgctgaacttaataaataattggaaaatgtggagaaatttatgtatgtatttatttttaattgggcagcccccaaaccaaaataggttcagagaggctccatcattttttaaataagctataattttcagcctggggaacatagggcgaccctgtctctacaaaaactttaaaacttagccaggcatggtggtatgcacctatagtcccagctactcaggaggctgagatgggaggattgcttgagcacaagagttccaggctgcagtgaactgtgattgtgccactgcactccagccaggggcacacagcaagaccctgtctcaaaaaaaaaaaaaaaaagaatttataattccaccaccaaaacataatctctgttaatatttatagtttcctttgttttttgtttattacattatatttttatgtagctgggatcaaaatgtaaatatgcttttatatcctgcttttttcacttatgttattgtgagcattttcttcatattcttaaaattgttcataagcattaacttacactttgctttctactgcttcagatgtatgcaccatgcgccataaaaccatttcactgttgctggacaatgaaattgtttccaattttttactrttagarataaggctagatgaacatctttatccttcaagttctgcccaaaacattctaatttcttattacagatttttctaggagtgggttaaagaatatgactattcttaaggctcttaatcctgtgaccttatgccttctagaccagtggggccagttgacactcccaccagctgtctggacataacatagatttggttgaagactcatggttcaatcacaaccatcagttctgtctcatctgttctcaactgtcacttcaggtgtcagtgggcccctttcattttgctgtttttaatccatttctgttgtttccaaactcagaaagtccggtttgtgtttgggacttgttgggcagattgacccagtgtggcaggtgtgaaagtgcaggaagccagagccagctgccggggccacatcctggttctgctgcctatagtggcacgtccctgggcacatggcctaactcactctcctcgccttggttccttacctgtaagtggaacttgctggagtcacctcacaggattactgtgatgatcagttaaggaaagcgtgtaaggcgcagggcctccgtcaggattggcagtggcagtcactggggatgatgttgatgttcccagtgaaaacctgagggcccttctgctgagcccagggcagaagcagctacagactcctgctgcttcagyccctaggcttttgaatctctcccgtcttgacctcattccaggaagctggaatttatgggagttgtttttgtgttcttgttttctatttcttttttagacaagtgagaggttcttgtttattaaagggaaagtgcactatacgtggatttaagaaccctgggcagatgtttacatttcacttgcaagatctttattaatctgctaaatatctgcaaatcaccccttggattttgctaagaaaattcacatgcaagtaggcactttgttcatgcactgaccccaaaggtaacatttaatcagctgaagacatagcagagtctctcccgtcacaagctcctgcctctcttttctccccatacaggacgggctctacgagtgcattctctgtgcctgctgtagcaccagctgccccagctactggtggaacggagacaaatatctggggcctgcagttcttatgcaggtgaggtgctccttaattgctttaagagaaattgaaactcaagcatccagaagtccaagaggacaatagattgctgtaagccagccattctgaggggcctggtttccttcattgccatccagtccaaacagggtaattggttgcattgtattcacttgctttcggtaaatctggggccttgtctgcaaattgcctttgtttcagtgcagtgagggtcaccccaarggggcgcaaaccatgccttgcagatgtttaaaatgtatttccgtttgcctggtggtcagaggctccccctctccctctcataggatttgtaacataagayttgtagcgagcaagcaggggagaaagcagtgtctttgaagggcagctgcccagctatgagattggaagctgtttcccagctaatgaaagcctggatttaggggttgcttagaaagaaaatagtattgatgttcactgcaaagaaagtcactgtctttgttcccagaaagcttgtgcttttttagatacgtgcttttcacagactctaggcaactcaaaaaccaacttctctttctcattttcccacaaaaagagaagttacaggtttgtgtgaccacatgagcaatattgattcccagccatgtgaagattgrataatgaagtacactcatacttgtcacttttrccagctgctccgagttggggatgtagaggtcctctaagtaacactgctagagcaggcctatggtcatgtgattaactcrtttcagcctgctgatctcaggctgctgagagcgctgtgtaagttcaaagaatcattaagtgggacaaatactatctgtagacaggtctgttaaatcattcctttactcaragacagcaagtccagcatgggtaggtgccatgaagacagataagagttatatgatacagtccctgccttcaccaaattataagctgggtaggaagctattgagcaatgtgaaataattaggagatgatacccagtgtgtataattaagcacccgggtaccaggtgcagtatggatcaaaggtttgcagggaccattaatcaagtgaagctacaagtgttgggaacctttccttgaaagatggacaagaattaaagagtatggagatgaggcatctaagctgagtgaattccctttcctctgcactcccagagctttgagttgagccagggtgccgctctggcctgttgattggcagctcagctaatcatccctggttttccaggcctatcgctggatgattgactccagagatgacttcacagaggagcgcctggccaagctgcaggacccattctctctataccgctgccacaccatcatgaactgcacaaggacctgtcctaaggtacgtggggctggtgaccctcagctctgcctcagagctgacacgccagaagtagcatgtgctcacaaagaggtgattggcagagagcaaccctagtcatttgagaaggaaagggaccagcatatgcctgtcctttcagtgtgagcctaggggctagtttggctcttagttgcaaggagtagactgactcgggccacctcaggagcaggctttatttgtaggctacacagggacattgtgggagttaaggatgcasaggaacccatgagcaggtacctgcgttcaaccttcccaggaaacagaaagcgaaagccgttggaacgtgggcagctgtgaggacttcatttcttctccatctttctcgcgatgtcagctgctaatctgctctgctctctagcagcctgttctttccttcggctctgtggaggttttctctgactcaaagctctggctttcgttcctcttcctgctcgcatttgctgctgcttttggctcactctggcctggattttgcctcccagcacacttccagcttcagccacccgcctgcctcccagcmcttctcagcacagtttcctgagagggtgtcgcattggcccagctcaccttctcatgcctgcacatcagaggccacagctggctacagaccggctgccctttggccaggttctgtctcagtctgttttgtggtactatcacagaatttcagactgggtaattttataaagaagtttatttgacgcacagctctagaggctggcgccagcatctaacaagaaccttcgtgctgtattaccccatggcaaaaggcagaagggcaagagaaagggagcccaagctcagccttttttttttttggagacagagtttcgctcttgttgcccaggctggagtgcaatggcacgatcgatctcagctcaccacaacctccgcctcccaggttcaagtgattctcctgcattcgcctcccgagtagctgggattacaggcaggcaccactcatgcctggctaattttgtatttttagtagagatagggtttctctatgttggtcaggctggtctcgaactcccgacctcaggtgatccacccaccttggcctcccaaagtgctgggattacaggcgtgagccaccgcgaccggcccttctcatctgttttttttaaaagacagggtctcactgtgttgcccaggctggggtgcagtggcgcaatcatagctcactgcagcctggaactgctggccttaagtgatcctcctacctcctgagtagctgggactacaggcacacaccaccacacctgactaatccaaactcatccttttatcaggaacttactcctatgataatggcaatccatttgtgagggcagagccttcataatctaatcacttcttaaaggtcccacctctcaatactgttgcattggggattaggttttcaacacatgagcttttggggacacattcaaaccatagcaggtgtcagccctggtccagtcagccttgcccagtgggcagggaagggctagggctgtgtggttcrgaacacggctgccctccgagcaaagactrtgggtgatttcactcaaaagttgcagtgagtcagtgggcggcaaggtggaaaactgtagggtggccagttagccgtaaaaaaagatcacactgtgtgtttgaaaacatgaaatccaagctgtagaattcacttattttttgcctggaaaccctctgtgtttccagtggcctcgctgggggagcccacaggcttcagctccctattgcctgggcttccatctgggtcctgtccccaggactgtggtttaccatgattgtgcctgtgaatagctactgacctctgaggcaagttatgctataaaagtgcttggaacagtgcctggcacatagtaagcacccaataaatgtcaccttatgttattttttaaaaaaacatgagtactgggcttgtttgagacagagatagcatcttcagtggtggggcctggctgtgtgtttcttcagaagctctgcgagtgactctaaggtgcattcctggtcacaaacctgtgcatggaggggatgggtgcagcagacaactgagacagccaagaacaggttctctgtgccttgccctcccttctgtaaaacagggctggaagttgggactgagacatagacataggccgatcatgaaactggaagggacttgaaaaccatcaagtttaatccccttatacagatggggaaattgagccccaggtggggaggggagtgactcgccccagatcactgtcaggtcagtgggaaggtaggactagagttaggccgtctgcctccccatccagtgctctttcttcctgcatggattgggtatgtaccaaccttctaagtctaaacacccttactgaccctgtggggaccggaaatacacaggtagatccagattcagaaggatatacagtgaaaattctccctcccactccacccagccacctccctagaagtcagattcttgtgtgaacttcagaggtgttttatgctgcacacaaatgcatatgtgtcctcttctgtctttcttatatcacatttatctgtattttttcacccactatattttggagattatcccatgttggtatatgaagagtgtctttttgaccagcctggacaacrtagtgagatcccatctctacaaacaaaaatttttttaattagccaggtgtggtggcacgcacctgtagtttcagttacttgagaggctgaggccggaggatcacttgagccaggtgttccaggccacagtgaactatgatcacacttcagcctggatgacagagcaagaccctgtcaaaaaaatatatattttttctttctcttcttctctcaagatctcttttctttctttccttttcttctttctttccacaacacttttttaggggggtagacttatccttctaaaatgaggggaaccttcactaacgtcagatgagtacttgtctcattttaccaagtacttgcttggtaaaagcaagtacttggtaaagtacttcctactttctacttcaatgaagctggcattcagtgggtttaattattgtgcctcctgcaaagcagatgttaacagctgtaggggcaaactgcagctaataccaatggtattggccagttgaaatcatcatggttttacaaagggttaayagagagggtagtttcttccacatacttttgagagctggtatatgctgatttctgctgctgcctatttaataatgatgatgtaaaagatttagagatgtctggctgattttgacattggcctgtagtcctagaagagacactaccctgagtgtctttgagcagtcagagagtgcacctctgccctgggcctgtttacctgttagagtgagccacacaagaaggaattcaacgtggcagagctcttgccagagggagctgaccatcttcaaatgttaaaaaaggtagacagaagagagcccttagcccaacccctatggttttgagggacttgatttgcattcaccttgcttggacactgaaccagctgaggaaggagtttcacccaagattgtgggttttccctttcagtttcagttatcatttgttattgattcttttctcttttttcaagggtctgaatccagggaaagctattgcagagatcaagaaaatgatggcaacctataaggagaagaaagcttcagtttaactgtttccatgctaaacatgatttataaccagctcagagctgaacataatttatatctaatttgagttcctttaaagatcttggttttccatgaatacagcatgtataataaaaattttaagaaataaatgttattctactttattaacaaaaaaaaaagaacctgttcctttacttgccgcaggggaatgtgaaggtgccaggagtccttgtccttggagagatggacagggcttcagagctgagcgggggtgggggtaccctagctggaaggaggtgatgagccgtggaactgacatcaggcagggcctgcagcttgttcccagctttgccactcaccagctagacaaccttggacaagttccttcacctctttgctgctccattcgcccatctgtaagatgggatccataattgtgcctacttcattcatctggtatgagaatgcctggcacttattctgaacactcagttagtgttagtgttctgtatcttcccagtttctatagttttcagtaccagaattactgaaaaccaaatcttggtaagtctttggatacgtcggtgaggccaggtttgagattcctccagcacagagcaatgaccctggtcagttgtgaatccagttagttccacaaatgacctcgtggggcctctcactgcaaacatcaactccacagcactgctgccttggctggcatgctcactgcacagccgggcgtggtggctcacgcctgtaatcccagcactttgggaggctgaggcgggaggatcatttgaggtgaggagttcaagaccagcctggccaacgtggtgaaaccccgtctctactaaaaatacaaaaattagctgggcagtgggtgtgcgtgcctgtaatcccagctacttgggaggctgaggcaggagaatcacttgagcctgggaggtggaggttgcggtgaccgagatcacaccgctgcactccagtgtgagcaacagagtgagaccctgtctccacaaaacaaaaaagcaatgcaaaaaaggagaaagggggaaagtaaaagtggaagctcctccaaactcatcccgttgatagcttagacatttccttccacactctacgttattacagttatgcagcatatataaaactttctcccttcaaaagtaaggtaccatagagccaggagctgtggcgtgtgcccctaatccagctactcaggaggctggggtgggagcatcacgtgagcccaagaggtcggggctatggtttgccatgattgcgcctgtgaatagttactgcgctccagcctgggcaacatagtgagaccccattcctttaaaaaaaaaaaaaaaaaaaagcctggaacagtggcttctagcacttttgggaagccaaggtgggaggattgcttgaggccaggacttcaagatcaacctggccaacatagtgagaccctgtctcttttttttcttaacataccaaaaaagattttaaaaataaaggggtatcctatagtctgccagcagctattttttttttttttttgagacagagtcccaaaaaaaaaactgcactccgcctcccgggttcacgccattctcctgcctcagcctcccaagtagctgggcctacaggcgcccgccactatgcctggctaatttttttgtatttttagtagagacggggtttcaccgtgttagccaggatggtcttgatctcctgaactcgtcatccgcccgtctcagcctcccaaagtgctgggattacaggtgtgagccactgcgcccggcctctatttttacctcacaatgtagaagggatttcagtgctaataaagacctacctttttgttgttgttgttttgttgtgtgtttttttttttttttttttttttgagacagagtctcgctctgtcgtccaggctggagtgtggtggcgcgatctcggctcactgcaggctccgcctcctgggttcacgtcattctcctgcctcagcctccagagcagctgggactacaggggcccgccaccacgcccggctaattttttgtatttttagtagagatagggtttcaccgtgttagccaggatggtctcgatctcctgacctcgtgatccgcccgcctcggcctcccaaagtgctgggattacaggcatgagccaccgtgcccagccaagacctcccttatctgtgtgtgtgtgtatgtaaaaatttttggaactcctgcttaagagcactgtggcatgggtgtacccttatttaaccattcccctactaaggcacattcgggtggtccctattcaccttttcatccaaggctgcttttttaagtcgtagctggaaacctctggatcatccggaaaacaaaggtttcatgcatcctgaggcaagcagctgagaaaacgtgtgactcaccgagaatgagccttaatgagcattttctggcttaaagggctgattcaacaagcatctgtctcaggcattatggaaggtgaggtgctggggacaaggatgaacaagatttgttgcctgcctgccacctaggagccaaggtcacaaaggaaaaggaacaaacatcagaaatttcaagaacagggccgtgtgcccctccctacagcatcttggaattcttgactatctcagtgagacacacagtacttggccctgcggcgctgaagcctaagattgtggagtgcactggcttcttgaaagacagtggaacttgaactgcgggccatgtctgtggatagcttctgttccccagctcagacctaatggctttctatcagcctggggaaaggtcacattccttggattcatggataatttgacttggcttctaatctccagatctgtagggaaagatgggtttttctcatgaatgacttttttttttttttttttttttttttggagtctcgctctgtcaccaggctggagtgcagtggtgcaatcttggctcactgcaacttccgcctcccaagttcaagcgattctcctgcctcagcctcccaactagctggggttaacaggcgttacgcagctaatttttgtatttttagtagagacagggtttcaccatgtttgttgagcatactgatctctaactcaagcgatccacctgcctcgacctcccagagtgctgggattacaggtgtgggcaagcacaccctgcttctcatgaacaacttaatgctttgtaaagatgggtccgcaacaactgataagaggcagggtgtagcttaggagtcgccacttcagatcagcgtcatcagaggctgggttgactctgatggtcactctccgcagttgaactccaagttaaattggtatatgttatcaactgatagtttactgcttaatctttcattgaattggagacaaatgttctattgcaacagtcacaaaggcttttccagtaaaactgcagacctgtgtggggaacagtattttgtcctgtatgctacttctgtgcccagtgtgccttcatttacaagataatacttccagcctggccctgtggctcacgcctataatcctagcgctttgggaggtgggaggattgcttgagcccaggagttagaggctgccgtgaactaggatcgtgcctctgcactccagcctggatcacagagccagagcctgtctctaaagaaattaaaaataaaaatagaatttcgtaggactgaagccagccatcccttcttacctagctctggacatgttgaacatctgtgactctattttcctatctgtaaaatgggaattaacagcattcccctctcagaattatggttgaagtctaaaagtaaatgtgaaagcatcttgcctgcagtagagtaaatgctccataaactcaagtgaacggatttgtcttgagtacctactatgtgaaaggccctcgagtgaatgctgggaggctgcaagagtaattccttcccaaccctgagttgacagctggcatgtttctgacatgactggccagagctagaggcctccctgttgggaggatggtttttccgtgcaaggctaatattgcttatttctcatctctcccgtcacactgctcaggtcagggagggactcccattggtcaaattctcttcaggccccttcccttcctggcaccaggataactaccatacaaagtgctgaaactcggccaggcacagtggctcactcctgtaatcccactttgggagaccaaggtggatctctgaagcacaggagttcgagaccagcctgggtaacatggcaaaccccatctctacaaaaaaaaaaaacagaaaaattagctgggtgtggtagcgctcacctgtagtcccaggtacacagaaggctgaggtgggaggatcacttgagccgaggtgggaggatcacttgagcccaggaggtcgaggctgcagtgagctgagatcatgccactgtgctccaacctgggcagcagagagagaccctgtctcaaaacaaacaaacaaaaaaaacaaaaacaaaaactgaaaccccactttactgtgtgtctagacagccataatcctaccaacagggtttgttactaggtgaaaaaaatcctcttttgttgcaaaaatctagtgaaactagagaagtcgaaaagtaaagcaatgctctggaataaactcgcccaaattagtgatttctcaagctttttgccactgggaccaggcctattacgccctctccgtgggttcccaagagagccacagcctagaagggaagctgttcagtcggttctcacccacgtgggactggaaatttcagacacggttatccgggaagacagcctgggccacagacctcctcgatgaccacacaccgagagccacttccccaaaggtaaccccaagcagatggcaaggcctcccacatgctctgtggtttggaaggaagcttcctctggcctcctccctcattaaggagaagggacgagctgcaggtgcggctccttcccagctggctcagggaatagagcccctttaaggccaggcagccttagcaataaaaagaatgaagggggcacccttgcaaggcagtcccccatgcagtccccaagccctctgcttttatttatttatttatttatttatttatttatttatttatttattttagagggagtctcagtctttcacccagactggagtacctctgcttttatgaagccgctaatccagtgccaggatctaaagcaagcagctggcttctaccaagttcctgccatctcatttcatcctctccatgccttccattttgtaggtgaggggaaggagagccttagagaaggaaagtgacattttaaagctcacacagctagaaagcaactcatgcatccatgtctttctgatgccagaacccagccccttgccactgtaccatactgcctcttgccaaggccacctgggctagccatttccaaacccagccttcctgctgccctggaggctgggttcctgccagaaattgagctaagccctgggggaggacatgggagttctgaaaagttaagcagcctgcctcccctggaagtgtcaccggaagatgaaagaactcttgtcacctgacccaaggaagccagtcccatggcccaggtggtcaacaggaatgacccgcaactggttggctcgggcagcctgccccagctgagtaaatggctccactggcacccagctgctcaggccaaaaccctggggagcatcttgaattccacacattcctgcacccccacatcctatccaccagcaagtcctgccaacgtgtgttcctgtaccaaatgttcactgggatcttgctatgaatcaggtgctgctttccctcctggggtctatcccctacccacaccctcaccaccatcacagctgtgtctccttccagccccttccacaatagggatcgttggagttttcctttccttgactagggctacttcccagtagacagcagtctccgcagggacaggggcatctctgttttgttcactctcacgttcctggctcccacagtggtgctggcactccataaattcatactggacaaatgaccagtgatcctgcccacgtctatccttggccctaacgtgaaccttcccttgtttgccctaggatctcacagatccactctcccctttggagctcctctgtccagaggtcctggagacaggga

SEQ ID NO: 10702 - DNA, 138244 bp, Homo sapiens
  misc_feature (1)...(138244): n = A,T,C or G, or insertion/deletion polymorphism (see Tables 1-2)
ttttttagcttctatgaaactacactcctgggtctttttttttttttttttgagatggagtctcgctctgtcacccaggctggagtgcaatggtgcgatctcagcttactgcaacctctgcctcccaggttcaagcgattctcctgcctcagcctcctgagtagctgggactacaggcatacaccaccacgcccagctaatttttgtatttttagtagagacggggttttgccatgttggccaggatggtcttgatctcctgacctcgtgatccacccgcctcggcttcccgaagtgctgggattacagatgtgagccaccgtgcccggcagggtctttttataccttactgactcttgtatttgccagttcctccttttttttcttgacttcagatctgggctgcactttctagctctgttgtctaaagaaaaatatctgctgttactcaagatcttctgataggttctacatcgttgtytatatgttgtctacctggtctgcctctttgagcaccagagtttgacagcatagttgagtgctccatcttaacctttcataagactcagacttacctatcgtaagtcttgattttttaaatcaaacctgtttccctcaacctttccccattccactaactggtactaacttatacttacttgttcaaactaaaagacatgtaaatccttgactgtgttctctctcatgcccatgtctatatgcaagtcctgtgggctcttcgaagctgtgctttgcctcctctccattgttaccaccctaggcaggctacctttatttctcagttccttcataactgctccctcttgcccctactcattcgtctggctcttatcccatccatactccatacagtaggaaaggtaattgctttaggatttgaagagatgaggtgatttccttgttaagatctgtaatggcttcccattatatgaaattcttatgattagttggctcttgataccttttgtgactttttcatatttcccttgcttgccctgctctagccacagtggcctcatttctgtctcaagtccttttcacttgatatttctgctacttggttcactcttacctaatgttttgcttggctggatcctttctttgcattcagttctccagctggtctgtattccatctcttgtcacttcttactgagtcctattttattcatacttgttaacgctatttgaaattttgttgcatgtttttcagcttcattgatagtctccctttacctggaaaggtgactggtatgttgtgagtgctcaatagttgttgaaacaagtccctcaccaaatctttttaatctctcccagtaatccatgtcagaccaggaagactgttttccagttatctcatatgtagcaggccatcctccactgaagagtgagacatggcaggcatggcagacatggcaagacaaagctcttacctctccagtgaacccgtgtacagcttcagccggtgtgagactgaagttacccaggaagaatccagctttcacttgccttctcatccaattcatcccctggagtctcctctctaggtcctaatttccagtaggtcatggtatcccaagttcccacctaatattagtaatttacctttttatgaatcaattacttctctattttagtgtcatccagagttttcttccaggaagccaggattgagtgtggtcattcaattctcttcagaatatttttcatgtcagtaaagttcaacacattctttttaacgtctacaaaatagcatagatgcaccaaatagcatatagatgcaccataatttataacaaattatagattacattttttagtagttgctcaaattccatggaagtatttagctgccttttctttgagaccaaggttggggaaaaatggatgcaatttttcagaagggagcaacaacaagatgcattgaaaaagcagaccaatggaaaatatttctcaactagctaccttgcttatgctttacacctaggggattaacaacttaaaaagaggttcttattaggttactatatgttactgtgcatgtctgtctgctacactggggggttacccatgaaaacattgttaaagcaagaacattctcagataagagggggcctagcttttcattggttatctatttaatatagaaatgcttaattgcaagtgtgctatagtgtcacttagactgaggtgactagatcagtagagttctcggaggcatctaacaaatttacctttggaaacaaggcccaagtatgcgtctaaatgatagctaatgaacaataataatactttatagattgaatcactttaatgagagaatagaacatggtcaagtggaaggtaactgattttagtttaaggacgagtatggaaatgatataagtgccttacgttaggttttaatgttaacacgtgtgtcactttttaatctctcccagtaatccaatgagataggtaattgtctccgttgcatatatggaaaacctgaatttcagagaggtttaatggtttgtctaataagtttagcttccaagagatagtagggaatagtgtgtagtctaaggttatatattgttatatgattatatattgccaggttttaagcaatcgtctagcacttacaggcaaatctctcttagcctcagtttatctgtacagggagaaaagagttctcacagatttttttcaggaaaaatctcataaatatgaaataccaaatactttatggaaaggacttaattcacaggaagcacttaatattagcgagtattatatattgtatcagtgattcccaagctttaggattctgtggccaatagacttcaaaatgggggagaggagatggaatggtcggcttctagccaactgaggctattaaaaaagaaaaaataattatctaacgccacgatctttataaaacgacattttaaaattcaaattggtagtgaacaacgtagtctcagaatgaaggagtgttctttaaattgaataaatttagcttcataaaacactcagtataattcttattttttttttattttaccatgaactaggaattggatgttctattagtctccctccagttctaaaatattttgactctaatattcacaatttttcatagtcctccctgctcctacacttttctccatctgacctagaaatgctggctgacagtttgtagtctaagtggttatttacctaatgaacttgtgaataattgctcttagaaatcataggagtagagactatatcaaatgaaatttgactggataaaacagtaggcagtataagaaaagtagcaaagacagcaatatacactcattcatctaacaaatatttatagtctactaattgccaactactgtactagatcctacatatgatgaaccaaacacaaatgatctatgccctttggaccttaaaatttgttttactcctatctcccaggactggtaggttcttagaagcttcaagataaatattacatattcctagagctttaattttaattaaaggaggagtgagggtgggaggataattaggtaatttatttggcagtttaaaatttacattgaaaaacatcaatgaataggaatagcatgcaaaatttacatggcttaaaaaatacaacatgtaatactttaaaagcaattttactcttgtaagagtcagtttgggctatggctccagattggcatgcatagtttattttcctctgcttctcattggtggttctttacgtttagtttgcataaacattgtttgaagaaatattaaaattacagattccagggtcctagatactctgattgagtagggctgtgaggaagcccagaactgctttagaaaaagctcttgggtgattcccatgtagtggtctatagctctttctttgaggggacttgccttagggatacttcagaagtttcataaggcaataaatgtaaaaggaatcttcacaaaatgaaatataggaacatttctctgtgaaagaaactcattttttgcatactatccctgctgtctctcctaatgttgccaaattaacatacttttaaactgcagagattaatttgagattaatacattcaacaggtccattttagaaaaagtccttgagaaattcttgactgatacattgctaaaacattgctttaagaggctgccctaattctgatttttcaactaatttaggatatcacaatttaaaaacaaacaaacaaacatttatgtaatgaatggtatggaatctggtttggagttgtgtttacttctaaaaatagaatttcatgtattgcctttgtatcttctagagatatgaatgatctccagccagagaccaccagtaacacacctacaagtggacaaagttgtgtttattgacattgtaacaagggagaatgcttgccatgggcacctaatgtgaggtgtctcagtaagaggatgttagaaactacataggatttgggcctgtcgtaggtgatttggggaaagttcaaggaaggatctggactggatgatggtaggaactggtgatagtagtgcatcttaattcttatctaaaacataggaatggagtgaagctagaactgattggtaaagaagtcataatagctaggataggggctatttgaacaatattcatggttttctattatcagacatgattatgattatgtttttgttgattcattgtggtcacaatggccttggctgatgctgtgctgtgaaattgtatacgtttaaccagggaaaaccatggtccagttgtgagtttcaggccagctccaggctttcagggcctgcttttctctttttcaaggttaatataaaaaagaaaagtgctatagtatgtatgagtaagatctacacacatccgaaacattcaacagtggctgtgtgtggacaaggctgaaagctcaatgtagaggagtatacaaatattactattcctatttaaaacagctcagtaattactgtgtgaacttgacaataacattaacagcttccattttttaagtatctactgtatgccatgttatgtactaggtgccttgcatacattcaacagctttgcaaggtgaacatattttgatcatctccactttacaggtaagtagacagactattatttccagaactgccaagttacatttattaaatggaagagctggtatattaatgggttcagctcattttgagctcactgtatttcccctataccaggatgcctttctattcagaactttgatgtctaaagttacagcaatggagataaaatacattattggcaggattgttcagagactcaaatgctatcatacatctatatatgatgtatgaaagcacctagcacaataactggctcatggtagacaaatcataactaactgtactgttttcatagcagaggtgcctctaaacgtgagtacagataagttaactatattgagattgtggagtgactcgacgattttaacctcttggtcacagagaaatcaggctgaagcattttacctttatagaatcatagtattttgaagaaccaagaaattgtcaaggtcttcttttacagatgagaaaaatgaagctcggaaaagcagttaatttgcccagggtcacacatttaattattgcccgagcttggctaagaaaccaggtcttctgactcctaagcccttgccttcttcaggccacatagctgcttcttttcatgatgtgtagattagaaaagtcagtgtgccccggggcccttgattgcaccttggtttccctaacaaggatatgggatccctgctgacatttcagaccttaagttgcagagctctgcacttggatcttcttccttcttgttatataatcttacagttaaaagtttctaggaatatttttattacgtgcaattggcaacttcagtattttttaaagggtgttggtagcattatttccgggagctacttagcgctccggttcggtacctcgtggagaagacgggggaggggagcagcgagatttccttgcggagcaatattcctagggtacagacctcgtagcccgggcccgcgactccgccccgggagcgggcaggggcggggcgagcgctccagctggcgggaaggaggaagggccgggcgcggcgcagaggcgggcgcctaccagccggcagctccggagctgcycgcgccatgtccgcgcacaatcggggcaccgagctcggtaaggggcccgcggggctccccatcccctctccctcgcgttcagcgccgccgggactagcgcggggcctgctgccgcccagtgccctggctgtgggtccccgaggggttttcgctggggcgggaagcagtggcgtctggtcagccctcaccccaagtaaaggccgaacccggcacgttcgcgccgcttgtctttgcacctaagcttttactcttgtatgcggaaggagtaggaaagggttagattattatcttcctgccttttcgttcactctagctcgctggttggaaaacccaacaacccaaaaaacaaaacccaaaacaaacaacccccaagcaggtaaaaacagataaaaaccttctttctcctccttttaatagaatacttgtgtaatttaatgcagtatttccgtagataattttaaccgtaaccttgaagtggccgtgctcgtggaaaagttgtcagccgtctgtgctcaaaatgtaacactgcagattcatgggattttagagttacaaagatttgttaaagtacctgtattatttcccagttttcatctttttttatattgttcaaatactggcaagaaaccttagttcagatttcttttttttttttttttattgatcattcttgggtgtttctcgcagagggggatttggcagggtcataggacagtagtggagggaaggtcagctgataaacaagtgaacaaaggtctctggttttcctaggcagaggaccctgcggccttccgcagtgtttgtgtccctgggtacttaagattagggagtggtgatgactcttaacgagcatgctgccttcaagcatctgtttaacaaagcacatcttgcaccgcccttaatccatttaaccctgagtggacacagcacatgtttcagagagcacagggttggggataaggtcacagatcaacaggatcccaaggcagaagagaatttttcttcagatttcttaacatgtgaaaaatttataattcaaacagcaaaaccatgatcaagagaaggtttaagcgtctcgtttaagtattatagcttggatatctgtgtatccaggatctttaacttcttacctgtgtgacttcggacaaattaataactttgcgcttaagtttcttcatctgtaaaatggttattttagtggtagttaccttataaggccgttaggagattaaataggatacatgtaaagtagtttggtatattgtggacacctagtaagtcttcagtatagatagtattagtatatggagttatggttttaggggctaattttgagaaaattggctgtaaattatatgtaacacatacaggtaggtccttttcgccctccttaaaagtgactggtacttaaacagtctgcacttccaagaggtgttctggattttttgtcgaatggtaagagagtaaatctatcattttaaagacagttgatttactaacctggttgattttgttttagtcactgtcctctagctgattatgttttaaactctagtcctatctctggaacgtggtctttagtaataacggcattatttcttagattggaatatccttgaaggtggtggatatggggcaggtttggggtggtgtcttacctgggtattcccaggaatatgaccatgtgactatgcatacatcaaggatgtgccctaaatttcccaaaacttagacattttaaatttttctttcaaaaaacataattgaaccatttttaaatttatttatttgcagtaattagaatcaatcacttccattcatttgttgaaaagtaatagacataaataattgccaggtagaacaatagtaaatgtggtttttatgcagctatcgaaatgatcatagctttgtatttattatcttatttgttaaaatcagatttttttccttcacgggtattaatccttaatccaaacaggtttaaactgaaatgctaaaataagttatttgaattaggtactagggaaaaaaatctttcagtattaatttatgcagtatattaactgatgatttttaaaatagttttctaattgaaagtctttttaataaacatcgtaactaatttctaaaataaattaacatttttgcttcccttttcttattacaaaaggaattcatggttattgtaaaaattctagaaaatacagttagcacaaaaatgttgtaatattattactagtccaatcactgttatttatgatttggtgtatgtacttctagttcatggacttaaaaaaacattgagttcctttgagactaaacctgaccctcatgattaaaaagtctttaaggaaaacattggcatttggatgtatgaaagatgttttccaaatagggaatgtaccctctagctttcatattagaggatggggcccagcattctgagttttaacaaatcctgtgggtagtactgaagcatacccaagtttgagaaccaatggcttaatgatctccaaggtactatcaagttttgtacctagactattatgccctatatagtctattaaaatgtacagatattcttctattttattagatgccacttaactattgcctaaaatgcaggtgtcacgtgggtagtgatctttcttttgttcactgatgtgtcccaagtacctagaatagtgtttggtacacagaaggccctcaaaaatgtcttgaggctgggcatggtggctcatgcctatagtcctggcactttgggaggctcaaggcagccggatcacttgagatcagaagttggagaccagcctggccaacatggcaaaaccctatctctactaaaaatacaaaaattagctgggcatagtggcgcatgcctgtagtcccagctacttgggaagctgaggtacgagaatcgcttgaacccagagagtggaggttgcagtgagctggaattgtgccactgcactccattgggcaacagactggagacagactgtgtctcaaaaaagataaaaaaaaaaaaaaaaaaagaaaaagtctgttgaatgaaggaatgaattgagagctgcttcttacttgggggaactggggaatctacctggtccccgtgtatggttgcatggacagatgctgtgaagcttggcaccttcttcctctttgtaagtattattaagattcagttttgttacatccgtcttcagagctatctcaagaagcctataaaggatgtagatagtgtaacttccttgcaaatgttatctttggaggcgtctggagaatgcgggtgttattagatgacttctaaggatctccctgctctgtctctgtgtgtctgaaaactcttctgttcaaaaagcaacatttcaaagatatctgaaaaataaccatgatgggattttgtattttttttcgagacagagtctccctctgttgcccaggctggagtgcggtggtgtgatcttggctcactgcaacctccgtctcccaggttcaagcaatcctcctgcctcagcctcccgagtagctgagattacaggtgcctgccaccaagcccggctaatatttttatatttttagtagagacgggtttttgccatgttggccaggttggtgggatttttttattttaagaagcacatttatttaggtagttattgagtaccaatctgtactgggtagtattaccctaggctgggggtacaagataatcagggatggtcactgccttcacagagctattaatcggtctggttcaggacctggacatcaagctagagctacaattaaatgcaagtgtgatgtgcaattatttttcatttatttttgtctaaaattagatagatgtacctagactgtgctttaaatgggttgtgaaaacagaatgtcctgggccttttgcattataatttttaatttccttttaaaagaacctatgaattagggatttagggagctcatttttggcattcctgctaaagtataacttgggtacagaatgtttctgatttgggtgatggtgattttccactgcaaagttaacgtttaatttttggaatggatatttatttatttatttgtttatttattgtttcaatagagaccgtgtgtcagtatgttgaccagactgktctcaaactcctagcctcaagtgatactccagcctctgcctcccaaagtgctaggattataggcatgagccaccgtgcatggcctagaatggcatcttaaacctcaacaataggcaaaggctatctgtttgcataataattcttcaccttatttaatacctactgtgtgcagacactgtgcttaggtgctgggtataatgatagtgtcaacacagagctctagctacttgtaaggcactatgctgaatgcttgaaattctcatttagtccacaatggccctgtgagggagatagcatgatccaggtttacacacgagcaaactgaggtacagggagttttaagtaacctgccgaaaaccagttaggtatagctaatgtggcagagccagaattcaagcccaggtgatttggtgctaataatgctacatgcttaaacaaccacactgtgtcgactggtgctaactgggagcactacaccctgatgtcagaagagtcaaatagataactggtgaatactgttaatgttactcttttaggtttgatttgtctgtttaaaacataaaggttactgttttattgccataacccacatcttaaccattgcagtttgtttcagagaagatgcaatttatcctgagggagaatggaaaagtccaaactttggtagattatgagagtagggttcgatgttagtgaagttttcaaggatggcatgtcaaaaccagacttcctcaggaactgcttcatgtggatatactgatgagcctcagagcatcatgtgatggtgaccagggagtgacctcaaggtgaatagagtggggcttttctttgtgtgtgtgtttgttttcgtctcttgcagttttgtaaaacgttacctttcatactccagtctttgggctggcctcagcttctaggtttaaaaaccaatactgtttcttttttttttttttttttttttgagacagagtctcactctgtcacccaggctggagtgcagtggcgccatctcggctcactgcaacctccgcctcccgggttcaagtgagcctccagtctcakccttctgagtagctgggattacaggcatgcgccaccatgcccagctagtttttgtatttttagtagagatggggtttcacagtgttggccaggctggtcttgaactcttgacctcaggtgatccacctgcctcggcctcccaaagtactgggattacaggcatgagccgtcgcacctggcacaatcctgtttcttgatgtattcttttaaaaaatgtttaaaataagagatggggtcttgctgtgttgcctaggctggtcttgaactcctgggctcaagcagttctccctctgtggcctcccaagtggctgggactataggctgtagtcaatgtgccaggctcttgttctttaggttaaaaaaaattaagtagaaatagtgaagtatttgataattttgttaatttagagtgacttttttgtcccgaatttctacgtctggagtttctcttagtagtttcctgaaaaatagaactggaatctctttagctgtaaacaagataaacagtttaaggaatctatgggtcacaagtgagaagtgacctaatacaccttacaaagtccccatatttcttttattgagatagaggcctttaaattttgcctttaagttaaaaaagtcaattcctagtgaaaaaacaaaaacaaaaaactaaaacataaggcagtgtattcttcattaggtggcatatgaaaatttgactctagctcttagctcaggtggtaagagaatttaaaaatttttagatttctgcagggaatttcccaactggagttaacttgaggtttctttaaacaataaaattgatttgtgtaattttaagttaatgtgggttttatgtctgaatctaatttttttctctttaatatttaatacttaacatacatatgttactttagatttcatagagtgcttttctaacataatctcttttaattctcccaggaatccattgtgctaggcattatcattctcatttcatggatgagaaaactaaggctcagaaaacacaagtaacttgcttattatacctcagagctagtaagagttgaggtcaagactcaaatgcagaacttctgattacaagttttttaccctttgctttacaccaacggtcccggacctttttggcaccagggactgaagtggttttgtggaggacagtttttccacagactggggtaggggtgggtgtttcaacaaggtatttctggcttatcttataatttccctttcccagcaccaaagtcagccagttctccaggcagcatttttttcagtggataacgatatgagaagccaagatctgagcactaggtatgctcattgtgatgggtgactctgttcccaaggccctcagctggcagagctgaaaaatgtatgtactgtatacacacacacttctagattcatctacctatcatctctctgtatctacatagtgaaaaccatgagttcacactaataccaccagttctggtccaacaccacaggatttatcccagtgttctccctttccatatttgaaacactccacatgcttcccctggccccagcagatgttcttctcactgttctcaggctctgacccctgagctgggcctccctcctgtgagtctgccttcctcatcccgctggtgcttggtcccccacagcaggctgctgcctacacaaatctccctgttaccttagtgtggggctgtggacctctgtgcccggccgcctcgcctccctctgcaggtggataccctccttaccctgcttgcgcttccactccctatgtcttgctcccgctttgtgcagatcccctccttgttctgattggactctgggctaccccattctgtttggcccactctgggccatagtggtgcccccatttcaacccggcttgaatgactacgttgttcacctcctcttcagtgccccaccccaacggtttaggacaatcgtttgggaaggggaagggggccagaataatttgttttttttaatttttaaaatgtaaatatataagaatattttaaaaacctttatgtggagtgcctgctgttcctggcacttgttacttgctgctcatggtcatggcagggatgccaaggtgagcctgacttggtctctgctttcccagagctcacaggcaactaagggagatgtttatgtaaatcaccacatacggcatgttaaaactgacaacaggaacgtggtgggattggaaggataaagacgaattcacagacagtccagggagggtttttttggagaggatgtttctgacggagtagtttctacaaagggactagcaaaagcagcctggcatgtttcattaactataggaactcaattttcaggtatctagtgtaatcttctcattatactataatggctaagagtaatgttttcatgaagaaagaaaaaaaatccttcatagcctatgtgtgaaatacatacacagagtsaataattatgtacattttagattttaactggggcatccttttgtgaatgctaactactttgattttaccttagaagtcttttactttttgcttgtaagcataaatgatgaggctgtcttttattattgtgatactatttgataaatagaaaaactataaagtaataatttgggtttgttgtataattaaataattaaaagtcctctgcggtgcctgctaagttaaaaaacatttttttttttttaaaaagcatctaagcccggtggattttgattattaggaaggaagaaaaacttcaagcacttatttaaaatgggatgcttctgccaggaaagaaagactagtaaatgagacagcagacagagcccttgaggatgcgatttaaacatgtcaccagaaattgtttaagtggagagctctggcccttttaaaacactgtctgtcacttgaggattgggtcaccttgaaatgtgttcatcttttgagttaaaggcataaaaaggcactttgaaatttttcagttaactttgatgtgtgttgtgtatgtgtctacgaatgtacttctcctcagcctgcctcagctgtaacagtgagttccctagaaaccaaagtggttgcaagggaaggataaatgtttaatcttggctccagcaaactmtacagattttttaaatgttgagacactctggctgcaacttctggctctctgtatagtcaggccttcctcccgcaaagcaaagtctaagacaagagtagctgctggtagttatttcctaaaaaggtgccacttaactggtgtctttgttcttttggaaggtggttaatgatgctaaggtctttaaagtctggaaaaatatccagattaactgctctcataatccagattcagataaggttttcaactgtccgcctaatggactgccccacagcctgagaaagaaakgtgtgtgtgtgtgtgtgtgtgtgtctgtgtgtgtgtgagagagaaagagagagagagggagggagggagagagacagaaaagggatttcattcaaatgtctaaaatttgacattgaactaggtatctggcctgctgaaggtatagatagagactccttatctgtgatgtagagattcttgaataaacattacctcttatgaatatttcagatactcttttctaggaaaataatagtgtccacacttataaggctacctctttttgttgttgtttttcatgtcatggaatttcctagcagaaaggcatgtttgttatcagtccaacccccttctgttgtgggtaagaaaactgagacctagggaagttaagcctgtagtcacatggctggttagaggtagtcctggaatggaaattcaggctctgtctatgctggtttagtctagcacgttgcgttaccttcttttccactagtttaccatgagcttggctgggctctgaccctgccttagaatcacctaagacgcttgttaaaaaacacagattcctgagccccacaatagctttaattatttgtattatggaagctgggcgtggtggctcatgcctgtaatcccagcactttgggaggctgaggcgggcggatcatgagatgaagagattgagaccatcctggccaacatggtgaaagcgcgtctctactaaaagtataaaaattagctgggcgtggtggcacatgcctgtaacagttccagctactcgcgaggctgaggcaggagaattgcttgaacccaggaggcgaggttgcagtgagccgagattgcgccactacactccatcctggtgatacatccggagcgagactccgtctcaaaaataccccccccaaaaataccaaattatttgtattatggggagaaagcccatgagtctgcatttttataagattcccagatagctcttatgaatgaatactgcaggggcagaaccatgcagtaagctgtggagtagacccaggttcagattcagagaatctttaattacgagctattgtttttttgataaatcttatgtcatttttaccttaatcttattatctttatatatcatatattttacactgataagcaaagtttctctaagcaaatatggaaagaaataagcctttttatttgattgagataagtgaagaaatgtgttaaagtgaatgtgaaggcatgttggaaacatcggggtgacgtagtgaagtaagtgcatatatctgaaaagtgcactgtgtctgaaaagggacatactttattcaaatgatgccagtggttagtggaaggatataatcagtgttcttgatgattttggaaattgacataaggatatcttctctgtggtctcagagactggaggagatagacctctaatcccattagctgaagatgtgagattaaccagaaagagtaattccgttaattttctggtagaaaaaaacatattcatgtttccttgagattrtggattaagtttgtattttggactcagggaagaaagtaggttgtaacaattcctattgtatttggtgaaggagctcaagatctgtatattgtggtattttgagggagattattttttcttcagtaagtagcaagaaacttaagtgcttctaataattttccaaagaggccaggcatggtggctcatgcctgtaatcccagcattttgggaatctgaggtgggcagatcatctgagttcaggcattcgagaccagcctggtcaacatggtgaaactttgtttctgctagaaatacataaaaaaattaaccgggcttggtggcgagcgcctgtaatcccagctactcgggagactgaggtaggagaatcgcttgaacccaggaggcagaggttgcagtgagccgagatcacgccattgcactccagcctgggtgacgagcaaaactccatctcagataataataataataaataattttccaaggaataaacaagaaatgtattttagttttgtgtctttataagcagagttttccttttttaacttttgacttcttaggaggcaatcattattataatctcaaagtcattcattcagcatgtgtatgttgagtactgtgaactcatcactgtccatgtctttgtgaaagctataagagcaatagaacttaggagccctgcccttgagaagcttaccttcatcaaattttaaaatatccccggggaagtacgctgccttattcttgtcaaggaaagcaaactgtggccatcatcaggatatgcacttgccctgtttgaaatgattagccagtcaacattgtattattaacctttagataatcatttaaaaatgctgtgggaaatctcttgagctaggcaaagatctcatatggatttttattagtgaaaacatttccatagatctgtctccagcaagaaaaaaatcataatttcagtctgcagatgaatgctatatttgactgagtgttgcattaaactactaatatagagaaattttgggacacagtgattagcatgtagagtctagaaaataggcattgatgctgataatactgaagaccgtctgaaagaaaagcatcctagagaaagttcagttgttttggtgcttgacagtagttgtttttacaggccaagttgaaattaggtatcctgtggaaagaatgtcagggaatgtgtacctgcccatttgtgcttcattgaatgcactgtggtttatctgggaaggatacaggattgggacccaggcactttagttgtagacctgatagcatctagctgtggaaccttgcggggtggggaggggcttcagtacattggcttgtactttccaagtctgtaaaacagacacacgagaatgtaggttcatcagttgtaaggtttgtaccactctggtgggggatgttgataatgggggaggctatgcatgtgtggggcaaagcttgtgtgggaaatctctgtaccttctgttcagttttgctgtgagtctgaaactgctctaaaaaatagtggtttttgtttttgctttttttttttttttttttttttgagacggagtctcgctctgtcgcccaggctggagtgcagtggcgcgatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctgtttttgcttttaaaaaacagacacagatttctgaaaacccttctggttctgaacttcattgagtcttctgatcattccttaaaatgaccatttggtggaattgtaggtctagaatgttccctgtgcttgcagttcagaccttttccttccttctctggccagcataatcttctctggctttcaaggctctgaattccagtgatcagtttacattttcagccctatctctgatgactagacacattatattttctctttctctagatcttaagtcaaggtctcatgaatgtataccttgacttaaaaattcttatgtgaacagagccttttattttgtattcattcctctgcatggcagaatattggttatagtcttccttttttttttttttcataaaaatatcttgtgaattcatctcttcctctcttctattccctaggcttggctcattctatcacacatctgaatcacaatggtggcttcatagctggtttctttacctctgggctttctcatctgcccctggaaaatccatatttggttaaactttttcttgttgttttttcaaatagaacacatttattcatctccaatttgcttttctgattatttggtttcttcagaatgttctttcatttcatgaaaagtatataatcttaaacaaattactgtattctcagtctttagttgaagaaaataattgagttagtgagtaacagccaaataattctatccagaaatatttgaatgatgttagccaggtaagaattctaaagactgaaaatagagttgtctataaaattctattaaaattatatatgtggttgggttaggtggcttatgcctgtaatcctaactctttgggatgctgcagtgggaggatcgcttgagcccaggagtttgagattagcctgggcaatatagcagactccaacaaaaagtttcaaaattagctgggtgtggtggtatgccgctatggtcacagctaccttggaaactgaggcgggacaaggttacagtgatgatcatactgctgtactgtagcctgggtgacagagcaataccctgtttctaaaattaaaatgtatatatataaaagttaaataattgaactcagtaaatatatttttcactgtagagattacaaatacaatattctagaaataacttgggtttttgaattatagagatctgtgtttccatcttagccctgacaagtatggtgtgaccttgaacaagtaatttaatatctgagcttcagctgtttccttatctgtaaaatggacctaatggctacctggtagagttagtgagactattaagtgagatatataattaaattacctttaacttgatgagtgatcaataaatggtagccattattgtaattccaatcgatcctatattgtgaaaatacttggctttcaccatttcacctcctccctgaaggcttacttggtctcctctgctagacttttcaacactgatctgctaagatactttgccttcttttatggtacctaccaatttcagccttgtgtttttatgttctaatgctgccttattaataggctgcttgagggtaggatctgtgcttatcgggcgtctgtatcacttatgtcaccttgaacagtacttttcataatgtgaagacttgttttcatcagtgtttgttgaatgaataaggaagcattgctccccttgtctgggaagttagaatggccttttactgcctggtgtaccaagcccagacacttcattctctctctctttgaagatcctgggtcatttggccccattcctgttaccctcccacccccgagccccaacccctttgctgttgtcaggctgtcttggtctttgttctttgggaatgttggtcctgtttagaatgcctcttgatgttatctgctctgctattggaaattatccctagccttgaaggtgaagcttaaattccttcactttcataaacccttctcttattcctcttgttccttaagttttaatgcttaattatttttttctctgtaaattttcttcttattattttgaacacatgccccttaacaccaaagacaataactagaacataaaaaaggcctacctatctgtaaactttggagaacgaatcaatgtggcagctttactcttttaagtgtgaaaaaaaaagatgtttaaaacttgaaccatctgggagtgaaattgttctaaaattaagtatctttaaaaaatgtttttgcctaattgtaaaggtatacatagattacctttataacttatctgtaaattatcaaggaaattaaaattcacagattttcaaggaaatcagaattgcctagtatcatctcctgaagaagtagaactttgaaggtttagtccctgtgggaggtgcagtgcaatggggagaatttaatcatttttgctgacttagaggaccttacaagcatcaaagctgctgtgttttcatgcagtgaggccctcatcaactcctgaggctttttttttttttttttttttttgagacagagtcttactctgtcacccaggctggagtacaatggcacgatctcggctcactgcagtctccgcctcccaggttcaagcaattctcctgcctcccgagtagctggattagaggcgcccaccatcacacacccggctgatttttgtatttttagtagagtcggggtttcactatgttggccaggctggtctcgaactcctgacctcaggtgatccgcccgcctcagcctcccaaagtgctgggattataggcgtgagccactgtacctggtcaactcctgaggcttttacagccactttcctctgatcaagtggccagtactgctcttcttttctgaggcactgttttttttttcttttcaagatgaagtcttgctatgttgccaaggcttgtgtcaaactcctggcttcaagcagtcctcccgcttcagcctcctcagtagctgggacaacaggtgtgtgccactgctcttggctcactgagtgtattttgatataaacttttcgattcctcccctgtgatcaggctctcattcgtctatcatagcaatttccacttcagatatggtatttcgaatatgcagtaggcaagaaacaagagaattggccgggcgcggtggctcacgcctgtaatcccagcactttgggaggccgaggcgggcggatcacgagatgaggagatcgagaccatcctggctaacacggtgaaacagcgtctctactaaaaatacaaaaaattagccgggcgtggtggcgggcgcctgtagtcccagctactcgggaggctgaggcaggggaatggcgtgaacccgggaggcggagcttgcagtgagcggagatcccaccactgcactcccgcctggggcgacagagcgagactccgtctcaaaaagaaaaaaaaaaaaaaaaaaaagaaccagagaatccaggttaccagaattgtgggtaaactaacaggacgatggttctgagtggagttctagcagctttcaacaactggaattcagccctcatgccttagggcacccgttatatgtaacgaattaactctccagtgtgtctagaaggataccagttcttcacttggagaactgaggaaatagttgttcttgagtgtttttgttttgtggttcaaatgagaaacctttgttggaaaaggctgctggggtccttctgaatagtcaagtacataaactatctgctatgtctatcatgctaacacatgatactgatcaagtagttacataataatataattgattttgttaaagttggtttacttaaaacattttgaaagggagatgctcttcatgaagatggtaatacatataataaagattaatatttactgattacttagaacatgctaggcttttctaggtccctgcattgtcttctactcctcccaacaattttattccgatttttatcctgattttacaaatgtgggagctgatattttgagaggtgtttatttggtaagtctcattggtaccattctgtgactattttagataaataatcagagacaagtgttcatacactattacttaagaacagtaacgcttttttgtggttgccaaaatagacattggtttcagaatttaaatatgtaagttttaatagcaaaattactgttataattctcagtaggtcatttaaaaaatatttgcttaaaaagttaggcatcaggagtaatatgaactcacaaacttcaggaaatgaagttgttaacaccccacataagttcatacaaacttttcatagtttgtatgaaaagtaatcaacttgcccatagtcatacggctagcaagagaatggtgagccaggaattagctgtagtgtatgtggttccggagattgcattctcaatctgaaaattactttatatacttttgtatgttttattattcatataaccttcacattccatatacaactagctgctaattatctgtcttttttaaaatgctttttttaaaaattaggaattcaaaatataatgagattacacggatgagatttagattgatatggcatggaatagtggctaaaaaccatataagggaagaaaaagtagcagacgaattagaagttaatttatatttctcttgctaacttttaatgaaactgttcttggctcaaaaatagttaaaactttttaaattggaaaataataattatctatttaggggatacaatgtaatattttgatacatgtatacaatgtgaaatgattaaatcaagctgagtgacttcatcacctcacatacttagtttttgtgttgagaatgtctgaaatttactctcttagccgttttgaaacatacatgagtattaactgtagctaccatgctgtgcagtagatctcaaagacttacttttcttgtatgactgaaactttgtaccctttgaccatcatctctaattacctgccttaattggaagaccaaaatgaaggtagatatgaaatctacaggtaatctctaagtgttattttaattaacaaattttaaatttcttgcccattattccacttacagagatttttgaacaagaaacagaaaggattactttaaatttcaactctttctgtatttgcattttggactatatggtggacatgccatgtgcaaattgtgagcacaggaaaaggctaagggctgagatcaccctgtttggactacttaacccttgagtcattgagccagctgatggcaaggacagcccttatgaagtaggggagattttgcctgtgggtgtgttggactcttattgcatgcttttcccacccccgaggtgtctacttggagagtttcccctattaaaagctgtctgggagaagaatagaaaattcggctctcactaaagtgtgaaagcctattggtgtaaatagctttttcctgggaaaggtaagtttggttggtaccaaggaatgaccctttatatgtgcagtttaaaatgtttaaccaaagggaatatttggttgtggggagccttttgggtgtccctgaaatcttgccattttgacttctgtccatcatggtttttgtacacttgaccttacttttctcagccttctagatctgtagctgttaaatcctgtcctgcagacgggagcagcgttctctgtgaaaactggacaggagtcagctcctttagagcactggctcagccacgtgacttcttccaccagggcttcgggttcagctgggtcaggggagcagaggcgggaagcttgtgtccctgtggagccccactagggagaatgtctcccagcaaccagcatccaggccacagtgatcgcagagctaacccacactaacttctgagtgggtacatctaaggactccctttttaaaggtggaatggggtactttaaagtttttgatgacttgtcagagcatttgaaagcactgggaaaaccagccgccttgtcaaaacctgtgtcacttcttccagaggagaaattgcagaaagagagcaggtgccgtgggaagcagtgttttgaatcagcacccagcaggtggtgatttcccctctaattcggttttgaacagatactcccagacagtgttggcaatcactgtgctccataatgtagcggaggcttgtttgtttgtttgttttgggagacaatatcagctcaagccctgtctgcttatagtcacagtattttagcacatgttagatgcctgctgtttaaggggtacacctacattccaagcttcttctgtgtgtgtgtctgtgtgtgcatgtttaaatatatatttaagcacagaaaaaggcattaccagagatcttgagactgttaagtagggatctggagagtatttgatttttttctgcaagtcaaaggtagtgcaaaggtacatatacagtatgtacatatacagtagctacacaacaaatctttcttttttaaatttttctttgaaaacttagctcacttcagtttcgaaggatgaccctgtatcccagttagagaatttggttatagagtttgagcccatcctgattaaaattttcacaaataaatatatatgttgggatgttagtatttaattacctgtagcttttttgaaaagagattggactttcagtgagactgacgggcattcaaatcctggttcttctacctataatttttgagttttgtaagtaaaaaatagtgaataaaagctaggtcatagagtaactgtgaagattaaatgaggtattatttgtagagcagttggcgtggtgcctagaatatagtgagccacaataagaattacagacccttccctttactcaaaatatattaggaatgttggaaaattctgaccttaaagctaaagaataattgtgaacaggggtatttgctgactggaatataacatgaggttgtgagggaaaaaaattcaaagagtgtaggcagttggagcctcaatgtgtgctaggatataatggaagttgaaactagacacgtattcaatacctttatgctgattttctttcatatggaaatgtgattaaagggtagttatcaattgttttttcttcctgagggaatttatccatcccaagttcttttatttttcagattcttttttgatcagcatctttaaaattaatcaatagccaaataacagagtaggtgtttatttgataagtctcattggtaccatcctatgactattttagataaataatcatagacaagtgttcatacactattacttaagaacagtaacacttttttgtcgttgccaaaatagacattggtttcagaatttaaatatataagttttaatagcaaaattactgttataattctcagtaggtcatttaaaaaatatttgcttaaaaaattaggcatcaggaatagtatgaactcacaaacttcaggaaatgaagttgttaacacccctcataagatatgcttttcatagtttgtatgaaaagtaaatgttcctgggagaggtcttgtattaccttaaattcatggtaaagtataaatgaccaaaaatagattttttcctgaaatgagacttaagtggggtagtttgtggtaagagtaggacattgagtactgagctgtggtaatagggcagtaagtttcaggaaaaataggtacagatattgtataatcttcaagttccattaattgtttcttctttttttgagagcttaatatacttatttaaatttaaatgaaatagttttcaaattgttttaagtgttttctattatggagatataaataatatttaggatattttcacaggatttattgtttgcggatctgttttagcatgcaagtattcttgcagtcactctaacttgcgtgactagcacaacatccagcataaatagcagctttaggaataacattttcagttgaccgatagtataaattcaataagtaacagagcattattggacattctaaaattttaattttggaaagttcttcatctagtagttttcattgagaggaaagagttaagtggattttctctgaagcgcttggttcctagaataattgattaaatcttttcaaagcactgagagttgactctttacccaacagggggccaaagttatccagcttcttgatgaatttctctaaggtgtaatgattctctctgtaagttaggcacatttaggtgcttgacaaaactgtcatcagaagttttcccagagtacattaagttgaaaaactacatgtttggaaatctaaatgtgctttattaagtcttttatggagttatcttcatgagagcatgctatggtttggatgtggtttgtctacactaaagctgatgttcaaatttgatcctcagtgtggcagtgttgggagatggggcctagtgagaggtctttgggtcatgtaggtggatttatgtgaacagatttatgctctctctggggagggagtgggtgagtgagttcttgctctcttgggaatagattaattctcatgagagtgggttgttaaaaataatctggcttccttgttttttcttctgttgcttcgtctcttgaggaagatcttgtgagtttttttgcacatacctgctacctttcacgtgtccgcttcccctttgaccttttgccatgttatgactcagcagaaaagcccttaccaaaagccagcaccacactcttgaactttgcagcctacagaactgtaagccaaataaaccccttttctttgtaaattacccagtctcagttattcttttattgcaacacaaaatggactaagagcatataataatgtaaccaagatattgacaataaccatcttgtgatatgaaaacttttgtctgttaccaaatttatccaagatgttaatttgactgaaaagcatgaaagagaactgatttttagatgacagctttccaaagcattgttagttcaaggattaactcacaactttaggtgtgtaaatatgtgtgtgtgttttccatatttgacaagaatgtatgaacccatatgatactttaccttaaagtttcactataatttgttggctggacatggtggctcattcctgtctcccagcactttgggaggtcgaggagggaagatcacttgagtccaggagtttgagactagtctgcacaacatgacaaaaccccatctccataaaaaatacaaaaattagctgggtgtggtggtgcatgcctgtagtcccagctacttgaggtgggaggattgcttgagcctgggaggagtggaggttgcagtgagcaatgattgtgccattacacttcagcctgagtaacagtgagaacctgtttaaaaaaaaaaaagtttcactataatttaaaaaagaaatttcactgaggtgtaatatgtggtgagaacatttaaagtctattgttaacgattttcaggaatacaatgcattgttattaactgtagttaacatattgtacagtagatctcttgaactcaatagatcttctaaccgaaatttttgtaccctttgaccaacatctccccagtcgtctctctccagcctctggtaacaccattctactctgtttctatgaattcagcttttttagagtccacatattaagtgaaccctttatgtggtatttcacttaatgtaataccctccaggattatctgtattgttgtaagtgacaggatttccttctttttcaaggctgaatagtattctgttatttaggtttactacattttctttatccattcttcattgacagacactgaggttgattccttatcttggctatggtgaatagtgctgcagtgaacgtggtagagcagatgtttcttcaacatactgacttcacttcctttggatatatacccggtagtgggattgccggatcatatggtagttctgtttttaattttttgaggaacctctatataccattcttcataatggctatactaacttacatttccagccacagtgaacataggttcccttttctccacatcctgtcatttttttaaattatctgtttctggaattcctactccttagatattggactttccacactgatcctctgattttgttatttttcccatttcctattttattaaattaattttttcctcctagattttaaaataagtaaatgtttgttataccaaattggcagaaacttggctatagtttctccctttttccagtctatcttatacaccaatctgatcaaatcgatgactgtgatccactggtatttcaagtctagagtttgaatttcaggattctctgtgacttcatatcggtatacccatgcaaccatatttttactcccacatgtaacttttaccgttgttactgttttggaaacaggctgtcaccattcccaaattggtcttcattttatactcagtgtttgaaatgtctgtcttctccttgattctcagttaatttctactaatctatcagggcaggtctgtcggcttgttgaaaccttctccgaccagcctcatcttttcatagtgacagagttggagctggaatccagtttcctgctttgttctatactgttatgccctatatttagcactgctgctcagatcaattaaatgatgactgtcaggccacgtaagctggttctttcctttttgtcagtgattgccttctaattctgtggttaagttactcagagaaggcctccaacatcaagttggttgtactaggataaagcactgtaaaacagctaataaagtgcctggtggagttagtggttcataaattgttatccatggttttcaactgtgaatccagtaatggcccatatcacagaaccagaacctagagttccctttttccaggtcaaggctgtgttcccagtgctggtgccttgcatattcctgtgaatctccatccatggctacccagtacttggcctcagtagacagcctgcgggtttggatgtattagaactgtgctgttagaagttttacaataggccctgcgcggtggctcacacctgtaatcccagcactttgggaggccgaggcgggtgaatcacaaggtcaggagatcgagaccatcctggctaacacggcgaaaccccgtctctattaaaaatacaaaaaattagctgtgcgtggtggtgggcacctgtagtcccagctactcaggaggctgaggcaggagaattgcttgaacctgggaggaggaggaggttgcagtgagccgagatcgtgccactgcactccagcctgggtgacagtgagactctgtcttaaaaaaaaaacaaaaaaaagttttacaataaactcacttggaactatagtaaattcaaaacaaaatgggtgggaaacttaacagatattttaactgcctctttcttcgacttcttgattcaagacaagaagtacatttctcaaacaacttttgatatgtgaattgctgaggaaaactatatagtcccaacctggcaagttaagagttctttgaaattgttaatgaaatacttcatgctgggaacctggtagaagtacttaatttctgaaaaatcttttgataatgcttcccctaagagtttaaggaaaatgctagcagagtaaaaagtactacctttttcataggtttaaacatattaaaacaatagcgaaaaagattatgataaagctgctgttcctcccagagaggtcagtcattggttgacaccactttttttatagcaaatatttccagagctaacaaaactctttggaggagagtttggaaaaacaattgacagacatcaagttaaggtttttgaaaaactaaaaatatactagttttctaaataaattgagctgaatttaaatacatggacatccattgctatgatattttaaagtttcactgtaattttttggctgagtatggtggctcatgcctgtaatctcagcactttgggaggctgaggtgggtggatcacttgagcccaggagttcaagaccaccctgggcaacatggcaaaaccctgtctctacaaaaaatataaaaattagccaggtgtggtggcatccacctgtagtcctacctacttgggaggctgagctgggaggattgcttgaacccgggaggtggaagttgcagtgagcaatgattatgccactgcactccagcctgggcaacagagtgagaccctgtctcaaaaaaataaaaagtttcactataatttttaaaaagaaatttcattgaggtataatatatgttcagttttcacatatctgtaccagtttcagtgtaatttgatttatttatttttattagtgggattttaaatatttacattttaaagttggggaagataaaaataaaataattcctagtctgccattttatttttatgaagcaggttgctactagaatcttttcatattggtttctatatgttgtttgttgttgtgtaatatattactccaaaatttaggggcctgaaacaataagcatttattatctcacaacatttctctgggtcaaaaatttgagaatggcttagctgggtggttctggcttggggtctctcatgaggttgcaatcaagttattggcccaggcagccatcacctgaaggtttggctggagctagaggatctgattccaaagtggctcacccatatggttggcagcttagtgctgacacctggtgagaagcctcagccctttaccatgtgaacaccctcttagggttgcttgagtatccttatgacatggcagctggcttctcgagtgatccaagtaggaaggcaaaagccaccatgtgttttcttaccaaatattgaagtcacacgtgggtatttccacaatctccacttggttacataggtcagctctgttaattatggaaggggcatgaatactaggaggagagaatcattgtgggtcatttttgaggctagctacccgtttcccttatttgctatgttaattattttaacttgcttttgtattagtttcttcctatggctaaagatttcaaacattcagaaaagtaggactagtataaagaacactcatatatctgtcatgacctaacacattaataatttactgtttgtgttggcagttttttctgcaatatcttaaaattatagacattttggaaaacattttactatatgatctggcccttgccgccctctctttctttcactcatagacataaaaagtttgcactttaaagaaattaatatattttcttacagtaccataacatcattgtcacagtatccaaatttgaaataattcctggttaacatctaatactgagaccatatttaaatttgttcagttgtccccaaaatgtaatgtattttatagctggttaatccaagccatgatacaaatgaagactatgtattttattcagttgtgtttgtcttcctttagagcagaactccctttttagtatcattatactgggttatgttttgtgtagattgtctcaccacccggatttgtctgattattttctagtgatgtcatttaacttatttctgcatcttctgtcttgtgttgtcttgtcttgtcttgtcttgtcttgtcttgtcttgtcctgtcctgtcctgtcctgtcctgtcctgtcctgtcctgtcctgtcttgtcctgtcccgtcctgtcctgccctgccctgccctgtcttgtctttcttttttgagatagtatcttgctctattgcccaagccagagtgcagtggcatgaacatggttcactgaagcctcaagctcctgggctcagcctcctgtatagctgggaccactggcatgcaccagcacgacctggctaatttttaatttttttgtagagacagggtctcaccatattgcccaggctgatctccaactcctgggctctagcgatcttcccatcttggctttccaaagtgctaagattatatatgtgagccactgtgcccagcctgtattttctttaatttggaagttatatctaaaacttgattcgattcagattaaacagttctggtaaaagtacttcagaagcgatgctgtgtattttacatatcatatcatgaggcacagaatgagtgcctggctatcccattataagtgaagttaagtttgatcatttgcttaaggagattatagccacatccgccagtagtatasttccagtttcccgctttgacctgcatgtcctgtatgagttgatactccaataccatgtgaatgtctcatttttcattaactttttacccagtgtctttagcatccattggtaatgctaatgtattatttcattaagggttacaaaataatgtagtttgctttagtttgattcttatgttgttaaattacatgtttttcttctcccttctcctttggtggttaacactaactgcacaatatttgtggttttgaatcctttttccttgcccctagatgtccctttctttttaagtttgtttatcaagtagtagttacttaattaatcttggttaagtgaatggctatacttcctttattctggtgtatcagggcttccccaaattaccagctccctttttcattaagttatgtgtttttgtcatcaattcatcaaatatttgtagaacatttgctatgtgtcagttaagtacagtgatgaggagctgggctgttattaatgaagtagtctgaatccctttgttttgaggaagctctaatatcttgttggcaacatccaagtaaataattcaactatcacaacataaccactggattatgtgccagggcctgatagacaatgaacacctaaatatttatttactgacttgggtaagagttgtaatattgatctgttaaggttcagtggagcccagaggaagacttagtggttgaggagctggagaaagttgctcagaaatgacattgacttggatatttgttagggtgacttagcatgcaaattagacacttttgacagcaaaagggagcactaaaaatacttaaaattatataattaaaaatattgaatgatacattgcctttattttattggtagatcttctgttcaagagaaaatagttccattcaaacagtaaaaaattcattctaacactaaaatatactcatgtacatcaaagccaaaaaatgtatttatattatctcagcattataaaacaacacaagttgaattattactctgctttaataagcttcttagctgtatcaatctatgtgtctaagttgcattttgtgtttattaagtttaaaattcttgatagttttcaattgattcttacccatgaaatgtgtttttaaaattgagaaaatattttctctataagtgttgagatacttggtaaatttagcacattctataaatggaggatattttcaattcacattttttaattgaaatgtgtaaatattttaccagaaatgttttcacagctaatatatttttgcctccattctgagacaaaatagtaaatatttttataagacaaaacttgtcaaataagatgtttctgtttatgatcctttgggatattttgctaattcaaatactgtaaaattaaaagtcttctcaatttcatttctttccagtacagaatgtaagcttatctaatttaaaataggagcttgtggtagctagtctccagagatggaccacgtctctggtattgatgcctttgtgtagtcctgtactgcattaattctgggctgaccctgtaagtccctttaaccaatggaatatggtagaagtgttgctctacagctgcttcaacaattttgggtgctctgagctgcctattaagaaattcagctaccttgttggaaaaggcacttggaaagggagaggtttgaggactacatggagagaaagaaggagacttaatgtcccagcagagcccagtcttccagccgtacccttcaaggtatcagaaatatgagtgaaatcatcttgcatttcccagtcccagccaccatctgagtttagccacacaagagatctaaagtgaaagcagcagcacaaccactcagctgagccccagtcaacctgtcaggagaaatagaatgactgctgtttttagccacaatgttttgtggtggttgttatgtaacaaaagacagtcaaaagagacaagttgaagtattccaaagtgcaactttagaattttaaaattaaccccatgtatactagttgaaatctcattatttaatttgttcaaatccattcttttgtaggagtaaattttatgtctccctctttgcaaaattgtcattaataattgaagttcactaacagtttcaaaaacaagaggctttggtgttttatttaatatttttttaaataaaagattttcaactgattttgaaaaaaaaaagccaacatttaaaggcctcatttagaagatagttcaagaccagtgtacatcagcttagattaattgacagaatggctcttaactcttcaaagaatcagatgtttctagtattcagctgatgagaatcagcagagagagtgtgtgtattgccatgaagaaagatttatgtttaatttaatgtcacctttttcacaaagatcagatcgttcttttattctgtgtataaataaaatgtttaaaatttggcaatgacagcttttactttagttgttagactatggaagcatatttggatgaaattatgaattatgtgtctgtcacaaagagatccaggtatatttctgttccataggtttcctaatttaataagaacatatttttaccatgatactacaacaaaatttgtatccatgttgtcactgcaaaatcacataattatgtgtttatcctaacctctttaactgaatttatagtggtagtcacaacaatgtcagttattttatcttcagcaaaatagacttccggtttttttatttgataaattagatttttaaaatgagtcaatattcaaattaactgattttctgtttgaggcatctatgactctgctatgaaactgatattttctagtatttttggagccaacaacttaataactactgctttcctttttttattttattttattattatttttttatttgagatggagtctggctctgttacacaggctggagtacagtggcatgatcttggctcactgcaacctccacctcccgggttcaaacgattcttctgcctcagcctctcgagtagctgggactacaggcgcatgccaccacacctggctgattttttgtatttgtagtagagacagagtttcaccatgttagccaagatggtcttgatctcctgacctcgtgatctgccctcctcgacctcccaaaatgctgggattacaggcgtgagccaccgcatccggcctgctttacttcttacacattcactagaaaatttagatctaaaagtgagcaatatttagaatagtcatttatttaaatggaagtcatgcttcagagttttctggtaactgtatcttctgaatatgtgttaaattgccatctttggacacaggcatcctaacataactactaattttttgaggtagataccgatgctttttagcagatttaggtcatcctggagtctgatatataaatagatagatagatagatatctttggtttccatagcacgtggcaaatgttgaaaaacattttgtgcaaattgcagataatcaactttcctgagaaatgggaattgagagtaaaattttttattaaacatactttttgtgaggtcattgtaactgatagtttttgttgttgttgtagaattaaaaagcctgacccaaagaaaatagtttagatttacagaatttgataaatcataaaagcattgctttcagtgtgctctctgcaaggaacctagtgatttcccgtacatatttcatgttcacctaatctacagtagcggctcattgacctactgactgtgggtgttgtgtgtttgtgtctcttgcatgattgagctcaggccggggctcaactagctgctatagcaaatgggtataacagagacacaacagtgttgaatacttctcctactgccacccaagagtagaaggacttagccgtctgtagccacaattttttttttaatttcaatagtttttgaggtacaggtggttttggattacatggttaagttctttagtggtgatttctgagattttagtgtacccatcaccctagcaatgtacgctgtacctaatatgtagtcttttattcctcacccctccctattctctcccgctgaatcctcagagttcgctatatcatccttatgcctttgtgtcctcacagcttagcccccacttataagtgagatcataggatgtttggttttccattcctgagttacttcacttagaactgtggcctccagctccacccaagttgctgcaaaagacattatttcgtttccttttatggctcagtactccatgatgtatatataccacattttctttatccacttattgattcatgggcacttaggttgattccgtatctttgcatttgcaaaatgtgctgcaataaacatacatgtgcatgttgtctttttcatataatgacttcttttcctttgggaagatacctaatagtgggattgctggattgaatggtaagttctttaaggaatccccgtactgttttctgtagtggttgtactaatttacattcccatcaccaatgtaaaagtgttcccttttcaccacatttatatcaacgtctattattttttgactttttaattatggtcattcttgcaggagtaaagtggtgtctcattgtggttttaatttgcatttccctgataattagtgatgttgacctttttaaaaatatgtttgttggttatttgtatatcttcttttgagaaatgtctatttatgtcctttgcccacttttaatgggattacttgtttttttcttgctgatttgtttgagttccttgtagattctgaatgctattcttttgtcggatgcatagtttgcgaatatttactcccactctgtgggttgtctgttaactttgctaatttttttttgctgtgcagaagcttcttagtttaattaggtcccatttatttatttttgttgttgttgcatttgcttttggggtcttagtcatgaattgtttacttaagctaacatccagaagagtttttctgatgttatcttctagcatttttatggtttcagatcttagatttgtctttcatctgtcttgagatgatttttgtataaggcaagagatggggatccaatttcatttttatacatctggcttgccagttttcctagcaccatttattgaatagagtagccacgaatattctgagtaccctcagtaatcagtgaatgcctggcatgctgggagtgttagttttgttatgtccaggagagtggggaagagagtcaagttttggttttcttttagagtgaaacacttggtaaagtaacactattcactgcaccgggctctcacgtgctgtgcgacattgctggagaccgtgagagaagagaagctggagtctcccaaatgcatcttggtttattttcaactttgttaagaaatgaaatatagaagatgaatgctaacacagaggggacaggaggcataaaccaggcttgtcttgggcaacccaggatgaggtggtcactctagtgaggaccaaagctcagcagtagttggaccatattgggaagagctatcaaatttgacttcagtagttacttagagcatagagtggttggggagagggacagcgatgtcacccctgacagtgtgttctaatctgtaaactcttccacacacttacctgaggctgtttatgggtagtgagcagaggaagctcttctttgaattttgtgctttgtgaatcttacagatgcttctgaatctttgacttttcactctccaggtgagaataacagcaccagagattgagtagctcttatttgtttgaagacaaattttaaacgcagagtagaaaagcaatagtcagttgattgatgagattttgaccccctccactgtattccttttagtgatttggtacaggccaccacctgctcttgcttgagcttcctacttgactttcgcaccacagccagaggggttatttaaaaatgtaaatcagatcatttcagcccttgctgaaaattctctaaaagacttcccatctcacatgggaaaacctttctgtgctgaaaaaagttctccttaaggaccttttaaaccctgttggccatggctcaccatatgcaktgtattttatattgccacacagtacatgccacacagtacacacgggtttgaaacagaacttccacgaatgatcctacctgtataacatgtgctgtatcttgacattttctattttctgtttcttcttttttattttttaatttttawttatttatttatttatttatttatttatttattttattatactttaagttctaggatacatatgcacaatgtgcaggtttgttacatgtgtatacatgtgccatgttggtgtgctgtagccattaactcgtcatttacattacgtatttctcctaatgctatccctcccccctccccccaccccacgacagaccctggtgtgtgatgttccccttcctgtgtccaagtgttctcattgttcaattcccacctatgagtgagaacatgcggtgtttggttttttgtccttgtgatagtttgctgagaatgatggtttccagcttcatccatgtccctacaaaggacatgaactcatccttctttatggctgcttagtattccatggtgtatatgtgccacatttccttaatccagggtatcattgatggacatttgggttggttccaagtctttgcttttgtgaatagtgccgcaatgaacatacatgtgcatgtgtctttatagcagcatgatttataatcctttgggtatatatccagtaatgggatggctggattaaatggtatttctagttctagatccttgaggagtcgccacactgtcttccacaatggttgaactagtttacactcccaacaacagtgtaaaagtgttcctatttctccacatcctctccagcacctgttgtttcctgactttttaatgattgcccttctaactggtgtgagatggtatctcattgtggttttgatttgcatttctctgatggccagtgatgatgagcattttttcatgtgttttttggctgcataaatgtcttcttttgagaagtgtctgttcatatccttcgcccactttttgatggggttgtttgattttttcttgtaagtttgtttgagttctttgtatattctggatattagccctttgtcaaatggatagatggcaaaaattttctcccattctgtaggttgcctgttcactctaatggtagtttcttttgctgtgcagaagctctttagtttaattagatcccatttgtcaattttggcttttgttgccattgcttttggtgttttagacatgaagtccttgctcatgcctatgtcctgaatggtattgcctaggttttcttctagggtttttatggttttaggtctaacatttaagtctttaatccatcttgaattaatttttgtctaaggtgtaaggaagggatccagtttcagctttctacatatggctagccagttttgccagcatcatttgttaaatagggaatcctttccccgtttcttgtttttgtcaggtttgtcaaagattagatgattgtagacgtgtggtattatttctgagggctcaattctgttccattggtctatatctctgttttggtaccagtaccatgctgttttggttactgtagccttgtagtatagtttgaagtcaggtagcgtgatacctccagctttgttcttttggcttaggattgtcttggcaatgtgggctgttttttggttccatatgaactttcaagtagttttttccaattctgtgaagaaagtcattagtagcttgatggggatggcattgaatctataaattaccttgggcagtatggccattttcacgatattgattcttcctatccatgagcatggaatgttcttccatttgtttgtgtcctctttgatttcgttgagcagtggtttgtagttctccttgaagaggtccttcacatcccttgtaagttggattcctaggtattttatgctctttgaagcaatagtgaatgggagttcactcatgatttggctctctgtctgttattggtgtataagaaggcttgtgatttttgcacattgattttgtatcctgagactttgctgaagttgcttatcagcttaaggagatttggggttgagacgatggggttttctagatatacaatcgtgtcatctgcaaacaggtacaatttgacttcctctttttctaattgaataccctttatttctttctcctgcctgattgccctggccggaacttccaacactatgttgaataggagtggtgggtgagagagggcatccctgtcttctttcagttttcaaagggaatgcttccagtttttgtgcattcagtatgatattggctgtgagtttgtcataaatagctcttattattttgagatatgtcccatcaatacctaatttattgagaatttttagcaagaagggctgttgaattttgtcaaaggccttttctgcatctattgagataatgtggtttttgtctttgcttctgtttatatgctggattacatttattgatttgtgtacgttgaaccagccttgcatcccagggatgaagcccacttgatcatggtggataagctttttgatgtgctgctggattcggtttgccagtattttattgaggatttttgcatcgatgttcatcagggatattggtctaaaattctctctttttgttgtgtctctgctaggctttggtatcaggatgatgctggcctcataaaatgagtcagggaggattccctctttttctattgattggaatagtttcagaaggaatgctaccagctcctccttgtacctctggtagaattcggctgtgaatctgtctggtcctggactttttttggttggtaaggtattgattattgcctcaatttcagagcctgttattggtctattcagggattcaacttcttcctggtttagtcttgggaggatgtatgtgtccaggaatttatccatttcttctagattttctagtttatttgcatagaggtgtttatagtattctctgatggtagtttgtgtttctgtgggattggtggtgatatccccttttttttttattgcatctatttgattcttctctgttttcttctttattagtcttgctagcagtctatcaattttgttgatcttttcaaaaaaccagctcctggattcattgatttttcgaagggttttttgtgtctctatctcctttagttctgctctgatctcagttattttttgccttctgctagctgttaaatgtgttcgctcttgcttctctagttcttttaattgtgatgttagggtgtcaattttagatctttcctgctttttcctgtgggcatttagtgctataaatttcactctacacactgctttaaatgtgtcccagagattctggtatgttataactttgttctcattggtttcaaagaacatctttatttctgccttcatttcattatgtacccagtagttattcaggagcaggttgttcagtttccatgtagttgagcagttttgagtgagtttcttaatcctgatttctagtttgattgcactgtggtttgagagacagtttgttataatttctggagtgctttacttccaactatgtggtcaattttggaataagtgtgatatggtgctgagaggaatgtatagtctgttgatttagggtggagagttctgtagatgtctattaggtctgcttggtgcagagattagttcaattcctggatatccttgttaactttctgtctcgttgatctgtctaatgttgacaatggggtgttaaagtctcccatgattattgtgtgggagtctgagtctctttgtaggtctctaaggacttgctttatgaatctgggtgctcctgtgttgggtgcatatatatttagggtagttagctcttcttgttgaattgatctctttaccattatctaatggccttctttgtctcttttcatatttgttggtttaaggtctgttttgtcagcgaataggattgcaacccctgcctttttattgttttccatttgcttggtagatcttcctccatccctttattttcatcctatgtgtgtctctgcatgtgagatgggtctcctgaatacagcacattgatgggtcttgactctttatccaatttgccagtctgtgtcttttaattggaccatttagcccatttacatttaaggttaatattgttctgtgtgaatttgatcccgtcattatgatgttagctggttattttgcttgttagttgatgcagtttcttcctagcattgacggtctttacaatttggcatgttttttcagtggctggtaccggttgttcctttccacatttagtgcttccttcaggagctcttttagggcaggcctggtggtgagaaaatctctcagcatttgcttgtcaagaattttatttctccttcactggaagcttagtttggctggttatgaaattctgggttgaaaattcttttctttaagaatgttgaatattggcccccattctcttcaggcttgtagagtttctgctgagagatcaactgtttgtctgatgggcttccctttatgggtaacccaacctttctctctggctgcctttaacattttttccttcatttcaactttggtgaatctgacagttaggtgtcttggagttgctcttctcgaggagtatctttgtggcgttctctgtatttcctgaatttgaatgttggcctgccttgctaggttggggaagttctcctggataatatcctgcagagtgttttccaacttggttccattctccccatcactttcaggtacaccaatcaggtgtagatttggtcttttcacatagtcccatatttcttggaggctttgtttgtttctttttactcttttttctctaaacttctcacttcatttcatacatttgatcttgaatcattgataccctttcttccagttgatcgaatcagctactgaagcttgtgtattcatcatgtagctctcgtgccatggttttcagctccatcaggtcatttaaggacttctctacactggttattctagttagcaattcgtctaatcttttttttgaaggtttttatcttctttgcgactggtcgaacttcctcttttagctcggagtagtttgatcatctgaagctatcttctctcaactcgtcaaagtcattctctgtccagctttgttctgttgctggcgagaagctgcgttcctttggacggggagaggcactctgatttttagaattttcagcttttctgctctgtttttcccccatctttgtggtttcatctacctttggtctttgatgatggtgacgtacagatggggttttggtgtggatgtcctttctgtttgttagttttccttctaacagtcaggaccctcagctgcaggtctgttggagtttgctggaggtccactccagaccctgtttgccttggtgtcagcagcagaggctgcagaacggcgaatattgctgaacagcaaatgttgctgtctgatcgttcctctgggagcttcgtctcagaggggtaaccggccgtgtggggtgtcagtctgctcctactggggggtgcctcccagttaggctactcaggggtcagagacccacttgaggaggcagtctgtccattctcagatctcaaactccatgctgggagaaccactactctcttcaaagctgtcagatagggacgtttaagtctgcagaggtttctgctgccttttgtttggctatgccctgcccctggaagtggagtctacagaggcaggcaggcctcctggagcggtggtgggctacacccagttcgagcttcccagcagctctgtttacctattcaggcctcagcaatggcaggcacccctcccccagcctcactgccaccttgtagtttgatctcagactgctgtgctagcaatgagcaaggctccgtgggcgtgggaccctctgagccgggcgtgggatataatctcctggtgtgccgtttgctaagacgattcgaaaagcacagtgttagggtgggagtgacccgattttccaggtgccatctgtcacagcttcccttggctagggaggggaattccctgaccccttgtgcttcctgggtgaggtgatgcctcgccctgcttcggctcaygctcagtgggctgcacccactgtcctgcacccactgtccgacaagccccagtgagatgaacccggtacctcagttggaaatgcagaaatcacccgtcttctgcgttgctcatgctgggagctgtagactggagctgttcctattctaccatcttggaaccacctacctgtttcttcttttttaaaaatgccggttgccactgacaaaactgatttcatgacttatctgtgagttattaccctcattttggaaaatatgttactatatgatctgggccttgtcaccctctcttccatttcccgtacctggccttgcctactttcccctgattacactgtgtccctgctttgccttagatatgactgttcactcttgccttctcctctttctgttaccagaaaggggtcctgatacagaccccaagagagggttcttggatcttgcacaagaaagaatttagggcgagtccagagtaaagtgaaagcaagtttattaaaaaagtaagggaataaaagaatggttgctccatagacagagcagccctgagggcttctggttgcctatttttaatggttatttcctgattatatgctaaacaaagggtggattatttgtgcctcccctttttagaccatatagggtaacttcctgatgttgccatggcatttgtaaactgtcatggcacttgtgggagtgtggcagtgaggaggaccagaggtcactctcatagccattttggttttggtgggttttagctggyttctttactgcaacctgttttatcagcaaggtctttatgacctgtattttgtgttgacctccagtctcatcctgtgacttagaatgccttaaccatctgggaatgcagcccagtaagtttcagcctcattttacccagcccctgtgcaagatggaattgctctggttcaaatgcctctgacatttctgcctagaacactgtttccctatatgatggcctcattgcttatttcacgtggggtcctgctcaaatgttttattatcagattttcctggctcatgcccatcctacattctccattttcttaccctatataacttttcattgtagctcagatgtataatatagttaatagatatttatgtgtttatctcttattaggaaaggcctatgagaataaggattttgttttttcagcactgctcactctctagagcctccagtggtgtctggcaccattttggatagccctttgatattagttgaatgaatgaatggtattcatagacagacttgcatttatcaaactctccaggaggttttctgtcccttgtctgtcttgtatcttgtgtaagtcttgactttgggtagagatccctgcagattctgtaaacaaggctggagccatttgatctaggaattctgggtcctgtgtaccttgagcatggactagaggggaatgttggcccagggacagtctgtgcccttggccccacagacccctgcccatgggtaggagcacagctatgggtgggccagagcaggctctaagtagagtgtgggcccatctcatccctttgtaatgttggcatcatgtaggagcaatataattatcagtttctacctgggggcctgtggtgaagattttggtgatcttttctatgggaacagaaacagggcattctgacatcatcatttctgcctgacattgtgtagctgtatcaggctggctttctggaatagctcagtggccaaagattgatcacgaagggtttagagctgtgaaaatgccccaggtaggtgttgtataatgctggtgcctggaccacagacagctgccttactggtttacctactgtagtctgcctttcattctacctgtccttcacactgctgcctggcagttcctcttaattcaagagtcaagtattattatgtgttatatttcctgctcaataagataatgcatgctctttgtaagaatgtttaaatattaggggaatatataacgtgagaaagtaggaatataatcttacctctgaagaaaaacacttctatcaatttggcatatagtttattttctttgcacatacaccaacagatacatgttttgtgttctttttgtttttattaacagttttattttaaaaagcacactgctgtgcatatttcttatttttactgagtaatgtatcataatcagttttctacaacagtacttactgatgtacctcgttctttttttttttcttttttttgagacggagtcttgctctgttgcccaggctagagtacagtggcgcaatctcagctcactgcaacctccgcctcccaggttcaagcgattcttctgcctcagtcccctgactactgagactacaggcttgcaccaccatgcccagctaatttttgtgcttttagtggagacagggtttcaccatattgaccaggctggtctcgaactcctgacctcgtgatccgcctgcctcggcctcccaaagtgctgggattacaggcgtgagccactgcacctggcctgtacttcattctttttaatggctgaattgtattctgttttttggatttgctatatattattgaactggacatggatcttggtgtcatttccaacagtgctgccacacatacgttttcatgtttgcatttgcaaacttatgtacgtatttccatgggacatattctgtgtactgattacttttttaaaatactcctttaattctgttacagccctgtttggagatcttctctgacttctggtcacctgtatcataaagtctagactagagcctagagccaatagaaacataatgtgagacatggagtcattttaaattttcaagtgtacacattataaaaaaaataaaaaggaacaggtgaaaatattttaatagcattttacttagccaagtgtaccccaaatattataatttcattgtgaaatcaatgttaaaacgtaattagatattttacacccttctttttgtactgaatctttgaaatctatgtattttacacttaaagcacatttcgatttggactatccacatttcaagggctcaggtaggcacaagtgtgtggctcctgattggacagcgcatgtctacactcagcctggtgcttacagcactttacaagtaagccatagtcagtcaaacaagccacattcagtcacatttagccaacctgcttttgcttctgacagccccacaaacttgcagtgcttccggtttatttttcctgcatcctgcccagttttttgggcagggtttctcagctttggcactgttgaagtttgggaccacataattctaagttgtgggtgccttgtaggatactgagcagtatccttggcctctacccactagatacaagtggcaccttctcctctagaatccccctaccccatctgtggtgaccaaaaatgtctctagactgagaaacaatgctttacggtgaatcagaaatctccacttatccattagggttgttttagccaactggataagcctactgtgacctacccttcctctgaacttgactttttatccagccagtgtggtaagtttttatttttgtgtatgaggaacaaagttaaaatcaaaatagaaaaagcgcctccttttgtagggttatcatttggtgttacatgctttaggaatactgtgaaaaatacaggaacttctgcagaaacacaaatgaaaatgatggaaagtctagaaagtaaagttgcagggaaaatgacctccatctccactacgacttgaaccagaaataataataataataaattgtgagaagagtatttgaggacaaatttataaccaacacaagggcctaaaaaccaccaaaatgacatattaaggtaaatagtgggacttttttcattggagaattttaagagaagatatcattgccttccaattatggtttcatatctgttctccccaaaggcatgtgtacttaaaacccctcttggccccataagaagattctttggtcctgatgagattatgtgcattagaatcacttctcctggaaaggagacgctaaagggtacttgaataaaatattaaaaattatggaggacataacaaaggccaatcagtcctttcttttccccagaccccataataggagaacatgggttatttgatgaaattaaagagtagcaaattaagtgctaataaaacgagatagtcacttacataattcattgccatgggaggtcacagaggcaaattttgtggctacattaaatatggggctggataattttatgaccgctaatgatatttttagcagtcaaggctgatactgtgagagaagaaatcctattacattctccagtagatggtttgcagggacctctggcaagaggtttctgagaagtgcaagagcagaccttgtgagttctaacctttggtgtactcaaaattggtttttaaggggaaagttcccaggcatcccattcatacctcagtcccatattttcttgtagagatccaaaagccctttctagtctgaagcagtggagaaagacattgcccagaattaaatcctttctggtctttgggaaccactcgacttatttatcgtatgccacccgtgcgtcaggtccttcgcttggagttttaaaaaatcttttggggacataaacatttggacacatcagtggcattctgagtgaaggggatgtactaaaggtggaatgcagagtttcatggaagcacgaagaagcaaagggatgtctcaacctgtgaggttcagggaaggctcccagagaaggtgacatttgaatcgactcttaaaggatgagcagcagttcactgttcgcaaagcagggagggcattcttggtagaaggagcttgcagcatgcacagatccagagacagcctggcataatgtgtcagggaactgccagtagtttaggaaggctgcaccacagaggcagaggagcagtgagggaggagctggggcttgagaatgaggaaggagccagatggtgaaggaagaggcttgtgtttgcctgagacccctctccaacagtggtgccagtgtttccagtggcgacagtagtggtagtggtgcgttgggagtagagaatgggaaggacttcaggggtgtcctgtgaccgataaaggacagcctgtcaaagccttgccccactgagtaataggcctacctctttttgatcacggtcaacaattagttggcagtgagtcttggagttcacatactcttcactcatttttctatatctgcttgaaacagtctttaccatgaaccaaatcagcattatcaatcatctgaggagaaaaaaaaaaagcctcttagggctgggtgcagtggctcatgcctgtaatcccagcactttaggagggcgaggcaggtagatcacttgaggtcgggagttcgataccagcctggccaacatggtgaaaccctgtctctattaaaaatacaaaaattagcctggcgtggtggcgcacgcctgtagccctggctccttgggaggctgaggcatgagttcgtttgaacccgggaggtggaggttgcagtgagccaagatcgtaccactgcattccagcctgggcgacagagagactgtgtctgaaaaaaaaaaaaaagaggctcccctgcgtttgagtagggggtgtttcttacaggtcttagataaattgggacgaagtctagagtgtctggtctgattttctcgggctctgctagaacaaaaacagcccttgagtgggaaagcagaggcagatttcatcggcctgaccccagactcccattttctctgtgaagttggctcagcaaacaagcaagaaaacatacaatatctttgaggagcaggagcagatggattgaaatgttaaaaatctggtttgttaaatgatttcagctaacaaaataattagagagaaaaagaagcacccaaactctcttccttcttcagtgaaatttaaataagatcattattaatcactcagagtccaccttgcaatctctatacctttaatactgatacttttaagaagaatgaaatgaaaatgagtgagagaaagaatgtcatctgtaaacattagtttagatgcaaatacttcaatttgtattgttacatgatacagtatgtgattagcagttttcctcattgcattataaagagttttgtaattagtgcattttttctaatggataactttttttccacagtactcttttaaggctcttttaaaaacatggaattgctggagagatatagaagtgaggttagttatagaaggtaaataatgttcatgtccgatttaccgtgaggccacctatgtttataggatattggtggatgaagttgaaatatgtgtaccaaacactgttggatgttagacacccaaagatgagtaacatcatggctgacaatgtactaagtacaacgaatggtttcaccaggaatccttgatgaattgattacaagttctgtggtagagatctatccaaatgttagctctgtctggggagctgacagtgttttcacaacagctaatatttagactaggtctgaaggtagaaattacagttaactggaagagaagagagagtagatcaaggtaggagagagcatttcagaacaaaagcaacagagatagctcctgaaactttaaataatttgttttttctttttttctaacttctgttatatcagtcaatgttgttatttctaatacattttgaaaaatttttctttgaagaaagaatgggctgtatcctgtcagcatgcagtaggtattaatcttgccagtaagcgggtagtgagcacagattctgtaagccccaccattagttcacttaagatttgttaatcatttgctctcctgggctggacactcaccagtaagtctttgctctcagaggtgaggtacgtggcatgggtaacacacatttcccacgtcgttagacatgtctgtgtgatgaatcaatacaggttcttccagttccaaatgtataggctggtacagaagcaattgtggtttttgcctttgaaagtaatggagtgatttkgcatgaagtatgccttttgttgactggtcttccatcaataaggttgtttatttatagttgtacaaaaaagaaatataagctttaaaaaaaggttgatgtcaaatgataaatgtatcctttcaaggaccatgtaaaaataggtgactatatttaatgaaactttaggtttcagaaagtgtttttctgtctgttttagaccttagctggatctccaaaatacaagtgaatcacccggcagttctgaggcgtgcggaacaaatccaggctcgcagaaccgtgaaaaaggagtggcaggtaagggttcttcttgagcattctgtgcctgtattttacaatgcatggtctcttccctcaaggccacaatattgaatttcactcaagatgcatctaaacttaaaagattgcagctgtccatgacttattttaataattcatatatgatgatgatgggttggagaaagataacacatttatccaaacaagttaaaatcttatcactcttgagtggcaaaaccgcaaatgaatttgaggcatctttattcatgagtgaattaaatggcatattttctcaacacatttattcagttttttagacatgccttctttggttgtcttctgttttaattttaaagccctaacatctaaacttgatgtgtccactgttgaggcccttaggtataagagttgacctttcttgaccatcatatttaccttactattactttctataaatcatttttcaaaattccaaaaatgatgtttcgtagagtacttgcggtcagcattttcttcagtgtatcccaaccaaagacgtgctgtgtaggattaaagggaattcagagttcatttcacaagtgagacagaatactgtgattgaatccttgagagtgatagttcacgttttgctcatccttagaaatattctggttgaaaaggtaaaataaaattcatcagactgagttgtgaaatatgaatattgttttaaaaatggaattggattaaattgaaaaaacaccaaaaaacttggaaacttttaaaaatgataatctcatcccagatcccagagcgggaggtaaaatgtaaggtagaaaccttctttcggagttcttctttgtcagggtggctctgatgggctctccctttggctgagatggagtagtcagaagtggggagacatgggctaataggggtttcaatttgggatatctgtgggagaaaaaaaatgtttaagcctactcttcctcccttttattttgggcagtgttcaccttgttagtggctcttgagctgtgtttatatcatgtatcaggatattccattgaacagtgtaggcataagatattaacacccatacttgtctaatgattctctactaaccacctgggttggaggttggttggtttgtttatttattaaatttactttgttttcacttttgtttaaaccaggctgcttggctcctgaaagctgttacctttatagatcttactacactttcaggtgatgatacatcttccaacattcaaaggctctgttataaagccaaatacccaatccgggaagatctcttaaaagctttaaatatgcatgataaaggtaatgttgttgtgtgtgatctatgtggtgtttagtgcttacaatactgattactaaatcaaagacgacttaagatacagctgctaatgatagcggtgatagaatccatgatagaaactcttgctgtgtatacatagacagattcttctctgaaaaacagcaggaagagaatctgagtctttttttttttttttttttgaggtcagttctttccatcaatggattaaaatgcttggtagagagtgactttatttcttttcagttcttcagttttggaaaatttctgtttagtgacactgaaatactctttctgattccctagccatacgtgaaaaagccagtctcattacttaataatcacatctcatacataaagtattttctgtgagtatatgaaatacttttgaaaataaagtgcaaatgagaaatatagcctgcttatatattaggttagatctttcaaaaaaagtcatattcactgccttagtatacatgaaaagaaggacttttctagagttgccataagtttagaaccttagcattttggagatgttggacacctgtaagaattgattcccttgttttctaaataaagaaacaaagacctggaaggctaagcggcattcccaaggctacacgtcttgttacttgctgggctggttttgggagccaggtctccttcccatggagtatgcttcatggcccccgagtgcctatctgctgtgagtgcaactggagacgttgaattggcccaatgcaggtcttttatcccaaataaacacgtttaggtttgtaggtaacatacaaacctaaacaactctacggcttttgaaaagtatttattatgtttatttcgtgttggccataaaaatatcaccttatttattgcacttaaaggtaacaacttgatgtaaggtcttatgatattgctttgttttatagtgactatttgaattctaaattttttaaaatttatgaacttatttcttaaaatcagggcttccgtttcagattttattatttcttgcaaaagagggaataggattagttaaatgtcatttttgtggtaccaccctctaaattgtacttatatttgtcttcatctgtccttcttcaaactgtcctttcttcaggtatgtcctatgtgaatgctctgtaaatatggattttgttatctacatgaaatatttgcatttagtaatgatcaccaaatttactatttagacatttttaaaaaacagtactatgttaatctcaaagatgagtatatcaaacttgtttttatgactttaacgataagaaaataatccatattgtcaagaactagaagggaatgtggaaaataaaaatcttttaatttattgcagtattgtgggggaattatttttttctcatttgatttttgccagtgttgcgatataaataataattaaaagcatgttgtatgagttgaacttcattgaaagttggctattcctattttttcttgataggcattactacagcygccgtttgtgtttatcccgcccgggtgtgtgatgctgtaaaagcactcaaggctgcaggctgtaatatccctgtggcatcaggtaaaatgtgttgtggcttttgttgttattttttaaacaygtttccagttcttcatacaatggggtattatatgtaggtttgtactatgatttaaattagtttatgtatttaattagttgtatttattcatgattttagtatgtactaattgcttagtaagtggaagacatttattcccaacaatatagaactgtattcctatccttaaagaaactcagtttaggaggaatagtcaggtaaagaaaaaagtcataaggcatgacatatagtatatatatatatacacacacacacacacacatatacatactatatatgtatatgtatatatacatattaactatatatataactatatacatactaacacacacatgtatgcatgttctgttatacatatatatgtaaaatataataataatgatatgcgggctggggacggtggctcacaactataatcccagcactttgggaggccgaagcaggtggatcacttgaggtcaggagtacgagaccagcctggccaacatggcaaaaccccatctctactaaaaatacaaaaattagccaggcatggtggcaggtgcctgtaatcccagctgctgggaggctgaggctggagaatcgtttgaacctgggaggcagaggttgcagtgagctgagatcatgcccctgcactccagcttgggtgatagaccaagactccgtctcaaaaaaaaaaaaaaaaaaaaaaaaaaacaacgatatgtgcaaaatgtgtagttgcggttctgagcagggaatgatatattctgcagaggttggtgacaccaaagtaagagaaagcatcgtcgtggagataattgcattggatcttaaaggatgaggaggagttcacagtgttaataaggtagggaaccacatgttagacagaggcactagcacgtgtgaaggcacaaagcatgttcagggaactggaaaaggtttgctgttgttgactacaaaggcagggctctgaagacagggcaaagggggagatacaggagttgaagctagagagggagatcagggcagaattgcagaggggatccatgccatgtgggggcatttggcctgtattctgatgatagggaagacactgaaaggttagaggcgtgacgtgatcagcttcatggcatagtaagttacctgatggtactggataaattagaaaaggagtgaaatggagttaggggagacttgtcacagtacatgcaggacctgataaaagccacacaaaacctagaagataaaggagagagtgcattcagaagtcactgacttcagatagacacggtaggacttggtatgacagaaaagtctttaaaacattagtttggtaaatgtgtatctgtgtgtatatggatggatgaatagacagatataaaattagattctagttttaagagatgttagaggaatatcctgatgctttaaaaagggagtctaggccaggcatggtggctcacatctgtgatcccaacactttgggggggctcaggcgagaggattgattaaagccagaagtttgagaccagtgtgggcaacaaagatctctacaaaaaaataaaataagtaaaaatttaaaaggagtttataaaggtcattagcttattaggaatatattaaaagaaacatggtgcacagtatttatatagaattgatttatgaggattcctgaagtatttggcagctacacttgtatagaccttaatttttcatcagcctcagtcagttcagtttttgctttaaacaacagagaaacatgctttcctctaaggtaacagacctaaggaatttttttaatttttattttttgagacagagtctcgctctatcacccaggctggagtgcagtggcgcgatctcggctcactgcagcctccgcctcctgagttcaagcagttctcctgcctcagcctcccaagtagctagggctacaggtgtgcaccaccacaccaggctaatttttatacttttagtagagatggggtttcaccatgttgaccaggctagtctcaacctcttcacctcggatgatccgctagccttgacctcccaaaatgttgggattacaggcaagagccactgtgcccagccccaaggaatttaatatcaaggtaacatgacaggtttttttagaaacagggatggagagttaatgatgtgcatgtaaaagatgttactatttttcaagagtgtagttgtgttttgtgttttcattttcctcttatttacacttggctctgctcttcccaaccctgcccctgcctcaatttggtggactaattaggtgtgttttcctcctgcattctcttttctttatgctcatctgccaggctggttgtttttaacataggcagtgggaggaacacataggacagtttgtttaccacagctaaagaggttcatgagagaattaatcaagataaatcaagggtaaatgagtaaatcaagatagctaacttgatcaagatttggacccagaactagtgtgctagataactagtgttcattaagatagggctaccactactattttatggctatcactgtgaagataaaacatctttgctggttacttaatccaccttcatgagcatctctgcagcatcttaatttcaggtcttccagaaaatgatatttgtcctaacactaatatgagagaacattcaatttcttcacacttatgcataagtgatgttcttaagtgtcagtgcattggtctttaaatgctgatgtttgggggtttggaattctttgatgaactactactgaccaattgaaatttgttttcccctcccccccttgcttactttctttcttccctccttccctctttcttcatttcctttcttaactctattagtggccgctggatttccagctggacagactcatttgaagacacgattagaagagatcagattggctgtggaagatggagctacagaaatcgacgyggtaattaacagaagcttggtgctgacaggccagtgggaaggtaggtgcatgcttttacctaagagagtttcaccattcttccctggtgaatcagatgatgaggtaagatgtggtatgttttagaggtcactgttctaggtgacaagttagtagatcaaatggtgagtttaggagaaagcaggctaagattacccatccttgtgcccctcataaatctaggcagttgcctacctacatgaacttttcagatccttttgagtgcttaggtgaatagttacttccatgcaatagattcataacttttaaaacaattttattttaccaacatgctttttcttcagaagggaaaagttactactattctatactgttttgttactcaatacatacttcactccaggcaagtcttttatgcaaagtttatttgaatatattggaggaaacttcccttttttatgttaatttttgcagtctttaaaggtatgggattattaagttgactaagtttatttttacttctagcattcttagacacagctctgatgactatcatgaaattaatgattcactatcacgtcagcatacactaagacattgccctttccagcaacaagcttttgtttttttaaacagatattaaagaatcaaatagattttacctctgtcttaaatatattttgtgtactaaagatgaggtcattggtagctagaaaagtaaaattctctttcaaaaaagtcattataataaatagtttaaccaaaaatttttaatgaaatyacaagttaaagccaggatagtatattgtctctttatatatcaaataaatggcatattttatactaattatggaggctattcccacactcctttaaagtttaaataagagataggattttatctcttatttaacctgcttattggacttgcctatttctcatgggtattttcctgtgactgtttctatccatctgtatctgtaaagcctatgtctatttgtgaagcctaattccattgattgtcaattatgaattgcttttggttatgaagtagcaaatgttcagtcagtggtttaaaccctcagtatttattctcttatataaagtccaggggtaggtatttcaggggtgtgtggcagctccacaaagttcttggagacccgggctacgtttatattccagttccaaagcatgtggcttctgctgttaatgtcaagggcacttcattgtctgagatggcttctgaagctccagcaccttacactcatctcctagaccataggaaagaaaggcttttctcatcaagtctcacacaacacctttgtttattacacctttgcccgttggcctgagctgagtgacgtggccattcttggctgcaagtaagctggaaaatagagtttttagcttggaatattaactactttcctgtacattcccatttccattgcgttcaccccacygccccccaagttccccattaatactcatcaacatttataattcttgccaggtttaaactcttgacagttcacaaatatctttttgtattttgtgttccttttttgtgattgttcatgtgtgtgttttagccaattacagtcattctgaaaaggcgtattttaaatagatatctctgttcctatatattaattttgcttatctgcttttagtcacggatttcactaagatttaaggctagagtaaaatgaaaaagtgagtaagcgtagtatttaaaacaaatctggcaataaactttatgtgatttagttgtatacaaacctatatgtcctttatatcttaagcaattgtagatgtagaaattgggtttatattataacttacaccttttattaagcagttgtggatatagaaatatggtttatattatgctactaattggaaaataaaatacaataggagatgggttttgatgtagctgactgccccttaatgaactaggaatggttgtttttaagaactgataatttcccaataacaggcgtttatgcaaaatgtaatgacagatctttgtcctggaccatacttttatattaactctttttctagtgttaataacctcttgacccaaacaaattgaaaaggaacatttaatactagaaatttaattctaaatagaaacctgaaatgacttaggactttttgctgcaatattttgtcttaattttgattctcaatttgattacatattgtatttttcagtgtcatgttttaatattagctgtttattaaaatatgagcataaaataatttcttggaatttgtggatggaaatgtctatcaagcaattgcagttttaaatccagggccctctcccttgtgcagtgaggtttgtaggatatttggtaaagcacaatagaaagaaccccattttattttttaagttctggggtacatgtgcagaatgtgcaggtttgttgcataggtaaacgtgtgccatggtggtttgctgcacctatcaacccatcacctaggtaggtattaagtgcctcatgcattagctattttccctaatgcactacctgcctccaccctcccccaacaggccccactgtgtgttgttcccctccctgtgtccatgtgttctcattaagagccccattttttaaacctggcccttcagagtggtcttaaccatttctcatggatgtgagagtccacagtttagggtatgaattcgaggagactggagtttgggggtgggggaggtttgatattcctctctgggttctccttagtgaccatttaaaatgtccactttcctgaaatttctaacttttccaccctccttgaagctccttcactgttagcatatgaactgcctcctacttctcagagaaaataaaatcatcagacaggagctccctccaggtccttgcatcagggctgcttttctttgcttcttcctttgctccttcctcctaaattccttccctcgactgtgctgtggctctcatctccccctgcattttcagaagccctgctctatctattgggcattctttcttccgtgtcatcagcctttctgccagctcattcccattaagcatttagacatactcaagcttttcttagccatttatgaaagaacctacatgctggctttccttttccttcatccccagcaacgtcctcctttcttctcttcccttcatgactaaaattctgaaaagaaggcccgatgcggtggctcacacctgtaatcccagcactttgggaggctgaaacaggcactttgggaggcctcatcacctcttgctctgctgccgccctaagctctggttccgcagcaacgctctggagtgaggcgtcctcctcacttgaggttgggagtttgagaccagcctggccaacatggcaaaaccctatctctactaaatatacaaagattcgttgggcatggtggcacatgcctgtaatcccagctactctggaggctgaggtgagcgaattgcttgaacctgggaggcagaggttgcagggagccaagattgcgccactgcactgcaacctgagggacagagtgagattccctctcaaaaaaaaaaaaaagaattctgcaaagagttatatttatttgtttgtcttgagaagttcaaactaatatactaatgacctgtcatctcattatgtccagggcatactccccagttgtttattcagcattaccatgcaacatatgacacagcagactgttccttccttctggtaatgctttgttgttgtggctttggtgcctacattcctgaggtcttcctttctgtttctgattacccctgcgtctcatttgcaagctccttcacctcctctgtcatccctgaagtgtccatgtttctcagaatctgagaactgtggttctcagattctgtcccagtgtgacttttccacaaccttggtgtgctttcctttggaaacgtcatgtccttgctgatttcagttacattccttatggcaaagacaaccaaacctcctgagcaccaggaccacctggacccggggccacctgctccagaactcgtattccgttgtatcactacaccatgttgcattttacccatcatttacatataagtagacattcaaatatcactgacccttgacaaaatcagagaaatatagctattttggaaataaatctattaggccgggcacagtggcttatgcctgtaatcccagcactctgggaggctgaggcaggcagatcacttgagcccaggagttcaagaccagtctgggcaacatggcaaaaccccatctctgcataaaaaaaaaaaaatgcaaaaattagcctggtgttgtggtatgcgcctgtagtcccagctactcaaggttgggcctgagatgggaggattccttgaatgtgggaggattccttgagcctgggaggcagaggttgcagtgagccatgattgtgccactgcactcataagccactgcgcctggcctaatagatttatttctgaaatggcctgagcaagagagtgagaccctgtctcaaacaaacaaacaaacaaacaaaaactattaaaaagtgtttttatttccctgactttcttaacaatttttattaaatacaatttaattttttcttgattattccaaactgtttcattactgattatattatcccagaatacagtgatgctttcaggggccagtggaatctctgagatgattggcctcatagctcacagtccagactcttgtgctttttgatttatgtatcttcttatttgttactgtttttttgcctactccttagtggttaagctttttactgtcagatcatgttgagctcgtgacggcacactgtccttccctgccaatccttctgtcactcctgtctagctggacatggaaacgtggataactacatttctcacttaccaccatagttttaaccctatagggtgtggcatgtattgtaggctctcaaaattacaatacctgacaaacattttcaaatgatttgccccagctgctttcctgacaggattagcatatccccctgggcatttgtgataaaagaattgaggtgtgtatgtgagggaggaataggcttctaaatggggaaaatccctccaggtgattttgttctccttccccaccagtcccatgtccttattaagaagtactaactcaggactctttcttcttcttcttttttttttttttgacataattccagttcttagttgcatatactttaggtgccagataatggaaacattgttgaatttacatacaacaatgtacgtaaattcatacattgaatacatttatatattgtatgttttattgtattactaatactaatcagttgattaattagtacatcttgtatttcctgtatgtttctatgccgttagcctggatctgtagttagttgtaaacaggagagtttgatgaataaagtgttattctggtgaatttagctaagaagtgcatctgcttcctgtgctcttgagaaaagaagactttcctctccctgggatggctgtgctctctgataaagatagcatccaagtggggacatcacccggccaggcagccaggccacccagtcattgctggtgtcacagtcagacccagaacaaatgcaccatggggtaagaagggaggacagtactgggaaagcaggaatagttgaaagctgcatctttgcattagacagatcttggctggaatcttggctctaccgtttactcttggacaggttcttctctgtgctttctgttccttctatgtaaagtggagataatgacatctacttcacagggttacaatagggaagaaattagataatgtatgtaaaatatcatcctgttgcttggcccagatgcagccctccttgccagctgcagtgttgccttctctttctccctcctcctgccccgatgatggtctgttgtcaagggaagtgacacatagcacatgtgttaagtgaataaagtggaactctaaagatttgggttttagtctttatgattttgataatttatacctagaccttgggtaaacacttcacttctctctgcttccatgtaaatgttacaaatgaggggctaggacataatgatttttacaaccctttagagctataatgatctttaattttatgtttagtgttttcattttcagtgaatattattcccatgattagtacatgtaatacagtatttcttaatggtggtgttgaagttgacatctaagatgcactccttaaacagttctttgaagaaagcattcaccagaagttgttcatcatttcataaatcttattgagcaggttttaaaaattgaatagtttccatgctcwgtaaatatacagaggtgttcattttactttttttatgacctctttctgttgcatctatttacctaatatatttaccagtgacagggaaatgctatcagattgcaccttgttcaggaatctagctccatgagctgaggacctggagctggctttactagctttgggagactcattccacactggagcaccagcagacgtagttccaaaggtggctaggattgtctgacattctgcagcatcttatgttcaatgggcaattggaagtaccattcgtctcctgtatccagagcctcatgtacttttcatctccttcaattgtttacccctgaattgctctcttaaatctggcctgtgaagtacatacatcatggctatcaaacattttaggataagagaatgaaatatcagcaccaaagtcacattatttttcattttcttanatgaagagaatcctaaagaccttgaatcagggcaataatctatttttcttatttgctgatttttacacaagaaggatggtagaaagaacatctcaaaaataaattggtatatttcttttatagagtgttaatcatattttattagaaaagcagtctctaaatcgatagctactttttggggaggaattacataatctataatttgtgatttctctgttttggaagttgtatataacagaaattctggaaatacgacaactgtatgcttttatgattttcatttttatgctacaattcttcaaaacttcagatactattgataaaaatgtgcatcttatctcttgtaggttattataatatctggtgtgttagctcatctctgccttagtcttacaagattaattagttgctttggtggatgaaactgtgttcttgaacattttgtgacttttttagtttaaaaggttgctgtacaattttatattaagtgttttactgtacatataattatcttaagagttattttcaggccattcttgtgcagtgttgaacatctttctgatactcaaaaaataattgcttagatatgttcgttaacaattatttttaagtgcctttgaatagcaggaaatatagaaggaaatatactttatgacttttagataggaaacagtctttaaacgcttggattcttacttaaatcataattttatacatataagttttattaacagagtttttgatgtctagagcagtgcttttccagaatacttagcagattgccagccgcttcaaaattgagaagataccgtcctttcaggtggatcctagagagaagaaagttaattttatttatttatttataagtgtttttagctttttgagggtttttaaattttcatttctttttttaaaatacaccattctatttttgaaaataatgttaagaatgagctcattaaaaaagaaaactgaaaaaaaacaggtacacccacatttccaactccatctctcttttcagactgttcaagatgtacacatgtacttkgtatatctgtagacctgattctttccatgttgttttcagaggttgacaccaaactaccaagtagatatttatcctttggtttaaattcagattccattccaccaaagcaacatgaaaaaacctaatgtctagttttagcttctggggattacattcttcaggtaagaagtgaaaatagagaataaatggtgttaccatctttattcagaaagtcattatttttagcaaaatggggccaaggcagaaaatccaggttgtaagatttggaaaaaggagtgtccacaccatgggacatgtacagattgatcactatgacagcagccctttatagaggtaataatgttgtcattaggttgtgacaattctccagagacttcaacagccccsrattaataacatctggaaattgttcagatgacataaatttctgttttctgttttaaggcttccattgtgcctttctgtggcatctgccrttgtttttctttttcaaacctttcaaatcaggaaatatacataaaatacaagattattttcctcacrtgtgctcctaggctcttgtcttgatagccagcgttaccaaatctatcaggtaaactgctggccaactggtatgtctgctggaatttctggaggtggaatagcaaatgagttcatctggcaaagagagcatctgaaggtccatgcagtcttggcaagaaaacactaagtcccacacataagacagggatggggagtttttcrtcactgaagaggccatctttakatctcaactcttttttttttttttttttttttttgagatggagtttcattcttgttgcccaggctggagtgcaatggtgcgatcttggctcactgcagtctctgcctcccaggttcaagagattctcctgcctcagcgtcccgagtagctggaattactggtgtccaccaccatgcccagctaattttttgtatttttaatagagatggggtttcaccatgttggccaggctggtctcgaactcctgacctcaggtgacccacctgcctcggcctcccagagtgctgggattacaggcgtgagccactgtacccagccggatctcaactcttaaagataattcaggaaccattgctaaagtgaacaaggccagcagattttggagcacagtcaatcttcagtgagggcagatgtttcctaattaaattcctgaatttctttttggcttctgtcctttcttcattatcaaagtaccaaacagtatagcacatctggtctcataggaagacagcacytcstgtagcttcctgcgatctgaccaggagagcaggactttttcacaattggcctccacatctgccacgaatgatttctcctctgaaaatagccataggatcccaccgtgtagcctggtatcccarttcttgttcagatagtagatgcaggtggtgcagcagccatcgttgttgaggtgtccacatgatgaatgtaacctattccatttttaagatagcaagccaccattgccttggacctctccttgacatagtattttcccagtggctcctgcactagaggactagcctgtcagtgagggacaggaggaagccaatggcctcgcggcccttcttgttgctcccagaactgtggggtgaactgatcaccccacagttcaccctttagagacactgcacacatcccagccagctggctgtcncgcagggcccccttgcaatgcagctgtttaatgtgctcctggatgcagttgnccaccacctccttgcccaggaagttttgcgggtagcagaagctgacttcccgcagacagcgcatgatgtactctagggaaattttctccaattcctgcctcatgatgtgtcccaggggcatttcacgcatagtgcagaagtcggggaccnccagcgtgcacccagagagggaangatgtatgtgatgtgaagccaaggtgtggggagtgtggccatggtcccnagccacngcagtcagtactggggacaggggaaagttgctcacaactctcaggagaagggatctgcgttcagggatcagtgggagtggtgcgggactccacgatctagtgctggacttggaagttaatcttaaataaagaaaactaaaatgctatcgatgcaagttcctgctggcgtgcggggacagcattgcagaaggtagggccagttgtcaacctgatttggatgctgtttcaaacatgcagtctgacccctttccctcctttccactccttggatccacactctgatgcacacaggcctttctcattgtggccgagtgctctgattcctgtcagtgagcactccactgacacagcctcacttgtttttcagctgggaacgacaggcagaggtcaggttatgacctctacttcttctcagtgtggcagtagtaggagggatgcggggagacaaacgggagacaactcttctgctagttgtgccactatattgattaagcatctgcaatgtaatatatcctgggcttctagcacacccactttcactacccctgaaaacctcattataagtcaaaacatttattaataggtttttaatgtgacatcactatgccagccacttctctggtgtatgtgttttgttaaattttgcattattctgactaatttgcagtcgtggtattggaattccattttcatttgtcaggcatctttgataatagcctaccaaattattatttttctaatatatggcaagaattgctttttttataatagagaatttccagttttcataatgtttgaatttttaacaacagacatatattacatgtgaatatgtaagcagaaaaaatagtaagggctctggagaataaggtcatgatgtttgcaaatatttaactataaggacatttactgaagtattacttataatagcaaaaaatctggaaccttaagtatccaataacaggaaaatgattgaatacattttttatgtccatgtgatggaatattgtgcagccattaataattgctccatagacctatatttattaatatagaaatatatcaaggatatattgaaggaaaaaagcatgttacagaataatatgtaccatatgtaatcacttttttttaagttatagaagccatagagtgattgatagtctaaaaagccctcctgtaagaaaaatatctggatgctaaattacaacaaacatatcaaattattttttaacttttatttttgaataattttaaacttacagaaaagttgtaaaattggtaygcaaaactacagttttatcactgagattctccaattataaagtgctatcccatttcctttttttgacttatttcctctgtgaagtgtgtacatacatatataaattatgtattatatacatatttttctgraccatttgggaataagttgcagacctgttcacctgttacccttaaatacttcagtgtgtatttcctaagaacaaggacaaggacagggacactcttgtaccaagccacagtactgcatcaaaatcrggaaattaacattgatraccatayggccattaaatgtacagattgttcagattttgcagattgtcccaatagtgttctttattaggtgtagtatcagttgtttcatatctctttaatattctttaacctaagaatactaagaacagtcctcagtcttcccttgtctttgacgattacgggcctgttrttttgtaaaatatacctcagtttgggtttgtttggtattttctcacagttagattcaggttgcacatttttggcaggtataccacagaacttttgctccgttcttctcaatgcattatttcaggagtcacaagatgttaatttgtcccattattgatgatgttcctttttttacttggcaaagatggtttctgccaagtttctccattgtaaaattaataagtattttgcattttaataagtaattaatatagattatgaatggagatattttgagactatgttaatatccttttcctcwtctaacttttattcactcttttagcatccattgatgattttttcagctattactctgattttctaattctgtcatttcttctatacttaagagttggcattaccaaatctgggcatgatgtggaaccctacaaagccagatgtggtattgaggtccttccctcgctcccttcctctgtccttccctctctctctccttccctcccttccttccttcctgtttgtaagaactcattgattcttattttactcaattggttataatcctttaccatcattatttattttgatactcaagtagtcccagatttggccattgggagtgtaaccgctcagtgggttcaccttgcctgctgcctacacagagctagtttctcaagacggaaattacagtagagaaagagtaattcacacagagccagctgtgtggcagaccagagttttgttttattactactcaagtcagtctccctgagcatttgggcatccgagtttttaaggacaacttggtgggtggaggaagtcagtgagccaggagtgctgagtggttggctaggagatggaatcctagggaattatttgaacctgtcctcttgtgctgaattagtttttgggtgggggccacaagatcggatgagccagtttatcgatctgggtggtgccagctgatccatcaagtgcagggtctgcaaattatctcaagcattgatcttaggagcagtttagggagggtgagaatcttgcagcccctagctgcatgactcttaagccgtaatttctaatcttggagctaacttgttagttctacaaaggcagtctagtccccaggcaagaaggaggtttgttttgggaaagggctgttattatctatgttttaaactatgaactataaactaagttcctcccaaaattagttcagcctgtgcacaggaaggaacaaggacagcttaaaggttagaaacaaggtggagtcagttaagttagatctcttttactgtctcagtcataattttgcaaaggcagtttcgggacctgcttcacactggctcctctatcctttttatgttcccatcattctttgagagcttccttgctttcttgtaatagatgtttcaggygtatctttgactttgtctgctccagctttggaatcagtcatttctccaaggagctcttgctccttttattgattaactgtatttagaaaccaagatctgggtgctaggtataactcactgctattgggatgttattgtttctaggccctcttgtcagacagatctagtaaatacatgaacgtacacatatacacagcacacacatagaaacacacattcatttttatttatttatatatcagtctataaatctgtcttagaacttacaacttcacactataacctctattacactccagcattgcatggtttattcttactttccccttccatatttataccccttcttcccgtcagtgagatatcttgctcccattatccattatcttcagtatattcatcttttttatcaatatttgcctttttatcaattgctttgtgtttgacaatctctagaacctgcgggttgtcttcctggctctacttgccaagtcctccccaacccctakaattttcagtcctcgctggtaagggtgaccttcactttccccagagctgactgcacgtccccctcacctcgcctccatcatgttgccatgatgtagcaacatgcaggccaagaatttctctaggccccagtgacatgggggctaggtttctctccaccttcttggcagtgtgtggctgagaaaatccctgctctcccttgtctgtggttgagagctcccaaagatagagttcagaatcatctttctaaatcaacaagaggctctttcatcttaattataacagcttaaacttttagagtaagtcarcgtttaccatcattttacgtgtgcttattatcaaaggtggatctgaaggaaaaatgattgattaccttcctaaccgttttaatacttttatatttattggcagaatttgagaagggtttgagctgtaaaaataaagctctcctatctaatcttgaggagaaaaatgaagcttggagaggttcagtaactttcccaagtaacaccactaatcagcggccaagcaagggctgagaagtcctgattcaaatatatgaactctactgtagcaccataccctggttttcttcccatccagggggctaaaagagcaatttagagatcatttttagtgtattatacaaaatttagtatcttatatttctgaattaccttggaacaaagagcaatttagagatcatttttagtgtattatacaaaatttagtatcttatgtttctgnattaccttggaacttttcattttatgcagcttttttcccctagaagaatgaaaaccaggtcctaggattctaatgcccatctgtcaagtgagtagtttgaactagaagggagttgacatccttctacgttctgagttttgacraatctgttgctcgaagcactgcaatgtatttccctgggaatatgttgtaactgcagtgagtgtacacrtgcatgcatgtgtgtgtgtgctgggatagaggcagaaaattttgaggaaatacagttttattccacgtatgaagacatgactcctcctctctgttctataactgacccacagtaagatttggagcaagtcatttatctctccacatctcacttttctttctttcttttttgagatggaattttgctcttattgcctaggctggagtgcaatggcgcaatctcagctcactgcaaccttcgcctcccaggttcaagtgattctcctgcctcagcctccagagagtagctgggattacaggcatttgccaccatgcctggttaattttttgcatttttttagtagagayggggtttcaccatgttggccagacttgtctcgaactcctgacctcaggtgatccacctgccttagcctcccaaagtgctgggattataggcgtgagccactgcacccagcctacatctcatgcttcacatgggaagtgtggaggtaactgcaaattgtctcacgatggatggttaaatagcgtgtggagaacactgagcatttttgagggaagaggctttgaaaacgtaggggatttctcatcctttagagtaattattcctcatgaaaawttttttggaaagggcatctgttgaacttattgcttcacttgtaatttcctctgtgtatgtggtctagcagcagttataataactccatacnccaccattgtcctttcctaccaacataggggaaaacctgctcattcgtttttccattgtttggcttatttgtattgaaaggaaagtgncagctgagtttgttaaaggacataatttgagattgactgggttacatttcagccatcaagccactttgattagcatatgtcattcatctagtttctgaggtgtctatcatggtactgtcaaagtcctcaaaacgacctaaacactaataatgcttctttgtggtttctatggcttgtgttggagtgaagtggtctattttttcttatatgtaagactggcaaattctagttgtgctttcataagtattaggacagtgcttgctattttttgttcgttaaagttatttttgggtttctggaagtgtataagggaaaatatgggaagctagtattgaatgattaactgcctactaaatgcctggttctattctagcaacatatattatttaatcatcacaaaaatatgtgagcaaactgagcctccctaagtaattaggcttagagaaatcgaataattcctaaatgtttacacaactagcaagtagcaaaaatgtcttatctcaagagtctgtgctattcaaagtagcatgggttcttagcttaaaaacaaacttgtttgtgatatatagtaagccgtttcccccagactgtttttttaggggcccaaagaggttttattttatgttcttcaaggaacatagatcatggtgtcctctgcttttgtaagtccctctgtaatctgagcctgataagcactgaataataacaggaacaccatcactgctgcyaccaacaactttgaaaacaggaactgacattccttgagcatgaacaatgtgctggatattgtccttatctattcgtgtgtgttaacctgtttgaaaataactccgtgaggtgtgcatacttctatcattcccattttgtaaatgaggaacatgggacaggtttagagttaagtaacttacccaaatcaaacaataaactagtagtaaagttggggtgtgaatccatatactcaggagaatccacatttttgtntacaatactatacttcttcagtaaatattcatgagttgaagaaaaccaattctgattaagtgaagctgaaagggaatttattatattaggaagacataaagaagctcactgaataagtaggaagccttgcttggaaaaaaagcaggaccatgagngaataaggagcagagaacanagtcagattgtgccacaggaagagcttgggcccagggccactgctggtgctgctcctactggccagcacaggtaccacactgttggctggtggctggcccctgggacactggacttttggatctcctgctattgctgatgccacaataataaagaaaatatctaactattctttcatctttgcctcactctttaagattcaaaggcctgagtagaagcaatcacttgatagagcccaggtcacattttaaaaagaccagatttggtataacttttgatttaattgttctgatatattttgggcagaatggtaacagaaagaaatgacaactttccacctgttgaaccttaaagattaagatattttctcagaaaaacttgatcctgttatgtggtaaaataggccagtaaaatgattttagaaattggcagttaaagaatgagaagacattggttgcatatttgtaaatccagttatgctctaagtgaccacttgcagttcattctgtttggatcatggattaaagagtataacttccaaatgactgaatcataaaatacctctggttttcgtggttaattttaactatacttcaagaaattcacttggcatcagaaggtagtactctagaaaaaggatggtgtttttttgttcacaaatatggtcgtgatcagtgttttaagaatttgttttacaggccaaagttcactttaacaactgctgtaataaaatactttccagccttgtctgatggctcactgattgtaagcagtaatccaacagaactttggttactggaactgggtcaggccatgaaataagatttgacttttataacacaacacttagtggaaattcattttactagaattctgaacttaataattaaactttttgagtgcttataacatgtcaggcagtatgcaaagtactttgtatatctctctctcattcctggtaaccctgtaaagtaaatattattgacactttaaggatggagctgatgctgacagaaataacttgcctaaggtcccacaggaaatgatggagttgggttttaaatctgcatttgtcctactctaaagcctgcttttaatgacaacactattttgtggaagaaaatcattaattaaatcacaagttaacttggattagcrttcttggatttttagatcagaagattttccttgtcacttgttcttagaaaacaagtttctttttttagattcaataacttaagaaatgtcattccatccaattcattctctgaattaaaagaatataattttttttttcgctccatagtctattactatttttaacattcttacacaggttgtcatattggaggcataagtaggatgattttctcccaggttaggtagatgggcagggtaaggtaggtggtgtggcatctcagatcatccctagtactcagaactgcacgttattaaggatctgtgaaaatagtctgttctttattgaaccttctgtgggtaccatctctcagtggtaacaaactttctaaacttactgagcatcttggaatagaatatttgctttcatttctcttcatttttcacttctgagcttcaagttcatgttttctgtgattgagaaggcaagctttatttggctgttataacttgtggttttaactgagactaatttttcatttttctaaatgtactttactaagcctgtgaattatagaactctcattttagctttaagaaatgcttaccccaacccttattatgaatgtttccctcctgcttggtttactctgtatgtttataaaactacttcctatgggccgggcaccgtggctcacacctgtaatcccagcactttgggacgctgaggcaggcggattaccagatcaggagatcgagaccatcctggttaacacggtgaaaccccgtctctactaaaactacaaaaagttacccaggcgtggtggcaggcgcctgtagtcccagctactcgggaggctgaggcaggagaatggcgtgaaccccagaggcggaggttgcagtgagctgagatcacgccactgcactccagcctgggtgacagagcaagactccatctcaaaaaccaaaaaacaaaaaacaaaaaaacctacttcctatgaaagatactcaaatacaaaggaaagaaaaagccttggtcttgttaccatggcagtagcctgagttcaagaaatgatagtggccggcctgaaaaagccaaaattcactagtatcattgacaaaagacttaaataattttttaaagatttaatacacatgattttggtctaatttgcttactaaaatcctgctacctttcatgtaaaatgttaccttgaatatgaaatatgaaataaatctgggcccaatgtggaaccctccaaagccagatgtggtactggggtcatgggctcaggggttaacagatttaaggcagcatctctgagcctccctgcagagatggctttgtacacatgcgtccagcactacctggccaggcctaacactttttagtcagatatataaacatactctggcaggcagtggggcaagctgctgtgtctttattgtcatgaacataactctcaagaaaggtgtgytttatattccaaccaaagaacctattacttgtgaatggaagaattaataagaacctaagatttttttttattactttgcaaaggggtacaccactgtatgtatggtagctacatttgttttttgttggaagcaaccatcatatggacaagacagaaattatttataatttgcatgtcattatgatatttaaaaagctctatgtctctggacctcaggccagggcttagaaacggtttcatggtagcaaactaagcattccttgtaacaggatgtgaactgcaacagaatgctccaggcaatgttaaattggggtgatttttagaaagtgacaaatgttttatgtttcctaaatgtgaaatgggttccaccagctctaaacggctgccaagttatgttatcacttgcctgctttgtaactgcctcaattattttcttccccagccctgtatgatgagattcgtcagtttcgcaaggcctgtggggaggctcatcttaaaactatattagcgacaggagaacttggaactcttactaatgtctataaagccagtatgatagcaatgatggcaggtaagtgttttatgttcaaataatgttttctattgaattgatgtttttaggagaarttaagtaagtgaaagcatttagctattaytaaacgtgctaaccacttggaatttttttgcgggaggaatcggatattttgtaaaaacatgttcaatgtgaagtggtcaaaaactcctggctttcttccacatttttttttgtgtgtgtgtggcatttcattgctgcactatgcttataaggcagtagatggctctcttgttagtgaattgccttctgttttattctttgattattcactcatcaacatatgttagacaggaatttctttgacttactcctctctgaatttaagcttttcatttatctcagagatatatatccatactatctgagacagcctctgcttttgtttgtgttaatgttttaaaatttagtgcagtatcattgatttttatactttcaaatataagttgacttattctttatctctgtgaacagcaggtctatccatttagacatccaagcttgcagcctaggagtcatgcttggttctttctttttctcacctcacataaatcagtgaasaagccttgagagttctctctagacctctttgctgtgtctgacacatcttccctccattctaagtgctgctgtcttaggccaccatcctcctccacagggattacttcagctgttcccctgtcttcctgacttttgttcccctccaatctgttctccacactgtcaccacaatttttttttaatgctaattttattatggtactgcttgcttaaaattccttcagtggtttcccttcatctttatggtaaagtgtacattccttgattcttattttaaaaaggtccttcctaagaccctggctgtgcctctgctgtgtcattttcccttcacaccatgttctccagccaggtagagttacttgcacttctctgcagatggtgccatccaaccttttgagtctttgtacgttctgtgcctcctgcccggaatgccttttgcccaaataactccacatcttggggttcagcacaggtaccacctttttcaggaattatttcccctgacactgcttctccccctnctgtttggcccattatctcctctgtgtgtccccacggcattcaagtaaaagccctatcatataacttatcacatgacattgtgattgagtgttgaatttctaggtgtccttctaggggccctatatttggatgaagatacctggtttctctggtcttgaatctgggccagccatattcttgtgtacttcttgagtgctctgtcaggcctagtagatcattccttggaactctactgaaaatcagcctactagtcagcaatggtgctgttgctctgggcacaactgctgtatctagaaaatatctgcagctgttatctgagagcaaaatctcagaaaaacctaaggatgagaagggatggaacactttgaacagttgttcatcagtgatgttggcatttcaaagattcacagtagaagactcactgtgcctcttaggaacctgggaaaagccccttggaggctacttggtgtacaggtagcccccctttatgctgcttgccagcacaagtgattgttagcccaggtaacaaagtaaaagtttggaaacgaataacagcagccacttataggacatactttgtggtagccacgctgttggttgtgcacatggagctgagatactcctcagggtcacatcggagccaatcttgtgatacctgttaccccagctgttatcctggtcacaatgaaagtgtattcattctgggaggtcagccaaccctgtcctacgcacagcacctactactcatgatacaaatgtggtattaggtcatcacgctttggaagctgtgtcccaccctccacccatcctgtccacagaaaaaaatgtgattataaacatgtccctttatttcttcctgtctgcttgtttctctgttcatgttgtttatccacttcatttcttcatttaagcagtgtttgttgagcacttagtatgagtaataaaaccgtattcatggtgtgctttaccaggtacattgaaacaatattccttcgtcctcacatcagtcctggagtggaagaaatctaggattgtgtgacttgtttaaggtcacaaagctaataaataacctgtatcactatttgaacactctggtcttctggctccagatttattgctttttcacttgtaacatggctatttcccaaggcacacactagattttatcatgaatgaaagacacaatctttgtgaggcataatatatgaaagcatgtagcatacttcctggcctatagtttatacttcctactctgttaagaaggtatataatagaattgaagtattctttgatgaacttgaaatattttgaaatattttttatattcttgtcccaattttatatgtaacttgcacaaactaatctccccaaaagtaatttacaaatttctgactaaattctgtattctacttctgtggtggyataaaaaattttttcttaaatcaatttcattgaggcagatttgcattcagtaaaattcaggtgttagatagacagtgtgatgagtttggcagtttgcaaacacctgtaaccactactcccttcaagacacagatcatttccatcctcctagaaatatctttgtgtccctttatagtcgcctccactcagctcacctgctgtccccgctgcaaccacttttctacttttatcaccatgcttagctttgccagtattagaacattatctaatcacatagtgtgaactcttgggtgctttgtttttggtttgttttgccctcactaaaaataagagataagagatcttaaggagtttgcctagaagtatttcactgtgtaagtatactgagttgctaaaattgttggcataatgttgtttataatatgttcttccattctgatatctgtgggatctgtagttatatctctttctttattcttgatattggtcatttttgtttcctttcctgttgttgtttttgcttttctttcctcctctgcttgttcatgctagggctttgccaattttattaatcttttcagagagccaagtttttattttgttgtttttttttcattacttttcagtgaaagttattttctaatttcccttgtgatctcttttgttatttagagtgctatttacaatgagatatttactttccaaatattttgtgcttttatggatatcctattgttgctttataatttaagattttgttatcctcagagagtatccattgtaagaatcttttgtcttttggaattaacagttattttgtagctcattttatggttgtatttagttatatgcttcaagtgcacttaaaagaatgtgtatttcagatgttasagcaaatgtcagatcgaaytggttgataatgtttttcagatctagttttgttttctttttggtctactggttctgtttattactaagagagtgttaaagtctccaaacatgattgtggatttgtctggttatccctttcgtctgtcagttttttcatcatgtattttggagctctcttatgtatatatacctttaggattgttatgtttacctgttgaagtagcacatttgtcattatgaaacgtccctttttatctctgatactagtccttgtctgaatgtctactaatgatgttcatctggccacaccagctttcttgtgtttaatacttgcatggtatatatttttttccatctttttattttcaacccatctgtggctatatatttaaaatgtatctcttgtaggcatttcttttctaatctattatgacagtttctactttttagagtgttttattcatttacatttcatgtaattgatatagtaggagttaagtctgtcatcttgcaaactttttcctgtttgtttgaatctatttttggttcctcttttcttgcaaccttttgggttcattagctatcttgtaacattttgtatcttctgttggctttttatctacagactctttgcacaaaatttttaagtggttgctctaacaatgtgcatccttaatttttcacagtctacttggaattaatgttgtttcactatacatgtcacaaatggaagaaccttacaacagtttaatttacatcctcattggttctttgagttattttaatgttcttttctatatatattacaaacctcttactacaatgatacgaatttttaacagtcacttgtcttttgaggacattaacaaagaaaaaactaagataagctagtattttatgttttccctaaatgtatcactttagtctttatttcttcctataaatatgagtttccatcttgtataattcagtctgggaaacttccctgggtattttttgcagtacaggtctgctgatgatgagttctttctggttttattcgtctgaaaatgtctttatttcacccccatgttctaaggatagtttgctgaatatagagttctgggttgagcattttcttgtttcagcctttaaataagtcattccatttcttggaatcccatttcttcttgtttccttgtatgtaatatcttatcttactctagctatggtcaatcaatattttccttttgtcttttttgttttcccagtaatttgaccacaaccgacctaagtatggttttctttgtatttatcctgaacttttctgagctgcttggatttggaggttgatgttttctaacagtttaggacgttttcaaaaccatatatatgtacttttttttttttttttttttttttgagacatagtctggctctgtcacccaggctggagtgcaatggcgtgatctcagctcactgcaacctccacctcccaggttcaagtgattctcctgcctcagcctcctgagtagctggggttacaggtgtacactaccacgcctggctaatttttgtatttttagtagagacagggtttcaccatattggccgggttggtctgaaactcctgacctcaggtgatccgcctaccttgacctcccaaagtgctgggattacagatgtaacccactgtgcccagcctaaaaccatatttttaaatgcatcttctaccccattctattggtctttccttctcggaccccaagtacatgagtgttagactatttgatattatcctataggttactgaggtcctgtttgttttatttttaatcttcttttctcctctgttctcctgattggttacatggatctttattcaagttcttttgtcacaggatctttagggtgtcgctttgccagtcagaaacctccgtgcacttctgcttgagttttgctcctggttgctggacttgttccacccacttggcccggcaggctgcacttggctcacactgctggcctgggtcgcacagctgccaagggcaagccaggcgcggagtggcaagggatgtgtgagtgagtgcacgcggggtccagccactgtgcacagccaggcacatcagctgcggcagggtgggcagctccaggtgcagactccatgcgaggctgtggctggaccagacgtaccacaagcagcttctgctgtgggcaccagcatctggacaaggggaacacatggtgcccaaaaacttggagacaccaggaaccacagagccccaaagagggtgttacagcatgtcacaggcctagctgggggagccctgagttctgggctcccagaagggccgcagctccttcttccttctcgttacctgcaatgtggtgagtcgggggcatgttttagccctgtttgtgttacagctctttcagtcccgccatttggtgggtcctgagttcttgtcctgtgtccaggaagaaagaagtacttggacaactggagggtgagcaaggcacagaggagcttcattaagcaacagaacagctgtcaggagacccaaagcaagtagctcctttctgcaggcaggtcatcccaacaagtgtccagctctcagtagagaggagacctgtagtgggtagctcctttttgcaggcaggtcgtccctgtgagtgtgtgagtctgactgagtctgaggtttttatatgctcagaatgaaggaagtgcatgctgattggtccatgggcggccatggatgggcctggaaaaagcaccatcggactgcctgaatggtcatcaatgaagttctcactccaggctgcggccttcactcagacctggcagcctggttcccaggcttcaggccatccctggcatgaaggtggggcttcaccagggacccatcccttcctgcctaggaacctgtctgcctcccaccaccatcatcatgttgtccacggcacccaggctattcacactgaggggcgcctgcagacccacaccaagctgccctcagccccttggcctttctcctatgcttgttgtcgcccaaagtccagagggggccaaggcggtgggaggctggcgtgtcagcgctgccctgaatgtgtgcacactcagccagattgcggcagcatccaggctcagccacagctttgctccgcagtggagaaggctccaggagtagggagaggccagggagtgggaccaggtacttctgagcctgcaggggtagagggcttcccaggcttctaagagcacaggaatgcctgggtctggagatgtggcttgttggatgcagctgcccctgggagcacagggctcctgccctaccaacatggtagagggtggagctcccacctgttcccagacctcaccagctccacggagtgtgcagccctagccacgcctcccccgctgcaactggcatccccacggtggctgctccagacaggccactgctgccatcactttgatccttattttctatttcaaattggcttttaagcctatccagtgaaatgtatgctgctgtacatttttagtttagaatttccatttgattcttttttataatttttatttctctactgacatgtccccactttttcactggttgagatcatattttcctttaagtacttgagtatatttgtaatagctgatttaaagccttatgtgctaatttgtacagctgggttatttcaagggtctgtattttgagcttttaattttttagtgcctgagttttattgttatttatagcaggagggcgagtctggtgacattctgttatgtctgttattcttctctgtttttgttttcccattaatttagaatcagaatctcaaagggaaaccatttgtcattacattcataacaatttattttataatttttgtagccatttagattatggtcaaaaagaaattctttggagaccaggtagagatatctaactatgttagtctggtcttacacatcattgtaagtaaaattgtgttaaacaactttggtcaactaaatgttagtagtctaaactgtaaggattattggtttaatcttgtttagaaatctttcaaaatgttttagagcaaggaacacagtcagaagaccagaactcttgttctgtcttgcatattttgtgaccttgaacaaataaattaatctggttatcaattcaaatgcagcaaggtatgtgagtgcatcataaactgtaaataaagtactttgcaagttattgaaaaatattagtataccttccttctccatcctacgtcaataagaaaggaaacataatgaaatctttttttttctatactctttcaaggcattatttagagcataacccttcaaaaccatttggtgtagctgtaggggagacaaatgacattgagctggatttctttctgtactgattccaaagcttactatattagcagaattgttcaatgaatcttatatttgaacttactttgctaacacttgcctctgtattcaaaaagaaaggtacaaaagaatgattaattgagaatcacaattagatgtggtctagttaatgatatgtttgtggtacgctactttccatgttcttttttgttttgttttgtttttagttttatttttaacttttaagttcaggggtacaagtacaggtttgttacataggtgaacttgtgtcatggggttttgttgtacagattatttccttacccagatgttaatctgagtatccatttgtcgttttttctgatcctcttcctccttccaccctccaaactccaaaagaccccagtgtctgttattctccttgatgtgtctatgtgttgtcatcatttagctcccacttataagtgagagcatttggtatttggttttctgttcccgtgttagtttgctaaggataatggcctccagctccatccatgtccctgcaaaggatatgatctcattctttttttatggctggatagtagtccatggtgcatatatatacaccacattttatttatccagtctatcattgatggacatttacattgattccatgtctttgctgttgtgagtattgctgcgatgaacatatgcatacatgtgtctttacaatagaatgatttatatccctttgggtgtatacacagtaatgggattcctgggtcgaaaggtatttctgtctttagatctttgaggaatcgccatattgttttccatgatggctgaactaatttacactcccaccaacagtgtaaaataggtcctttttctccacaacctcgccagcatttgttattttttgacttcttaattttatccattctgattggtgtgagatggtatctcattgtggttttgatttgcgtttctctaataatcagtgatgttgaactttttctcatgattgttggccacatgtatgtcttcttttgaaaagtgcctgttcatatcctttgcccactttttaatggggttgtttgctttttcttgtaaatttgtttaagttccttagagatgctggaagttagaccttttttggatgcatagtttgcaaaaatgttctcccattctgtargttgtctgtttattctgttgatagtttcttttttagccatgtttatgtaacagttcttttaaattttttattttggatgccatagcagcaacatcagctcttcagacatgtatccaaataaaaatcttttaactgacagtcacttaatcagcagctgtaattatccagaaccaaggcaggaaccagaaacaaataaaagcattttaaatagatgaaaaatatataatcgaatctatcatacaacaacaatgtcataatagctcaagttttttgagcatttactatgagttggacagtgtttcgatgatctatgcacatttacatttaatcttcacagcaaccctatgaagtaggtactcttacatgatacaattagaatattagtcagaaagatctttttgcttttgttctatatggtcattattgatgtttggaaacattccaggtacttctgtctttgttttaccagttcctctctctgttatagctttgtccccactccttggccattttaaaagatttaaataaaatttctgtactctgtcaaacctcctattgattatgcaaaggcagaattaattgatcatgctgttatactcttaggacagttgcaaataccagtagcatttgtaacatagtatcagcatcaactgttttayctgttagattttttttttttttcaaaactgtgctcttccctgggctaaggaccacaccttccttaactttattcctctgcgattactatcaaacctggcatatagtagagcctaagaatatatttccatatacaccaatgaatgagtgaaagagagaaaaaagatagagataaggaaaagtgaaaagaagcaaaaagaaatttgaaaatttagatgcctctttccagatgtgccaaaatcttgtagaatttgaacatgttattttagagggcaactcttattttagttgaacaaaaagagagacaatttatattttaacaaggatattgtatttctaaagcaatgtaaggtatgacaaggatattaatgatctgtaagaatgtggagatggatctggaggcaaggaagaaccagggagaactttttgctttggttttggggttgaagaaaaattgatcttcccatgtacattagtggaaatgtggtaagggaagtacaaatacaggaggaactaaagtaggagcaaacaatttgaagggagtataatcagagaagaaaaaagagagctatacttttttccttgaacaatccaagaacaagatgataggacataagatagggaaacatacttacagaaaagagaagtgtaargcaggtcaatctactgctaagggatttcagcccagcaaatgcacacattaagaataatgccagaatgtagaaaagtggctttatctttcagtagcggtggactgttcgcacacactcaacagttaacaagctccgctctgaagttattctagaccttatctttggaaataatgcaggcatgataaataaggttggagtagaaaagcactaaagatgcaatcataatgtcatcaggtttgaattgccgatgaagatctgtgggaagagtactaacacaaaaatatggggcttgagaaaagcagaccttgaaggaatacaaaatgagttttgaacttggctggaattttgcaacgtgtagaaaatgaaacatgaaaaaggtagaatccaggggagggaacattcaaaattcaacccaataagatcaaagtaatacagaaacaatgagaggaagcggagaaataagagaatataggggaagccatcaaaaaataaaataaaggggaaaagtagtgggaaacgctatgactgaatgaaaccaaaacactaaaaaaatgtggtgattaataggaaattagtatctaagattttaaaaaatatatttttgaaaatttaaatatgcatcaaatagtaaagtaaatgacaatgtcgatttatttttctaaagattgtcacaagttacatggaatccctcctcttaggctgcaagtctttgtatactcaaggagtattgatccagatggcacatctagactcctgtggtgttgtggcctttttttttttttttaaaaaaaataagatcttgcctttcataggaaaaagcatttaatttatgaaaaggtatgctacaactgaaacttcatcactggggaaagcataagaccatagtttgtattgggttaagagataaaagatttaaagtgtacatttatttacagttccttaaactagccctggaaattagactacttatagggtgaaaactaattaacttgctgtctcatccatggaatagatttaaattcaggtccccaagcaaaaattttataaagtttacccccacctggcccctcgctatcctttgttgagtggaaaacacagagctctgtagaggaaagaagttatcgtattttctggcttcccagcaatgcaggaactactgatggtgtattttggtacatgcatatccttttaaagaaaaggttgagtatatgacagacatttaaacataaaatgttttctttgtttcttcatggttgggcttctgtgaagaaagaaaaagagagaaaagaaaaagcttagttttttatgtggcatattttctggtctgtgtaaaattttattgtctgaaattgtgaaaaatgtagcccaacatattccaaaatcacagaactgcttcttgcagacctaacttgcctagaaaaattcacaggtgcaaagactggtacatagtaaatgcctagtacatgcttgctgatagattcaggtatcacacatatgagtacagtggcatcaatgatatatctgtaatcaacttgtatagaaaccaatttttaaataaagctgtatttcccctttaaacattaagggattttattttctaagtgaaattctggcacatgacatagaggctagacctgtgttcatgtgtctgagattctgttattcctttatctgtaattcctagcatattaactcttggttatttattccttaatatctgtgccacgtggttactgatctattagaaaattcttttttttgagacggagtctcgttctgtcgcccaggctggagtgcagtggcgcgatctctgctcactgcaagctctgcctcccgggttcacgccattctcctgcctcagcctcctgaatagctgggactacaggcgcctgcaaccacgcctggctaattttttgtatttttagtagagacggggtttcaccatgttagccagcatggtctcgatctcctgacctcgcgatccacccacctcggcctcccaaagtgctgggattacaggcgtgagccaccgcgcctggccagaaaattcttaaaatggtgggaaattggaatccttgaatggatccctcagtatattgtaccaggtagatgcttgattatgcatatttattgaatgaataaatgaaaaaagagtaataaatcatgtgaagttggtagtttataaattctttctgcagtaatcccaagagggagggagggaggagaggtatcttattatcatcttttagtagatgaaaacntgaagctcagaagttaagtgaatagaccaaggccacacactgagtaagtggcagaattttctgaaggacttttgactctaaactccatgcttttattaatgcacaaccctgctctctatcctgcaattgatctgtatatcagataatatttataagctgtgtttaacttttggaggcacagatgtttctagaggccctgaatgagattgtatgttgcactttacttttctgttgagggcaagaaaaggaagacataatggcaaggtgtttctatagagaggcaaggtgtttgcagaaatttataggagttggtgaacatgaaatcaatataaaagagaaaaatgacagcaagcccggggccacctgcytatgattggcccacagtaactccttgttgaaaagaaaaggtagggtgcccagagctaaaagatctcttctcaggctgcttccactgttatttgtgtttagctactctgttgatgtccctgtagtgatgcacttagaaaattaaccagggttgtgatacaactgccacttgagttctgtacttttcttccagactctcttacctagggtgcccagagaacagctagggagtgacaagaaaagcagatctttctgttttccacctgatggaggagtaggagagatgttaaagctgaaggcagtctgaaaatgaaggaatagagtagggaggatggaggggtatgggagaatggaagtggtatcagaatatttagagggaagtcacagcacaggatgagataaattgaacccttctcatgaagagtggttggaaagaaagtggacatctaattaggaggaggaaaatccttggggttgtaatattatgttcaaatacttggaagattttcctgataaaggaagatttttctctgttaactcaaagtagtaggactaggaccaacttttagacattgtgggaagatggcttttgagctagttattataggaagaatttcgtcagtgtctgaatcacctggaaattgggtgcgccacatcaggaggtaggagacgttcgaggcacaggctgagtgagcctgatggagctacactaagacagactcagcaaacattagagatgccttctctttcagagttaatgtgattctatgcagaagagaaaattatttcatatgcagacacagacacacacacagagcatgtgtgtgtgtgtgtgtgtgtgtgtgtgtgtgtaatttaagagtagattacaatccagtatacacagggccccaaaatatagaaaacatgggaaaagaggagtgtattagtttcttgggctcgctgtaacagagtaccgcaaattagatggccttaagcaacagaaatgtgttcttaaggttctggaggccagaagcccgcagtcagggtgtcagcaggcttatgctccctctgaaacctgyaggcaagcccttcttgcttattctggcttctggtgtttgccagcaatgcttgacataccttggcttcactccagtctctgcctctgtcactagatggctgtcttccctctgtgtgtctctgtctgtgtctcttctcctcttcttataaggaaaccagtaatgtaatggcccaccttactcagtatgaccttatcttaactaatgacatcttcagtggccctctttccaaataaggtctcttcctgaggtattgaggggtgagattttgacatctcttttttgggggaaacaattcaaagcaaagagaaataggattcttgctttatggtcttattattttctgtcaagaagacctgaagaagttagagaaaaatattttgactcaaacccagcaaacttgaattcaggtacaaaagattgatttttccctctcagcaatgttgaatggttttgtggataggggaaatctagtagatattaaatatttttatctgcaaaaagcatttggtaaggttctcaatgggagattaatgactaaaataaagaatgaggcattaggagataaatttgcttatgagcaagagacagatactaacagtagaaggaaatactttttagattggaaaggagtgacatatagcacaagccaggaatcagttttgggacctatgggtttttcactttatttttattggactttgtaataaaaatacagatcttcaaacagtccaagacagagtgagtaatactacaagcatcagtaatcaaaagttattctctatcataaactaaatgactgataataaatactgacacaagactacacaatgtaccataatattataaaatggagcaggcaattctcttgtgttctcttttcctccgcatgggtgaatatttctttatttgctgtttaaaaaaaatatttgcaggcttctaggattactttataagccaaatgaatgaaaaaaatgatttttttttwaatttggaaagatatgttaacagggaaaaattggttgaagcaagacaaaggttacattgccatcactagaataaagaaatgaagggccctgcgtgttacattgctcagcaaggtgttcggtaaaaatacttgagttagggggcgttcttgaaatcatcagcttattctgcagtcatgactttaacggaatcgtatgcaaaaragtcattgttagaatgaggaaactacatatctaaagacagggaaatatagcatggaacttttttctctttttwwattttaacgtggctctaaaaaaatccataaaatccattgattgtatatgtaacgtttagtctgcccagcagctagtaaattatgtagagaacatacttttcaaattgaacttttgcctgtcaccccttttgtcaaaaatcactaaaaggtgtttacaaattcattgccttttccccattatttgtacattgtcagatataagccaagagaaacagagcaaataaacattcgaaagtgaactcagagaaattgtaaatgcttagaaaactataaagattataaagtgtaaagaagctccattaacctcaaacctctcattttaaaggtgagaaaaccaagatccagaaaggtcaaattcataagaaatttgcccgaggacaaataactaaagtcaaaacacagagtctagaacaaggttctcaacctgggctgcacattagagtttcctgrcaagcttctttaatgaactgttgcaatgatcttcctaccagagattgtgatttcaggggtcatgaacggagccaaggaaattcatactttgagaaacatgcattttaaaacttctccagttgcttctgctgtgtgggcaggaatgagaacctctgatctaggatctagctttcctaatgttaacacaggaagtctttcctttatttatttatttatttatttagagacggagtctagctgtgtcgcccaggctagagtgcaatggccggatcttggctcacrgcaacctccgccttccgggttcaagcarttctccygcctcagcctcccgagtagctgagattacaggcatccaccaccaygcccggctaattttctatttttagtagagatggggtttcttcatattggccaggctggtctcgaactcctgacctcaggtgatccgcctgcctcagcctcccaatgtgctggaattacaggtgtgagccaccacgcctggcctaacacaggaagtctttcaactcacatttgtagttcagagatggcttaaagagcttcagattctgaggtaggaagcacctttagcataggcagtccacagttaacaaaccaattgttctagtagttattttcattgcaatgtgcttatttggaccgctgaacttacatccccaaagaaacaagattgtacattgttgtttggtgtctaggccagccccgagattagcttacagaataactgaaatgtagcctgtgtcagttgcactataggtcctaaccaacgcatatacagtgtttttctaagagcaagaatttatattttaaatttaggtctctcaggacatttgtaattcttctactgttctgatagcactatcaagatttcacctcctttcatcttcaacatattagatttaggatttgaatagggagttccccaattccaaactgtgtcggggaatgggaggaaatgagggatggagggttggtgagggctggagggaagactgaggcactgtgggagcgaggaggaggccaatcaagaacagaagggccagggttctctgccatcagtacctggggatatttctttccctcgaatgggttcatccaaatatttgatgaaggcataatgtttatcagacactattctaggcattggaggaggattagaagagagaatggagagagtaaagtaagcatgacatagttcctggccttaaaaaagtgacattatctcttagtgtggtgaagaagtgaaaaatagggtttatgatttgtcattttgggaaagcaggtgatgtggggacacgttttccaagcacttcaggaacacagctgaccttctctggaggagtcatagaagaattcacaaagcaagtggcatttgtatagaagttgttaggtgcagatacagagaaaggcattttgggctgagagtcactggctctcatagagagatgtgaaagaacatgtcatggtgagaaagctggtctggttgggctggagagtaaatggaaagtggcagaagaggtggggatgaagctagtaaatagcttggagtttaaggccatgctaaggaattgaagtttcgtgtttgggggtacaggaaatttttagcctgaggaatgaatgattgactgagtaactcattcattcattcatttattcagtcgttaggatttattggaagtttgctgtatgtcagacactggatgacaaagattattatgacaccctcaatccagatgctttgtagaagcagagcagtgatcagattttcattttagggacataacctttgggcaatgtgtttaggctggagacaggaaggccattaggaagctgtgataacacttcagctgaccatcacgagctcctgaactgagatgcaatgcaggcaatgcagtgggtatggagcagagtagatgcctgtgggacatatcggggggcaaatttgattgtgcttggtgagtgattgcatgctgagcagggaagggaagggcagatccaactcctaatggtgccatttgtcaggatagggaatttaagaggaygaagtctttttcccagcccaggaaccagcgcctctgtttccatttataagacctgcacccgttcattctattattggtttattgcagaacatagcgcagtctaaccgcttttcctctacttttctgttcttgcaacaaggaaaaacatagtaacgtttttaaggaaatctgatgaaggctatgaaggtgaaagaaaggctattttttggtttagaaaacattagcaagataacacatgtaaatcaaaatgcagaactaatacatttgttttagtgattcaggaggaaaaggaaattcatgcttttacttgaattatcaggatgatgctttgctttaccagtgacccaagaatgagtgttatagtatgctttttgtaaaaaatttatcaccaactggggcattgaaagtaagtttcctatgttacgyggctgctaaattggccagggacaacggaggaggaactgaatagtcaatgaaattggaaagaatttagatcatccatgtcacacaaagccagcaaaggctgtttgtagaaygttagctgctatcacactggcttgatattaacattctagtgaataattaaaatattcctgtttattttttaataaaaagaaaaagcatatatgttacctcagagtctgtaatgatacctatagttgcatccatcagatgttgagtttttttttactaggattgtagagtagataacttagacaattaaaaagcaggttttgttctgcctttttctgcattcttgttttacagtattcagtattacaatgccattcaaaaatataaaataaaaatccttaaaagtgctctgagacattttcattattgtcagtattttctaaattgagtggttattaaatacatttttctgctggagttatttttgaagtacatctatcattttcattttctgtccataaacgcatacccaggcagagctgatactctatttcttcctgctaaaattcgggctcccattagaggatgggtcagtaggtgcagcaaaccaccacggcacacgtacacctatgtaacaaacctgcacattctgcacatgtttatcctatttttttgtttgtttgtttgtttttagaagaaataaaaaaaaccattcaggctcccatgaggtgatcaggtacttctttataattgaatatacttttcagctaaacccacccctttccactggctgttttctttggttgttccttcagggctagagtggaaaagttcagtgttttattcgagacaattgactcagagaaaagaacaactcacacagagaccagaaagagattcgtgctcagtaacaaagagagagtaatacagacttgtggagtcatggtcttaggtctgtgtgacgtgtttgatgctctgcaaggtggtcagtttctggggtgactagacaccaccaatttctggaggatctgcctgagtttatatcctttagatagtagtaacaggcttagtagagtagttggaataaaattacaactgaggaaggacaagaataaatggtatcagaggagaaattttcccaggagggcgaggtcatgagttaggagaacactaagaccgaatgctctgtctcctgcttccctgagtcagaagtggcaggcacactagacgaagcagcattttgctggagactttgttgagaattcaggtgctttgggagcttagagaggaaacaaaccccggtatggacttttcagacaaaatactgctttctttgcctaatcaagtaaagttaggataatgattaccaggcactttgtaacagcaaggttattctttttttttattattattatgctttaagttttagggtacatgtgcacaatgtgcaggttagttacatatgtatacatgtgccacgctggtgtgctgcacccattaactcgtcatttaacattaggtatatcttctaatgctatccctcccccctcccccttccccacaacagccctggtgtgtgatgttccccttcctatgtccatgtgttctcattgttcaattcccacctatgagtgagaacatgtgaacagcaaggttattcttaacgctaaagttaaggttattctaaactctaaattgtttgctagagaaattacaaacatagaaagaaataccacataggagccaacgtatataacctttagttaaatgtggctcttatgtgtgaccaggaactagcaagaactgtggcagagaaattaagaataccctcgctcctcacagctgccctacaggatttttcctttttctctcctttctttttttaaatttaaatttttatttattaaaattgtatatatttgtaacatacaatgtgacattttgatagacattgtgaaataattttatagtcacgtactcatctcctcatgtggttaccatttttttgtgtatgtgtggtaagaaccacacaaatcctctcagcaaattctaagtgtataatacaacattactaattagagtcccatgctgtacatcctcytctcttatttccttagctagttgccacctaggactctttacctctcctgaacctccactttgtcttagacagggcagtagtgctgttctcttctcttcccctaaaaatgttgatctcttagacccagtgccagtttcttggctatgtcctccttcctcatgtcatgtcatttttaaaatctcctcccctgccccagctttgtgctgaaataccctggagagttgattttggattcattctgaaatataaatgacctaactgtagtctttgaaatatttgagacccactccttatgctcctaaccccttatcaccacaaactgggtgccttacacaacagaaatttatctgagagttctgagggttagaagtctgagataaggtgtgagcagggttagttccttctgagggctatgagaaagaatctgttttgtggctctccccttacttgcaggggattgttgcctatctttggtgtttcttggcttgtagaagcctcaccctggtctctgcctttgtgatgatatggtgttcttcatgttgtatgtctgtctcttcacctggtgttctttttataaggacactaatcatattgcagtaggagcctaccgtactccattgcgacctcatattgactaattatatctgcaagcacccaggttccaaataaggtcacattcttacatgctaggggttaggacttccacctatgaattttggggggctccagttcaatccacaacaaatgagttcaaaatgaggaaagcaaaactggagttcagagagaatctttttggctcattttgcttgtgtgcctaagggctgagtgttcgttttaggtaagagagaaactgtgaggggttagggtttgggttagagaagcctactactgtaggctagatgccaactaaaaacaactgctgggggcagtggagagggaagtagactgcagggttgatgtaagaaaaacaggtgagtttgcanttgttgggggagcgccaggaaacaagagtgtcaatttctggctcatgagtgagaagtattcctccttagttgtgcctgagaagctcccagcttccataactcctcactgccccttccccgcaaaaccctctttgtatcaccatcttgagattccttatccaaatttaaactccattagtaatttaaagctctgaggaagttcatcccaacctggaagaggagagaggtgttctgggttgtagagctagccactcagaggcatccgggccttcctctgtttcctaaaacatcattgtgcagaatgcttagaaggggttggtagggctattcattaagtgcagtaagagtaaaacatgcttttctgggctggctgggacttactaccacatgaaatctggaaaagtacattctgatttccagccggctgtgaatttacaaacttttggaatgcaatctatttctaggttggagaatggcattactaaactgctcaatttaataattagaggtagaaaatataattggtttatctttgtagtcaaatagcaatttcatatatgcagataatttgaatctgaatgtacagccaagtattcaaaatataaatagatgcagagaaaaaatcaaaagcacatataattcccccagaccctacataaagcaaaaggaaccactgcagaaaagaaaagaaaaacccaactcctccttaacaatttgttctcccaccaatctttgatttataaatctagaagcctcatgttttctggaatccttaataaaaaatgactttttaaatgtcacaattcttaatttttcttagtacattgaaaaaaattaaagctagtaaggaaaagaggcatcccagtactttctgacagaggaagaaagaaaaggactaaccacctttctaaatgtttaatagtagtcatattaacttattaaattgtatgctctcaagaaacaagtgggtgtttatgcatgtatcctttgtacgatgacaacaatgacaacaaatgacttagtggggctttggttctttgttacattcttttttcaaaaaccaaggtggattatgtttattaaatgtttttaaaaatttaaaaaaatcctactaaaaactaggagataccttgggagtttccaaaatcaaggttaggaaccattgatttataaagatcgtctgcatatgtgtgtttcctagttcaaggagttagaaaacttttgataatttaatgggatttatgaacctattttaagagttagagtctgtgaataactagataaagaagaaacagagcaactgaggatttggttttatgccctgtagagttcaaattaaattttactaaaaggcagtttaaaagtttaaaagattaacttctctttcatttcacgcagtctacttcagaactagtcaccataatgaactcaacagacgtgccctggaatgatttggaatactagaagagttaccgtcagagttgaaaaggggccaagcacagtggctcatgcctgcaatcccagtgctttggggaggctgaggtgggaggatcgcttgaggccaggagtttgagaccagcctgggcaatgtaggaagaccctgtctctacaaaaaatatttaaaaattagcagggcacggtaaggcgcacctacagtcctagctacttaggagactgagatgggaggattacttgagtccaggacaggagttcgaggctgcagtgagctatgattgcaccactggtctctagcctgggtaacagagagaaaaaaaattaaaaagcttattctgaagaccagctcgcttcaaccgagtgaatgaagaaagcttttatgtttggaactattttctgctaaaactgatttctgagttgtgttctgttagacaatatctcaatcaaaacttctttgacaaaaacatctcatggtcatgcaagtttggggaatgctgcatgaatatacccctgcaagccattcacagtgcacaggcatttagaaaagaccctgcaagtttacaaaaagaaaaaacttctatatttttggataaattcatcataccaaacttattttaagtatggctaagttcttctcgtgtatcatttttaatattgaaccaaagaatagagcaagtgaatagttattaggttaagtcctgtagacatagaagattatgctctgtgggaatataaatttttaagcagacaagattactatgaacacataactgtaagagcataagcatgcaggtataagtggtcaattttagaaaaccttccttacaatctctttaaacatcaccccctccccattcctgtggccattgtctgaaattctgctgttcggtccttacactttcatttaagcctattaaaagttaagtctatttaaaggatgtaacacgttcagcaaatgtgtggccttacttgtggaaaaccagctaatagatgatgagaactagatgtggactttgtgaaaatattcaataaaaacaaaatccattgagctgagactgtaggtgacaatcccttccttaccctctcccctcttgctcccaatgaaaagaagtcaggacatttgtccaacccaaatcagaaacccaaaaccagaaaccaagaaaagaggaagtttttctttaggctgaaaattgcgttgccagtgagatttttttgtattaatgctctgactaaagaaatagctggaaaaaaatagcagaaaaatgtaatacaaatttatgcagttaaatgactgtctgggacgaaaatcaagaaaacaaagcccaaacgttacctattagttagtgagcggccctcatttatagtgtgctgaaactcaactaccctctctccacacttggcccctccagccctgccatctggagacagaaacctcattcatttccacacgtcgtacccgacatgaattcctaacctgtcaccgctcctgatcccacctcctagctatmcctctcttctccagcattttggacatgtctstcagcatatgtgtctgcctatctctcagaatggagtatgagtgtccactcagagacagagacttatttatcagtgctgagcacatagcctagaacatggtagtcattcacagatatttctgatgggacacaatagttaaggaaagttcctaagagctaggaaatgtaagcctgtattgctatcaagaaattctggaaattccttctttggttactttaggcttgaaaatatgtcttctccgtgtgtacttccacagccttctcagccagatggcctcagtgggagcctgaagtgtcatktaactgctttagtttttaaatatttgtcacgttatgtatcaagctcttagaacagtacctcgccgatagtaagtgctagataagtgtattagagaaaatctttaaataaaaacccatttgtttatacaaataggcaattgcagccatagagtcattgtaaaacttagttatgttcattatagacattttttactctttttggggtttttttgtttttttttttttgttttttttttttgagacaaggtctcaccctgttgcgcaggctgaagcgcagtggcgcgatcttggctcactgcaacctccgcctccggggttcaagtgattcttgtgcctcagcctcctgagtagctgggattaaaagcatgcatcaccatgcccggctagcttttgtatttttagttgaaatggtgtttcaccatgttggccaggctggtcttgaactcctggctcctagcagtccacctgcctcagcctcccaaagtgttgggattgcaggcgtgagccactgtgccccgccaatagacattattcttcattaaagctggtctaatacagaattcatttagattttgtaagtatttattaagtttctagtatccacttagtagaaagtggatagtagattgtgctagctgtatggtcaatataatgatggttagtgaggcaggcatggctctcaaagagtatgtagttcattaggatgggggttgtctccccatgaagggcaggcacatagaaaaatttctcgttgattcaggcccagtgtcttcttcagttagctttttaagacttgtaccttagtctcttccttcattttctactattgctgaagctccttatattttctgtatattgataatgcagttttttgttttgtgttttgttttgttttgttttgttttgtgacagagtctcattctgtcacccaggctggagtgcagtggcatagtcttggctcactgcaacctcagcctgctgtgttcaagcgattctcatgcctcagcctccctagtagctgagattacaggtgtgtgccactgtgtgcccggctaatttttgtatttttagtagagacagagttttgccctgttggcctggctggtcttgaactcgtggcctcaggtgatctgcctgccttggcctcccaaagtgctgggattacaggagtgagccactgcaacaggccagataacacagtttctttttctctgtttcttcagcaacgtgcagacacattggtgtacagatgcttcattcgctaatgcctcagatggttgtttctcaaacaggaatcctactactccgtggcttctcacttttagcttttcctaatatttcctaatagctttctcaaatctctcctgccttggtcctttccttccacattttattcagttggactctgactcctgtctgatttgccagtgtagatggggtggggaattacctgcataggcatagctggtggtgtcttaggggtgtcagctgcacagagcagagtgtgtgagggaaggataactcgtgtccctggttgcagagtctgagtgatccccscagtaaactaatgtaggatatatttggatgtccaggtcagcagagtgaaagtaaacagtccagggtctgtgctaggattgagtgtggccacagatagcacggaacatgataacggtggcttaaattgttttttcttgtgtaagaaggaactctgaggtgtagccagtcaccgctgttggctcatcattagtgtcaggattggggccgctcttggcatttctctcgtggttacaagatggctgccacagctccagtcatgtttatattcagaataggaagaaaagcaatgaaggtgccatttcgtattgaaggaaatagtttaacagggctaggtaggattttgactgggaaagaaaggacgtagagaactacaaacttgataaggtagaaactgcaaaacaatagctggtctgatgtagaggcagaagtgcatagcagttaaaagcctggactttgagttagaaaaacatggattcatgacacttacaagctgttgtcttaatgtgttccttagtctctataaagtcttcttttcttaattggtaacaggagtatctgctttttaaggtattgtgaagatcaaattagggaagttttaaggtgaagccaagcacttagtaattttcagaaagggagacttattctgttcctcctccttctcttactgttgtatggttgtcaatcagaatgaactagaatctaagatgcttttgggtgagtagcagaagagaacaatggaatattggattaaattcagcccctggagagtggaaatcctagggttttattcttttagcaggttttgtgatgaaaatgtcaccatcaaaccagtcttaactgttcatcctatatacaatactttttagatctttatactttaaatttttcatcatctttagtttccatgtattaaatacaaaaaattgggccaagtcaacccagaaaacctcttctcaagagtaaatttatgatatttgtgacaaacaaccaaataaacagatctccagcatatgttgacactgttcactgtctctaacccagtttcccaaatgcctttttactttgtaggttatcattgtgaatctcattttccattttggtaataaatttaacagctgaatttttttctcactaaggttttatatttttaagttatccatgtattcattttggattttgacatttaataaccttcctgaaatacatgggagaaattatatctacaatgtagaagactctaacatgtactctaaggggaggaaataaatgccacactcaaagcaattatacaggaagtattaaagatattaaatatgtatcaaaaatttaaaatgcaggtttaaaagaaagtaggtaaaaaccctaactttggcagtatacatgttaagaaactatttatattgttttctgctgagcagaaatctaaaaacaaatggcctttaaatcagacctattagttttgtaataggaagttctgtgagagacagataaaacctctgtattaagtgtgcagtataacctattcatctgaaatatacatgattactgtatggttgtgtgttatttccatttaagagttttagtaaaggaagccaagcccttctgctgtgagggaaatatagcatgtgagcatatatattcgtgggcaaggcagtgccttgaaaacaagtgtgtggcatccagggagatcctagatgagttctagttcatatgcagagtggatccaggttgcgtgcatgcttagtattaatgcatgacttctgcagagtctaggtcaggaccattcttcctgcccccttcacaaccttctccttgctttctccttgcctcatgtgtcttcaggaatttgtgaatgattctgatatcccagtgatataaaacatgatctggcaaaatttgatggtgaccttttctgcttgtacctttacncatagatgaggttttccgagttctgctgctttcccctttgccagcatatactgcttttgttgaggaatcaaggtctccggtggtcgccaagtgaaaaggaataaagataaaaatgaaggcgtgactagttgaaaaatagagacagaattttaatgtgaaaattgtttatgaacagaaggagagaggctgcattgtctctataagtggttagtaagtggagactgcagtcacctagatggccaaccccagggttccatatagtaaatgctttccattcagggctgtttgaaagttcacctgtctatggatctgctaatgggaagcacatacgtctccaggtacagtgaaataatcacttggagataagactccccacagaaaaattaacacaacttcttttatgaaagacaggtcactgtaaaaagaaactctacccacttatcatcaattgttgaaaaaaaagatttatgatgacattgaggtatgataatctcaaatacgttctgcattgtttttaaaagctttgtgtttaaaattcatagcactttctaatcctgataaagtagcctaattttctagcttgctttgttcagtaaaatgtatttctaaatccattttaagcagctatttcttcaatttgagtaattttctctcaagttaatagattccacacaagcatacctgacttttaatgttaatatatactatatattccaaacttgctagtgacagtagaaagcacaatcaaaaggaaattcagttgtttaaagcatatctggcttattttgttaaaatgtttcttcattttactcatctttgccaaagcatagtgataccaaatcatattttacaggttgaatatcccttatcttaaatgcttggaaccagaagtgttttggattttggattttttcagatttcggaatatttgcatatgcttaccctaacctggttgagcatcccaaatccaaaaatctgaaatgtgaaatgctccagtgatcatttcttttgagtattgtatcaacggagtttcgattttggagcatttcagacgttcagatttgggatgctctacttgtaccttgcttgtattgaggttccatttcccccttccctctcagcaaaagtaaaagaaaagagaatgtgttagatacgattttgtcattttaacatgagatgactttaaaactaatcaatgaaaggcatttgcctaacatagcaaatcccttcatcaataaggtcagctataggaactggccaagaaggaaaaatattttgattttgaggcatttggcatgggtaattgtatttacggatagatgttttcattttatactgagtctaaaataccttaatattttgttcaaactattatacctatataataataatgcctgtggatatttctggcattttcttttgtttacagggtactggcctaattgccatgagtctcattttttttcttctcagcaatgccactggctctctaaaaaacagaggataatgtgatagagacagataaagaatttttctaaattaggcaatcaaaccaagaaaaaacacataaaacatgcataactaagtcagtgtttcctcaaaaggggcagagtttggtaaagaaaagccttgtcttgtacactgctgtgtatgcactttatagaaaagtactagcatagagtgggtgctcagtaagtgttagttaaatggatgttgaagggttgggaaagagaggagttgagttgagcacagagatgtgatacaagtcctacacagtcatgagtttataagtgtagttttagagttactcctgtgtatttgaaaactgaaagcaaagccagttccagaacaggattaaggggccagccagctgggcagtttcccagtgtgctaatctctaagagacattgaaaccactgaaaatactcatgacagaggaaactgtatttcctagaatttctctactgtctgtcattgggattagacataaggcattccagggctgtgctcccctgtcccttaaagagatattctgtttttttctaaggagggcaggttgagttacttacagatcttttgcattgctgagtgaaatattcaaatttgggagcagagccgagttgtttagacaagagagaatagtcaagtgctgtcacaggggatcttcttattctattctacctctaggcagaattaagccttttttctcaataaattttaaaccaacattttaaagatattggtgtaaaatggtgtcaaattgttaacctacagagtgattacatgttttggtgtctcattgaagctctgtaaaaatgctgttgaacagatatatttaatttaaaaatttttaataaccacattaattaaatgaagagaaacaggtgaaacagtaattatattttatttaataaatctgcaatatatcattttaatgtgtagtgaatataaaaattattgagatttattacattgtatttttttgtattagttcctcaaatccccgtacttcagtttaaactagccacatttcaagtgctcagtagctacatatggtgtgtaactatcatattggactatgacgtgcagccctagacaaatcagtagagtcagtgactcccagttggcatcattgagctggtcctaaaaggtcctttaaccagaattctctctttggccagtgtgaaatttccagtgttgataccagtctttaaaaatcattttaaagaaccataattatgaatgtgttgaagtatttttcttcagtagtaatgcttagtttaatgtgtgactgcacatgctgttcatttgtgatatggttatgctttgtatccccacccaaatgtcatcttgaattgtaatccccataatccccacatgttaaaggtgagaccaggtggaggtaattgaatcatgagggcagtttcccccatgttgttcttaccataatgagtgagttcttaggagatctgatggttttataaggagttctcctacctttgctcggcacttcttgctgctgccttgtgaagaaggtgcctcactaccccttcaccttctgccatgattgtaagtttcctgaggcctccccagccatgctgaactgtgagtcagttaaacttctttcctttataaattacctagtctcaggcagttcttcatagcattatgaacatggattaatacagtaaattggtaccgaggtagtgggacactgctataaggatacccgaaaatgcggaagcaactttggaactggttaacaggaagaggttggaacagtttggagggctcagaagaagacaggaagatgtgggaaaatttggaacttcctagagacttgttgaatggttttgaccagaatgctgatagtgatttggacaatgaagtccaggctgaagtggtctcaggtggagatcaggaacttgtagaggactggagcaaaggtcactcttgctgtgctttagcaaagagactggtggcactttgcccctgccctaaagatctgcggaactttgaacttgagagaggtgatttagggtatttggcagaataaatttctaagcagaaaagtgttcaagaggtgactgggtgttcttaaaagcattcagatgtatgccttcacaaggagatcatttggaattggaacttagtttaaaagggaagcagagcataaaagtttagaaaatttgcagcctgatgatgtgatagaaaaaaacccactttctgaggagaaattcaagccagatgcagaaatttgcataagtaacgaggagccaaatgttaatcaccaagacagtgggggaaatgtctccagggcatgtcagagatcttcatggcagtctctcccatcacaggccagaggtctagaaggaaaacatggttttgtgggccaggcctagggccttgctactttgtatagtctcaggacttggtgccctgcatcccggccgtggctaaaagaagccaatgtacagctcaggccattgcttcagagagtgtaagctccaagccttggtggcttccacatggtgttggtcctgcaggtgcacagaagtcaagaattgaggtttggaaaccaccacctaggtttcagaggatgtatggaatcgcctggatgtcctggcagaagtktactgcagaggggagccctcgtggagaacctctgctagggcagtgtggaagggaaatgtggggttggagtctccacacagagtccccactggggcactgcctagtggagctgtgagaagagggcaaccgtcctccagaccccagaatggtagatccaccaacagcttgcaccgtgggcttggaaaagccacagacactcaatgctagcccgtgaaagcagccaggaggggtactgtaccctgcaaagccacaggggtggagctgcccaagaccattggaacccacctctgcatcagcgtgaccttgatatgagacatggagtcaaaggagatctttttgtagctttaagatttgactgccctcctggatttcagacttgcatggggcctgtagccacttcattttggccaatttctcccatttagaacaattgtatttacaatgcctgtaccccagttgtttctaggaagtaactaacttgcttttggttttactggcttataggtggatgggacttgccttgtctcagatgagactttggacttggacttttgggttaaaactggaatgaattaaaacttcgggggactgtcgagaaggcatgattggttttgaaatgtgagagggacatgagacttgggaagggccaggggcagaatgatagggttaggctttgtatccccacccaaatctcatcttgaattgtaatccccataattcccacatgtcaaggaagagaccaggtggaggtaattgaataatgggggtggtttcacctatgctgttcttgtgacaggaagttctcacgagatctgatggttttataagtggctcgttaccccttcacttggcacatctccttcttgtccctttgtgaagaaggtgcctagcttccttttcatcttctgtcatgattgcaagtttccagaggcctccccagccatgctgaactgtgagtcaattaacaccctttcctttataaattacccagtcttgggcagttctttatagaggtatgaaaacggactaatacaatttggtcaaccttatctatggagtgaagtatcatcaatagataactatctatttaaaccaatgacgggttacatcttgttgattagagaggaggcctggattatggatgtcatatttggcagctaatgggaaaccatgtccagagaagatgaggaacaactttaaaatataaattcagggaaaagagtaaaggtacaaattgattatatgtgtttgccatttgtcagctaatgatacttttccttgtagttacttttactaggcaattttttttcctcctttctccctcatgaactcacttgctgtgttcctttttttaaattgagatataatttatgtacaataaagtttaccctttaaactgaagttatggtgaaccctcttcaggcggttttagtattctcacaaagttgtgcagccatctctttgctccctttctcacatgggtagctaattatccttggatcatgtaagcatgwctttgtggaatcatagtctgcagatttagtattagtatcaaattgatatctctaaaggggctttctgcttccatatttactctggccagtgcttcaaccataacactggatctttattatattgctccaaatcagagcctttgttttaattacaaatcttctagggctcccttcacataactctccttccttgacagacatactcagaaaaggggaggggaaggggagaagtgcagcattattttggagaacccatatttgaattgttctctatgtagatatttaaaaacaccctcaggagaactaatacaatattaaaaattagagaagtggtcttgtaaacacttgaattaaataaccctttcttttttccaaatgcgttaaaacccaaaaccttacagttgtttgaaagattaaacaagttgggtgtggtggctcatgcctgtaattctagcactttgagaggccgaggtgggcagattacttgagctcaggagttcgagaccagcccagacaacatggtaaaaccccatctctacaaaaaaattagctggtgtggtgctgtgcacctgtactcccagctacgtggagggctgaggcaagaggatctcttgaacccaggaggtcaaggctgcagtgagccatgattgcaccactgcactccagcctgggcgacagagtgagaccctgtctcaaaaaaaaaaaaaaaaaaaaaaaaaaaagaaagaaagattaacttaaacccactctaaaaatagaagttatgtactttgattagtaacttatttctggcattactacagttcattttgaacaccttaagttttaaaaggaaagggaacatctgacttactggacatactcaaggacttttgtttcaatcaggtgcttgtttcgatcaggtgcgtctaccagtattttgaagggtttgcataattatgcagaatcttctcctagtcagtaaccaaggattatacagtcagagtccccactttgtattccacttaaatcatactgttttgcattattttaaatggttgcaactttatttttattgaggggaaggcatccggaagaaatgtggttatcataagatcatctttcctttggggcattggagatattttccaaccctaaaattgtgatttctttctgactgccattatgcttaaacaagcatcattgcttagttatcgtgttctattgcattgctaacgtgatggactggaccgacagagaattactctgtagctcactattcagattggaagaaagcactggaaagagcaggtgtttgaatttttcatttttcttcttatgcttttctttctctctttctctttaccccctttctcacatgggtagctaattatccttggatcatgtaagcatgtctttgtggaatcacagtctccagatttagtattagtatcacattgatacctccagaggggctttctgcttccatatgtactctggccagtgcttcaaccgtaacactgcatctttattatattgccctaagtgatttccaaacctatgttgaacaaaagaatacaatattgaagacttttaatttgagggcttatatctttgcataccctgcttaatttttttccaagtgtcccattgcagattgcaagtataagttagtgtcggaattaccatacgaaactctctttctaactttaatcggtaatttctcagcaatagaaaacatgatgctaatgaataatgtacccaaaagctcttattatagggttggtatgaattccacttaatgacaagctttctcaagcagcagttgatttgaaatcctacttttcattagtgaagtataaaatgttaataataccttccactgtgctgttcttttgtagcatagcagcatatatcttccctgttcaccatggactctttttaagatcttactagtaacttcctataacataaataagatttgttcaagaaataaaaatgtgtgttttcccattgttagctatatgtttttctaataatcacatccgaagcttattatacagtagtagccttaagatattatttttttaaatatactactttggtcttaatactagtttttaatctcttcttgtttctatgaagtctgaatgagattttcaaaattgaataataatttgatccgttaatcttttgaagctagtaattttattttcctctctttgcagtctctgaggttcgcaaatgaatagagcttcattattgcagtctgcatttaataacnattatccattatcttgtaattaagactccctgtaacgaatcatgaggacaatgcaaaaatacatagtacatttctttaatgaactggaaaatgttcatcttgttctatttagtaatgagttgctgaatagtcattaaatccactggagaatagagctagatggattttgaagactgtcttgagtttgtggttaatctattagaattaaaatttcatcttctatttttatcaacagctgattagaagtcattctgtttgaccaaattgattagaagaccatatacaagggcagctgttgtttaatgaaagtttttaatgaaactgtaccatggagacttgtaattatagtccttagaaaagctttgagttgccttagaccacaaaaatagtattgtgctaaagatttcaaattaggaaaataaaaaatacaatttaatataatactataaatttattattaattttaatttcaactaatcacagttgaatattagtctacttagtgtgttccttttgactttttcagccctttcatctcttagtttagtcatttagttgaaattgtgggcactgatgaaagaacatttatagggatagctattgtaatttgagatattttctcataagatttttgtccccaagctgagcagaggtaagcttggctaatgttagatttatgtgagctctgaagagagtctgtagtgctgtgtggtgttggtaattsaaaatgtagcatttatttctctaaagtaatttcgttttagcagaagggcaaaggaagcaatgttaaaatgagaagtaaaacaaaagtgtgtcctacttagtcccattggaaaatccatttttcttttgacagcagtaaagtaatgatgtactttctaaaatattttgtgtaattaaagctaggtcttattcctcacttaaaaaatagccagtgtctgcatgcctgaactatttttaatatcttgtggtctctgactctcaattgtcctttctcaacacatccaatacagacactaaatttagcatcttaaaacactgatttcatgtgatcagacctcacattacctaaagaacagagcccaatgtctgtggnttcaaagctctctataatattttcctaagggatatttacagtcacatcttctaaaacatacattcatatatctgtgtatatgtccctcctcccacctcacctccaacacagacttcttagatgtattctttcattatttggtatgccatatactttctttgcttttggtgtttctttttatggtggtgttcttccatgtgtgccctctcatctttaaattttgtctctccttgaaggtctgtaacacattccatctgttccatgaagccttcccgtattattctagctaaagttatttctctgatcctttgtaattcttattgatcataatacttactgggcatatgatatagtttggatttttgtcccttccaactcacatgttgaaatgtgattcccagtgttagagatggggcctggtgggaggggattggatcatggaggtagatccttcatgaatggctttagcaccatcccttttggtgatgagtgatttcttgctctgagctcacatgagatctggttttttaaaagagcatggcacctccccgcatctcactcccactctcgccatctgacatgcctgctctctttgctttctgctgtgattgtaagcctcccaggagcctctctaggagcagatccaagcaccacacttactgtacagtctgcagaattgtgagccaattaaacctcttttctttataaattacccaatgtattagtccacaggctgtgcaggaagcatggctggggaggccttaggaaacttttagtcatggtggaagaggaagcaggcatgtcttaaatggctggagcaggaagaagagagaggaggggaggtgctacacacttttaaaccaccagatctcatattaactcactattgcgagaacagcacgaaaggggaaatctacccccatgatccaatctcttcctaccagagacacctgaacattggggtgggggttacaatttgacatgagatttgggcagagacacagacctaaaccatatcactcagcctcagatattcctttgtagcaatgcaagaatggactaacacagaaaactgataccaggagtggtgtgttgctataaagatagctgaaaatgtgggagcagctttggaactgggtaatggagaggttggaagagtttggagggcccagaaaaagacaggaagatgagagaaagtttgaaacttatgagagactggttaaatggttgtgagaaaatgctgacagaaatatagacaatgaagtcaaggctgaggaggtctcagatggaaatgaggaagttattgagaactggagtgaaggtcacccctgttatgtcctagtaaagaacttggctgcattatgttcatgccctagggatctgaggaaatttgaatttaagggtgatgaactagggtatctggaggaagaaatttctaagcagcaaagcattcatgatgtggcccggctacttctaacagcctacagtcacatgctggagcaaaggaattacttaatgtgagaacttatatttaaatgggaagcagagtataaaagttgggaaaatttgcagcctttccctgtggtagagaaggaattcaagcaggctgtggagcaactgcttgctagagagattagcttgtctaaaagggagccaagtgctcatatataagactgtggggaaaagacttgaaggcatttcagaggtcttcgaagcagcccctgccatcaaaggcccagaggcctaggaggaaagaatggttttaggggacaggcccagagccctactgccttgcacagcctcagtatgctgccaccagaatcctagaagcctcagctgaaaggacaactgatacagctcaggctgctgctgtggagngtacaagttgtaagccttgctggtttctatgtgatgttaagccttgaggttcatggaatgcaagagtgaagggggtctggcagcttccatgtagatttcagaggatgtgtcagaaagactgggtacccaggcagggattctctactaaggcagtgctgaagggaaatgtagggtggagcccacacagagtctccactgcagcgctgtcttagtggaattgtgggaatggggctgccactctccagaccccagaatggtagagccaccagcagtttgcaactaccacatggaaaagccacagggcagagctttccaaggacttaggagcccacctctttcaccagtgtgccctggatgcaggacatggagtcaaaggagattattttggagctttaagacttaatgactgccctgctgagtttggggcttgtatgaggcctatagygcacccctcccccttttttggctgatttctccctttgggaatggtaatgtttacccagcacctttgccacaattgtatcttggaagtataacttgtttttgatctcaggctgacaggtggaaggaactcatctccagataagactttggactttagactttggcatttttgagctaaggctggaacaagttaagactttgcagaactgttgacagggtattactgtgttttgcaatgtgaaaaggacatgagatttgagagaccagacgcagaatgatatagtttggatgtttgtcccctcccaatctcatgttaaaatgtaatccccaatgatggaggcagggcctggtggaaggtgtttggatcatggtagtagatccctcatgaatgtcttagcaccatccccttggtgatgaatgagttctcacaagatctggttgtttaaaaagaatgtggcaccttccctctctctctcttgctcctgctcttgccatgtgacatgtgtgctccctctttgccttctgccatgatcgtaggcttcccaaggcccttaccaggagccaatcctgatacaacacttcttgtacagcctgaagaactgtgagctaattaaacttcttttctttataaattacccagcctcaggtattcctttatagcaatgcaataatggactaacacagcatatgttcagaaacaccwtaactaccagatacattcttatttccccccacacctaatctctagacaataaaggcttggcttgatatttaaggacttccagtttcagctttaacatataaagagcttggaagttgtcactcctgtccttagagcaagaaaaagcagaattaactgaaaatgagtgacttttctcagacccatcaaagacctgaggtcgcaaggtaaactgtcagcttgaaatccagagagacagataaatcctgagcgtctcagctgaaatttgcttacctggagcagaagctactagaaccaaaacctagtaggaacacttaaatggtaattttgacaaattactggaggctgagtgtggcccccactcttttttgggttttacctccaagaaccccaccaggttctcacagtgaagagccaaagaaggtcccttcttggctctggcaggagaaggagaagataatcattgtgcaatatgcccagcatattccctatagtaaagcctactctaggacaaaatactaagtcttttcccgcttgagagaagggcatttcctctctagtctttctgtctcatcaaaatgggcggagaaaagctaagaaacatttgtgacagttacagcccagggacacaggaccactgaaagactgagatttaatactaaggctatagaatactcctccctcatctgttaccaccacagcaacatggtttcagtataagattacagctgacagagctaaaatacataggctctctgaagaggaattttagggaagcccagaataaagaggggagataaaaacaagaatactatagaaatttgaagactatggcagctacagcaaaccttaaacacagcccaactccttgcccgattaacataaaaccttacaccaaaggcccatttgtttttgttcatgttacccaatatatcatgcatagctttcaacaaaaaatacattggatgctagaggcaagaaaaaaaactcaaagtcttttttttttttttttttttttgagacggagtctcgctctgtcacccaggctggagtgcagtggcgsgatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctcaaacagtctttatagagaaaacaagtatcagaatcagattcagatatggcatagatttgggaattatctgacagagaatttaaaataactatgactagtatgttaatagctttaatgaaaaaacagacaacatgaaaaaagatgcataatagaatcagagagatggaaactaagtaagaattgaaaggaaatgctagaaatcagaaacactgggacaaaatgaagaatgcttttgatgggtacatcagtaagctggaaactgctgaggaaaaaaatcagtgaccttaaagataggtcaatagaaacttcttaaactgaaatgtgaagagaaaaaactgggaagaaaaacccccacagaacagaacatccaaaaactttgggacagtttcaaaaggcataacatatggtgtataattggaatactagaagacgaaagaaaatagagcagacaacatatttgaagtaatggccaggaactttccaaaattgatgtgagacaccaaaccacagatccaggaagctcagagaacaccaagtaggacaagtatttaaaaactgtgcacctagacatattatagtcaaattgaagaaaaccaaagacaaatagaaaatcttgcaaaaagccagagaaagaaaacacttttcattgagaagaaaaaattactacaatggacttctcattggaaaacatgtcagcgtggagtgaaatacttagaagggtttaaagaaaaaagcaaaaacaaaaacccaacaacatggaattctgtgttcaatgaagctatttttctaaattgaaggagctcagacaaacaaaaactgaagtaattaattgccagcaaagcttcccaaggcttcagagagcctgtgtattttagctctgtcagctgtaatccactcttattacgctgtaatccactcttattacactgaaatgttaaaacaagtttctcagggagaagaaaacttatatagatcagaagctttgatctgcatttaaaaaggaagcgcattagagaaggagtaaatgaaaaataaaaataaatttttaactgatttaaaagataacaatttaaagtaataatataacaatttattgaattgttatattaccagataggtaagctgaaatgaatgacagcagtgttataagacacaggagaaaagaattgggaatactttgttaaaatgtacctgcagtacctatgtagtggtatagtgttatttgaaggtggacttagttaaaaatgtatattgaaaactctagggcagtcactaaaatatgtacaaaagtatgattgatatgagaagagataaaatggaataatataaaatgctcaattaagccaggaaaggcagaaaaataggtgtcaaaattaaccaaaaaaatgcaacaaatggaaaagtaataaacatggtatatattaatttgactacatcagtaattagtttaaatgttagtagtctaaatatgccaattagaagatagagatgataaaaaatcaagatcctactatatgttgtctgtaagaaagccactttaaatgtgaagactcagaaggttaaaaataaacaaataggaaagatgcaccatgctaacactcatcaaagtaaagtgggagtagctatatgaatttcacacaaagcggacttcagaaaaaggaacactatcagcgataaaaaaggatattttataatgatgagggggtcatttctcaaggaagacataacaatcctatgtatgtatgcacctagccacagagcatcaaaatatgaggcaaaaattttatagaactgaaaaaaagaaataaacaaatctactattgtagctggaaacttcaaagctcctcttttagtcactgatggctgaagcaggcagaataacagcaaggatatagttgacctgaacagcactgtcattcaatatgatcaaattaacatttatagaaaacttcatccaacaacagcagaatacatattcaatgttcacatggaacattaaccaagatagaccacattctggtccataaaacacaccttgacagatttaaragactgaaaatcacacaaaatatgttctcagaccacaatggaactaagctagaattcaatagcagaaagttagctgaaagatccccaaatgtttggaaattaaacaacacactcctaaataacatatgggtcaaataagtctcaagagaaattttaaaatactttgaactaaatgaaaataaaaatacaccaccaaaatttgtaggatgttccaaaagcagtgcttagaaagaaatgtatggcattagatgcatatattagaaaagaataaagtcaatatgcaagctttcatcttaggaaagtagaaaaagaagagcaatttaagcctaaagcaaacaggaggaatagaaatgagaacagaaatgatgaaattgaaaacaaaaacaacagagaaatttttttttttaaatatcctaaaagctacttttttttttctccccccgtaagattggtaaacagctagctagrctaatcaagaataaaagagaaaagacataaattacccatatcggaaatgaaagaagggtcatctcctcttcccatggatattaaaaggataataaaggaatgtgtgaacagctctattttcacaaatttgataacttaggtgaaatggatcaatcctcaaaagacataaacaaccaaaactcacaaggagaaatagtctgaataggtctatatctattaaagaaattatttaaatttaatttaatttcttttataaaatatttaatgtgacttttacataaattgtaaatatatttacacatttatgtaaatatataaaatattttaattatataaaattatttatttaaaaatttaacaaattactaaaaactatttataaccttccaaaagaaagcaccagctctagatggcttcattggtgaattctgccaaacatttaaggaagatataataccagtcttctacaatctcttccggaaaatagaagagagaacactcattctgtgagacaattactccaaaaccattactccaaaaccagataaagacactgccagaaagaaaacctatagatgaacatctttaatgaacatacatataaaaatccttaacaaaatattagcaaaatgagtccaacaatgtataaaactaattatatgccacaaccaagtgtgatttattccaagtatgcaagtctggttcaacataatgtaatccatatcagtaagccaaagaagaaaaatcatatgattatatcaattgatactgacaaggcatctgacaaattccaacacccatttataagaaagcctcggcaaactagaaatagagggaaatatcttcaacttaataaagaacatctgcaaacaaacctcagccaacatacttaatattgagaaattgcgtgctttcctcctaagatcctcttaaggataaggcaaggatattctctcttaccactgctattcaacattgtactggaagtcctagctagacaaggaaaggaaataaaatgtgtacaggtcaagaagtttggtaggctaaagatgactcctgaagataggttcacatcctaatccctggaacctgtgaatgttaccctctttgggaaaaagagctgttgcaggtgtgattgatttaaaggtcttgcagtgaggtgatcattctggattatccagatgggctgtagaaggcatcatgacaagtgtgtaagaaagactcagagggagattagactcataaacaaaagactgtatgaagacaaaagcaggaattggagtgatgcagctgagaaatgctgaaagccattagaagaggcaaggaacagattatccctagagtctccacagagagtatggctctgctgacacttttattttggatttctggcctccagaatggtgagagaatacacttctgttgttttgagccaccaagtttgtgatcccttgttacaacaacaataagaaacaggtatgagaagaaagatataaaactgtctttgtttacaaacatgatcgtagaaaatccccccaaatcaacaaactcctgaaattgctaaatgagtttaccaaggttgcacgatgcatggttaatatacaaaattcagttgctttcctgtctagcagcagtgtacaattggaatttgaaatttagaaaactatttgcaaaagcatccagtatccatggattccatatatttacagatatgtgtatataaatgcattaatatacacagatatatttccctgctcagtcagctaggagagctaaaagcaagaacactagagcagcagtgagcatacctagcacccatatagtggtttccaataccattctccagtaaaaggagccagggctcattggagaaatggcttataccaggactggtgcagaaaacacacaagataagccctgagcatcttctagtctcagaaagtaagtgcttaaaaaacagaaaaatccacatgatgcaaaggcatacaggaagcaactgaaagagctcccagtggccaaagctggaaccgtgtgaacaataaaataaataaggtagtgaggaattatawacccaagtgtaaaataaatatcttcaagtgtatactgatattaagtaaattattttaaattttaaaatggagaggacacaaaccttcccatataaaattccaagtaattatgtagccaagccccygctcgaggaggtggattataacttcccactccttaaatgtgggatacccataatgacttcttttcaaagagtacagtatgaaaaatgggggaaaaagattagctttacagtggagaaaccgagccaacactaactacctcagccaagtgctcatggtcaacatcaacagtggtaaatcatggtgctagtatgtgcccttgacataatgtgattaacatagcagtttccctctatggtcttaccaaacctataacctcagtccagtgatgagaaaaacatttaacaaatcccaattgagggagggagagtattttgagaatactgaccagtactttcaaaactgtcaagatcatcaaaataaaataagaagaatctaagaaactatcacagccaagagcaatctatggaggcctgacaaatgtagtatgctagatgggattggttattgagtcatactaaaaaaaatctataaagtgtggactttggttaatagtatatcagcattggttccttaattgttacaaatgtaccataattatataagatagtaataatagggaaaactgggtgtggggtatatggaaactctgtattatcgctgtaatttttctgtatattgaattttgttctaaaactaaaagattatttaaaaataaacaaactggccgggcgcggtggctcacgcctgtaatcccagcactttgggaggctgaggtgggcggatcacgaggtcgggagatagagaccacggtgaaacccggtctctactaaaaaatacaaaaagttagccrggcgtagtggcgggcgcctgtagtcccagctactcgggaggctgaggcaggagaatggcgtgaacccgggaggcggagcttgcttgcagtgagccgagatcgcgccactgcactccagcctgggtgacagagcgagactccgtctcaaaataaataaataaataaataaataaacaaactattttgttctgagccaccagcccagttttgttactgggactggaatgaaacacaagattattttcccttcttcattagtcagttaaaggtggaaaatactgtagttttttttttcttggtagctgtgtccatccatctagaaattatttattgagcttctcctgtgtgtcgtgctctgaggatacagaagagtataagaaagatgcagcacctgcccctaaacgtccagaaaggggcatagacatgcaaataatgtgtgggccactgtagctactgctgggctactgttgctgccatagtagatcttctgctttgctctcccaaatatattagaaagagagtgtccaccccgcccttctgaaggagtttggttcttttgattaactttagatggtgtggtttttaagagatcatgccttgttttcagacctccaaatgtagccttggtctttttttttttttttttttttttttttttggagatggagtctcactctgttgcccaggctggagtgcagtggcacaatctcggctcactgcaacctccacctcccaggttcaagcagttctcttgcctcagcctcccgagtagctgggactacaggcacccaccaccatgcccggctaattttttttttttttgtatttttagtagagatggagtttcgctatgttggccaggctggtcttgaacttctgaccttgtgatctgccagcctcggcctcccaaagtgctgggattacagttgtgagccaccacgtccagccagtagccttggtcttctgtcttaatcttctcttccaagatgcttaagataatttaggtgatatccattattatacccaaaagccttctagtgaatcaaaagatgccacatattagaaaaacacatcttgatatcattatggattctttgggggatgtttccctcaccttcttacatctatgtggaggctttaatctcttctttttgattgtctcatttttgatgttgtaggcatcaggcacctgttctatagtctgttcatctatgcatttattaatgaacttagtatatgcctagctcaaggcctttacactttgttttcctgcttgtaatgctatatctgcacatttccttcattcaatctctatttggatttgattaattagagatgctcttatgataactctttaaatatagctgcccctcaccaactccatcactctctatctcattacattgtattatatttctccatagaacttatctccacttgacatttgtttctttattgtctttctcttctagaacacctgctcacaaaggcaggaactttttgttcattggttgctctattcccagcagctttagagcagagtctggcacatggtagtactcagtaaatatttgttgaacaaatgcatgcatggtagtcatgtctccactttctcccaggcagccttacagacccaaagaaatgaaggcttccagtgacctgctctgatgcatcagtgtccatggaatttgtacagattgcagtcctacttaagtccttgcttcatttctctttgtataataattgacagttttcaaagtgcttgctatgcgattgtcccttttgatgctttgtgtaatactatgaagcaagtgggaatttcttagacctgtcgtacaaatgaggaatgtaaggggatggaatttcaaaggtaactatcagagccagagctagaaaccagatctcctgacttctagctcatttggtgattatgcggggtttacgtttcatctccacccgtgtctacattgtatggttttgagggcaaggtcttgaattttttgtatttatatttttccatatgccttatacacagtgtgcttaataaaggtgtgttgctttgggcctttaggccacttcaacttttatctttgacttcgttaatggactttgggaggatctcagagacttgttttaggtatggtgccacagattccataggttagggccatgaatttgcacacaaatcacctaggaactttggttatgttagattctgatttagttggtctggtgtagtgcctgagattatgcatttttaacaacctctggtagtgcccatgctgctggtacatcttccacactgactatttcagggccttgtaacacgtgaaagaggtattctttgtttggctatctgactgtgtgaacctaggtaagtttattggagacgctgtgatgtattgtttaggctagattactttggttaaaatcctacctttccatttactgtgtgatctcaggtaacttacttaacttttctgtgcctcaatttcctctttaaaagtagagatcgtattactatgatctctatttgtagctcatgcaggtattgactgaattaatacttgtaaagcatctagattcataatgcatggcactcaatgaatcttaactactgtgatcatttctttgtctccttgtgttattttgttaaactacattaataggtttaagatacatttgaaggaaggaagttgtttaagatatttgcaaggtatgaaatagcgtggtctctttcatggaaatgctaatctggttggaagacagttctttcattaatgaacaatgcaatagaaatcagctaatggtgattcttcttgagctgtcacaactgtatactgtgtacttttcattaagcatgagcaaattaggagaaaatgagtaggcactcctgttttgtagtaaaatgttacgatgtataatattaagcatagggcataaaattgtttttattcatctcagttatgtattaaatgaaccaacttgattttaattggcattgtggaaatatggaggcaagagtatcagaggtcagtgagaatatatttggtgcctaatacagtgatggtaagggggaaaaagtatggacataatcattttaaagggagattttggttttagtttttccaataattaatgaaaaataacattgggtttcttcgggaaaaaatttacacaactcatttctcccactgactcaaaagtgtaaaaaaagaatctttaattaacatggagtttttcctctttgttttaggatcagattttattaagacctctactggaaaagaaacagtaaatgccaccttcccggtagctatagtaatgctgcgggccattagagatttcttctggaaaactggaaacaaggtatattattgccagcaaatctttcttcagagtaaagataatgttatttataatactagttacagccacaataactgtctttatatggagaagttgtgaatgaattacctttattaagataaatgtttaatttacctttcattataaaagaacacactgatggagaaaaattgtgatgaacagaaagtgagttgtgagtgtgggagtgagtatgtgtgatcaagatgtaaactcactttatgtccttttgttaaccgaagacaattttgtcactgacaagagattcctaaatgggttctttaacgaactaattctgctgcaacacagaggctttctcacaaggcgttggccagtgaaaacaggttaatgcagaaattaaacttccttgaggaatggaaagaattgcagagtaacatttattgaatgataagctgtggtggtgatatgaaaggtatgcaatataatgggaaacaatcttttcctgtcattattgaaggacacacataaattggtttttctgttgggaaacccccggtccagaaaaacttattacttttaataatatgaggtgaagagaaaattctcgaggagatgaacttattaaacaaaataatgaaatgctgtgaaacagcagggaaaaggtagctagacgttatatagctcttgaattaaatatcaatttttgcgttttatggaagttggatgtgctctttggaagactgttaagctgaggagggtgtatactagtttttgtcagcttttcgaaaaatgatacatattttttgaaacatatgaagttaaaaggaaaaatgcgtatgagttgcttttttaaaaatgagtttggattttccttttcatctcaagttacttgtttagctgcaaattatctcaaaggatttttttttttacatgattggagagcaaggttgtgtgtgtgtgtgtgtgtgtgtgtgtgtgtgtgtgtgtgtgtgtgtttaatgacactttcccttcctgagaggcatcttttaaatccagtctcttgatttgtgccaaatagaaacccaaaaaagacctttaatcctttgtccattggatgtgatgactttatatgtaagtgtagcttcagtttattttggaatagtgaccttttttttaatatactgttttatgagaggaaataaactccttccagaattttctcacttaaaataacttcacatcttaattacgaataggataaatatctattgtgaactacatgagaaagctgacccaactcgaataacctctacctggtatcctttctgcaacaatccaaataagttaaaagagtttttgtttagataagctgtaaaaatgataaatctatctttggtcctcagttgaaactaccaccactcatttgattgtgattctcattcttagccaaagaatatcaaaaccaaatgtgaagcttttcatacttacagatgcctgggcccccatccctggtggttttgggtctggcatagtcttcaggcatctgtttgcattaagttccattgccagggttcagacctgccattggggacccagtcctgttttgttctcaacaaacatttattgggtagttaaccatgtgccatgttaacctgtgttaaatgctaggaatggaaaaatgagtatgttccttctcaggagagctcttagacaacaagcaaagaatgtcaatgaaatttttaagtgctcagtgttccaggccagagtacagagggagggacactttgctgtctttcagtcctttctttttaattgtattgattcttttcctcggtaataaataagtccatcctagttttattaagaaaaagacaggtacaagccaaattgtattcatttaatcatattcgatttcaaacaaataggttctgtgtatgtgtttgcaaatcaggtgcagcctttcgggttgcttgacaagttgcttgggcagcccttagactataaagtttctacgtcattgatttaagggtgttttaaaatgcgataggctagcttccagaccatgattagtgtcactcctgagaagyagaggtttaatatttcataactgatttcattgcagatttatgtcttccatattctctttaaaaaaaaaaaagataaacttatgttagaacctctctggaaacagacttgctgacacaaactgaactgtataggaaatctgtaagaagcactgcctaattgacaaaaatggtcctatgattaacatgtatgctaatatcaactaattgatttttttggcttattctcaacaaataacctcatcctacttaaccccctactaccttacagagtcatagcttgggctccagagtaatagcagatatggttggaatccgtgcactgctactgcttagttgtgtgacgttgtgtaattgaggcagggaaaccagttaaaagacttttactgatatttcctgtgagaattgataagggtctaaactgaaacaagtgagagtgcagtggaaagagtgcatgtgagggggtaaggaaggtaaggaggtagaattgtcaggacttaaatattgattgggtgtggtgtggccagggaatggtggagtttggattaaactataaggtttcctgcttgggttgataatagaatatattcatttaatgtctcccttctctagcattctgttagcagtcatctgctggtgcaaccagtcatagccctgagtgataaaacgtgagagatttagtactcaggctctgaggtgttgttttgaccactaccatctacagattcccaactctactggatagtcaggttcctgaaacatgtaaatccagataatcagagttttattgtatatggaacatatctttcatttcctaatggatccagggacatcatttacgaatatcagatattggctgaattcagctgtgttatgatcaaccttaaagactactggactatgaggagcccctcacggtgtttttctactgcccttatgtaactggtctgccagctttttagaactgtgtgtgcctgcaacttagaaaaaaaatcccacagttaaattggttaaaacaactgtcaactttccttgcttttttgctgccagtttggttagggtaaccttgcagccttgctgattctgtcctttgattttaaatgcacgtgtcttttgaacctcaagatgaaggctgagaagtgactctacaggcttacttgtggaaatgtagaatgagtgggctttgcttttgtgatctgttttcctatttattgacaccttccttgtttattccaggttcacagctatagtctagatggtggaggtttatgactttccaataagtgaaatgttaatgagggttattaaccctcactagtgtctgtttggaagtagtgacattcttccaaaaatcttggaaaagttgttttgtagtgtgaatgagcatgagtcactgatctaagccctttcactggatgaagtgaaaagattttttttcaacaaaagagggagagagagaatcaagactctgataaacatagtactatttttaaaagaaatccaataacaataaagattgttctattctctgccttcccatttagatagggtttaaaccagcaggaggcatccgcagtgcaaaggattcccttgcttggctctctcttgtaaaggaggagcttggagatgagtggctgaagccagaactctttcgaataggtgccagtactctgctctcggacattgagaggcaggtgagtaatcatctctgtctttggaataaattaacaagtgttttttgagaaaggaattgaaaagtcaaattgagaactggagataaaaactcatctgattgacctcatcctacccaatcctctaccttttcttccaagcaaaccgccatcagaagtgagtagsgtggagattctgctgaagcacatactagtgaggctttctaatgaaatgttcattaaaactattyattattatttgatagtataattattaactgatgtgtataattatagaatgattgttaattaaactctgcttttcctcacagatttaccatcatgtgactggaagatatgcagcttatcatgatcttccaatgtcttaaatcagtcaccagtwccagaaaagttctttacgacaatgtttaaaaattatttttctacgtaattgctaaaattatttaattaaaaaattgggcagtaggtaactggcattcctctctttaaaatttctaccgaacttaatggaatggaaaaagcaaactcatccacatgtggtactcatttcaggcacatctgaaatgatcttaattactagaagatctgcactattaactttgtgaagagtttctcctaaaaactttaagtaaaatgttaatggtagctttgataacatcaaattctaagggagaaaaaaacaatattaaaccgcccaagcagtgtgccctagcagaggaaaatgcaacatctcgcaagcgctgctgtaacgacttcaggagtcactgattcagcactaatttcctgctgtgaaaactcatctttcatttttgccgtggataggcgcttttattaattgttgtcctaatgaaatttctgacattgtcatatacaacgatgaatatcattaaaatttttaaaataataaagttcctatagtttatttttttaaaaaacttaaaaattgttacaatacataatgaaaaaataatccattaaacataaaaagaggtttgatcagtgagtctctgaatctctctagttgattccttgggtatatatctgtaaaacaccccagtatgttattaatgaatgcaacttatgtatgtgttctgaaacttcaaattttctggtatagtgaatggaggaaaacagtagatattaacagcacttgctgtgtaataagctttacatatatcaatttatttaactctcatttaatcctcataatagtaaggtaaatacagttaagggttttgcttcttatagcagtaagtactcatgtaaacatccttttatacagacaggggaatgaggaacaaagagtttaagcaacgtgccaaaggttgctcaaaattagcagagttaaaaatcaagcccaagcagacaggctggctcccaagtgcgtgcagtcacccccatgtctccctgtccctcggtacacatagtcaggtgtacataaacagagctccccatcagctgagaggacggtaatctgcctcatggtggctggcttttttgctctctgtctgtcccagcctcgctcttccggagattctgcttgctagcacctctaccacgttacagaatgtgtttctttgaatggtgattttcatcaggagagtctttttcttccctgaatggctctctagttgctcataagcaaaaacctggactggaagtcagttttggtttcatcttctcacctgctgaattctagcctgaactctccctctttctgactttgactccttggtccagtcagttcacatctcttgacctcagtttcttcatctgtaaagtcattgggttggggcaaatgatatcaaagttctttcagacctaaaattatattaccctaaggataattagaacaaattcaagaaaatgttttatggctaaaaagagaaaacacttttgtaccaatctaaattagaatttgcctctcgggagacaatttagcaagtccctcagagcacctctctaactgtaaatgaaatgactaaaataagaatagaaaagaaattctgtttttccccagtgccttagcaggatgccaacttttgacttgtgcctttggatatggtcagtggctccgaacgccatatccagcctcacaatatgctagcccaggtgcccaccagtgcaatggccagtcacctttggagaagaaacattccagaaaaataattacagtctatcacctttgaagctattccaatttcacaggggtttctgttttcctcccattaaacccagctggtcattttagttgatcaagtgaacaggtatcattatcttcaattttaatttatatgaggcatccactgaaattgacctctgtggacaattacagattcacataggaaattaagactagtgagtccctcagacctattagaggctgatgagcatggcctgatctaaaggtaagtaatgttatatttggggggcaaatttattccaaggactgtggggctcttcatctgggaatgtctgcccatccttacctggctcttgaaatcaaatgtaacacagatgactttaataggaacaccctcattaatgttgattgctatgaaaacataagaggaagaggtcatttctgaggtgactatgatttactacaagctgatttgtgtacttcagaacattgggatcagatgctttacacaatcagaaaacgaccttctatgttctgtgtttaaagcttctaagttaataaagcaccctgccttgttgcaattgttcagtaaagcatattaggctttaaagttatttttgaaactatcagtcataatttgggagcataaagagactttagagaacatctagtaacactgtcttttttttacattgagaaaagaagcagactggagaagtcacttgtgcaaggtcacatagaatgtcagagctgatgccagaacgtacatccctaccacatgacgaaatattttacaacacataccctggtctttggaactgaaaattccttgcttgtttatgcaccctgctatacctaatcatgtttgtcagcatgtgaacttaagacttacaagagattcacttttgagtcttcaaaatggtgttttagagaccaaccttctcaatctagcccaagtgatagtttgatagcatggttgatttcatctgttagaatctcagaattttggatgacctctagaactgatttttttaaaaggttgaatgttactttgttttgttttaaggaagaaaaagacacgggggcttgtttggattctaatttgtatacacgtggaaaggaaatgacatgtagtcacaaaacagtttgataattaaagtattcttgcctcattctggattatttgaacactaatgagaaattcagacaaattggttcacatgaaaaataatttgtaaagagacctgtggtagcagtgggaactgttacagatatctggaagtgcatcctcacaacaacataacacagtctctgagcagaacagtttgctatgtcatacatacatgtcttacagaaaccaaatctgtttctttggaaaaattaacttacacttctagtacagagagaagccagcattaatttttcttccatcaacctgatattgtacacatcataaatagggccacagtgcagaggtataaagaagaagaaataatttgagtaggtcttaccttccaagacagtgaaatgttatgcccattttggtgctacgaaaaaggtatgaggtgaaatcaatttctacatttattttcctgatcacactcaggagttctgcctcccaaagaaaatatgtattttataaccaccaccaaatgatcctttttagaaatgaccacaggtaacatctggctgatacataaaatatgtagtaaaaataatcatttttaattaactaaaacctgctcaggagagagtcagaggaatatccatctggtcaattcacacttaataggacagatgaggatcaggatgtttaatgcaatatacgtgaaatacttactgaccttaacaatgaactaaaactttttattgggaaaaagaacacagatgaggaggaagaattggaatatctagaaaggacagacctaaaatttgatatttttagaagtacgtcttgtaaaacaggtagaatataagaaacctaggtcatatggcattagtttctgttttccaatgacagggaatgttttcatttgcacaataaaataaggttatactttattctggagattggcaacgagttttaagaagtgctaagtatcttataagaagtgatgataagtaaaaggaactgggattatttagcctgaagagaagatcaaagggtacttaatgtctgacaatcccaggaaaagttacttctatattagagtttagtaacacagtcctgtatctcctctgttgaagaagaaatggaatttatgctacatgtgaagttaggttagttctaggtaaggactcccttaatggactagaatgtgttattaagaaggtacatcttactattctcagtagtagacttgtctttgtgtttgatggtttagttgtgctgccaaaaaaagtgtttctcaaatggaatcactgggaggattatatgaaataagtctgatctccacccccagaatttccaattcagtaagttagctgtaaagcctgagaatttgtatttccaacaagtgcccaggtgatgctgatgctgtgctccaggaaccacactttgggaaccactacattagaaatctttgcactcaatacctggattccaaattaaatgcatctattaagcagtaaaatccaccagctgcagcacttctttatcatgaagctctaggataaatgtgtatattttgctgcttttcatagccaagaacaggagaggggacaatggaaatgacattatcccttaatcctttcacactaggcaatgaacttgatttcactttgggtttaaaagcaagctttggagcctagaataaattagatgaatttagatgaatttagaatcattatccataaaatctccaaaggattttagcaagccaagattgtaagattcagctgtatttgattctgccagtctggaatgctataatttttggtgatttatttataatatacattaaaatcaagacatattttaacagagcccattctttaacttagaatagataagatgttttagggaatggcatgtttcacagatacttggcttattttgaaagtactgtgtagatggtctctagagcacatgaaaatgttagttccttggtcttttccatataaaagcatgttttaaatttggtttttgcttttaagtgtttgctttgccagtgctatactgcacgtaggtacggttcttaattgtaagcaacagaactctacctagtttaagcaaaaaaaattcttaaatcatgctgtcttacagaatatgtaggatggccagatagtgggaaattttattagaccgttcttgcatcgctataaaaaaatacctgggactgggtaatttataaagaaaagaggtttaattggctcatggttctgcaggctttacaggaagcatagtgctggcatctgctcagcttcagagaggcctcaggaaacttacaatcatggcagaaggtgaaggggaagcaggtacatcacatggtgaaaataggagcaagaggcagaatggggaggtgccacacacttttaaatgaccagctcttgagagaattctttatggcaaagacagcaccaagccatgagggatctgtcctgatgacccaaccactttccaccaggtcccacattcagtattggggattatagttcaacatgagatttgggcaggaaaaaatatccaaactacatcagaaatagaggcagcttggtaagaataatgcccaaaccactctttagaaaactgctcttaatcgcttcttggtcttttggctaagatgaagtgtagacctgatggtactgcctcagggcacttgataccagaacccctgcctttgccttccctgaaagttgggtttatcccagtggccaaagatgaattcctcatgttgatctcttgggtatccagttcctgtctggttatgtctaattgttacagtgttggccacatccctgtaccttagctgcaaaggaagctgagaaagccaagttttggctgccttcttggggaaaggggcatatcatgttcaaaagatagaggatggtcaagcatcatcacagttgtcaactacaatataacgaggtggtactggagagacagttaatgctttgtattaagaaataacttgttggccctctactgtatttctattttcagttagtctctaaagctgaacactgcaaagttgccccttgtttcttggtcccatataataggtccagagaagtcctatggagtccttttgtttaaagagaattgcactcaccagcaatatgccctttcctccaaatatgtacacttctgtttatttagacagctattgacttcctaccaagagcatgatgaatttatttatttctactttctcccccttatcttccttccaaactcatcagatttttgatgtcacgtagcttttataacatattcttgaagcttggaaatgtacttatagctctgttttttattttttttaatttttgagacggagtctcgctctgtcacccaggctggagtgcggtggcacgatcttggctcactgcaagctctgcctcccggcttcacaccattctcctgcctcagcctcccgagtagctgggactacaggcgcccgccaccacacccggctaattttttgtattttcagtagagacggggtttcaccgtgttagccaggttggtctcgagctcctgacctggtgatccacctgcctcagcctcccaaagtgctgggattacaggtgtgagccactgcacccggccacttatagctctattacatgatttatcagctttaataataatctgttctctacagatgagaaaatcagcatacctacccaccaccttgt

SEQ ID NO: 10703 - DNA, 170546 bp, Homo sapiens
  misc_feature (1)...(170546): n = A,T,C or G, or insertion/deletion polymorphism (see Tables 1-2)
tttaaatatttccccctatgttctttccagataatgtgaaaaacttatacttggtaatgtcttatggtgacatactgtgcagctattaaagaacgatgtttccagagagtatgtaatacactggaaaagcttacgacataattataaaatttttatctgtctggaaagaaatacgcctacatattaaaggttgctatctatggctgggtagattttctggtaattttcactttcttccatactttattctgtaacgttcaaattatctgcaacgagtgacaatgtgttaagaaattcacaaaataaagagatgagtattcagctgggcaccgtggctcacggctggccaacatggtgaaaccccaccactactaaaaagaaaaataagccgggcatggtggcgtgtgcctggagtcccagcttcttgggaggctgaggcaggagaatcacttgaacccgggaggcagaggttgcagtgagccaagattgcaccactgcactccagcctgggcgacagagtgagactccgtctcaaaaaagaaacaacaaaaaagatctgagtattccccagaagtaattctccttttcattttggtgtgtactacctagactttttctgcatgcctttaaatacacacagaaacagaattttttaaaaaaatacaagatgtgatatagtgcatattattctgaaacttgagcctttcacttaatagttatggcaccacatacatatttccctccttttttcctactgttgcatggtgtaccccaaactggaaataccatagtttagctattttcttattgatgaacatgcagatcatttggattttttgttacaaataaagccatagtgaaaggttttatgttttgtttttgttttttagagacagggtcttgctctgtcactcagattggagtgcagtggcgtgatcatagctcactgcagcctcgacctcctgggctcaagtaatcctcccacctcaacctcccaagtagctaggactacaagcacacaccactgcacctggctatagtgaatattcttatagatatttctttccttttttttttttttttgagatggagtcttgcactgttgcctgggctggagtgtagtggcacgaactcggctcattgcaacctccacctcccggttcacgtgatcctcctgccttagcctcccgagtagctgaggttacaggcacacaccaccacacccggctaattttttgtatttttagtagagacggggtttcaccatgttggccagactggtctcgaactcctgaccttgtgatccacccgcctcggcctcccaaagtgttgggattacaggcgtgagcacccaccctcttatagatatttcttaggaaacacgtgcaagtatttttccaaggtaggtaccaaaaagaaagaaaaagacgatgcacattgtacgttttaataattgctaacaaattgccctcaaaaaagcttgtaccaatttaccgtatcattaacagcacgtttctccacatcctcgccaacacttgatattatgaatccctaaaaattttgcaaattgccatgatggggacactaaaaaaaaaaaaaaaaaattttttttttttttttttttgctcaatttagaccaggcgtggtggttcacgcctgcaatcctagcacgttgggaggctgaaataggagaactgcttaagtccagggagttcagaccagccacggtaacatagtgagacttcatctctacaaaaaatttaaaaattagctggacatggtggtgcacacctgtggtcccagctactcggcaggcttgagcctagaagtatgaggctacagtgagctgtgattgcaccactgcactccagcctggacaacagaatgagactctgtctcaaaaaaagataatttttcaattttatgagagaaaatattatattttaatctgcattttgctagttactgagtttcagcatctttttcatgtctatttttgttatttgcatttactgctttattttattttatttttttttctgagacacagtctcgctttgttgcccaggctgcagtgcaatggttcaatctcggctcactgcaacttccacctcctgagttgaagcgattctcgtgcctcagcctcccgggtagctgggactataggcgcgcaccaccatgcccggctaatttttgtatttttagtaaagacggggtttcaccatgttggccaggctggtctcgagctcctgacctcaagtgatcctcccacttaggctcccaaagtgctgggattacaggtgtaagccaccatggcatttactgctttgtaaattatcttttcatatcctccttttctatacagtggtttgcctttttctcagtgatttaagagggtttttttccccccatatcttttggatattaatcttttgttatacagtctccagagtttttctggcagtttgtcacttgtgttttgttgaatagattatcaattttgatattgtcaaatattttcctttgtggctcttggattgctctttgaagccctttagtaccctatgttctcctacatttaaaaaattatttagagatattttttaaaagtttggttcttcaatttatgtggaaattaattttgtgaacagtctgaagtaaacactgacctcatttatttttcaaatgaataactaattgtccaagcactgtttattattttgccctactgacttcaaatgccattttctatatgaaattcccatacatacatgagactgtttctgtactctctcttctgttccattgcctatgcttatctcaataccatatagatttaattttatggttttataatatactttgatatagggaaaatcccaccccctttatttcatttataatataaagttcttaaaaaactattcttcattgtttatctgcctgattctcacttcctacttccagatgacagggttccagacgacaaagaggtaaaataaaaattacccataggcaagacaaaggagcatgggaaaatgagggaaaggagacaaaaaaaaaaaagagaaatgctcttaaggtgggacaatttttcccctacacttcaagaagcaactttatgtatcaatattttgccacattcaaagtaaggtagattttgtgtgtttaggatatttcagccactgtctaaatcaaaggtgtctctgactttcattgctagctagttaccaatggcagaaaccatgtaaacaaaaaaatgtgaatggaagggaatagaaagaaacatgaatcaatcaatgtgagaacatgaacaagaactagagagaatagagacatggtgagacagaataacatacttgtattcttcttgtggaaccaaatgtaaggaagtcaaacctctgagcttagtgcattcattgtatcctgggttctttgttatctctgtttacagtcacttgatgttttatatggaacatagagaggttgattctttactggataattgaagtgacagagaaaggaaaagtactattaggaattatagtaatgagtaacagaaaataccatttacttggaggtaggttggtaagcattaaaaagaactgagtgagctgggatcaagccactgtactgcagcctgggcgacagagtgagcctctctcaaaacaaaacaaaacaaaacaaaaactgagcaaaaaagtgtttgttagtaaaatacgcacactaaataatataacctttaaatctaatcattgtacataataagattatattcaacttaaaattgtatctgttttcattgtaaagctaatattacacaagtgggaaaagctgtctcctaggcaagtgtggttttaagtcaacagttaattaaattacttacaatgaatttagttgttcctggttgaaaagacatgttgatagggcatggtgattatcaagggacttgtgtccaatgcagtgtggccaaagtttcagggctcagtaaacaggaacaggcaataataaaatcctttaacaaccactcacacaaaaatatcctaattttttcatggtgccaaaagggaacattgtgatttactgatcttcttttaacttgccaatttgtaattagctgccttatgtttaaaatcagactatttttcctagtgaagcaacaattgggtaagttttattttactcaaaagtacaataaaaatgtattttacagccatttcttcccttgcttacattaggtttacggttagaaaaacactcttaattccatttgccataatgagattatttaccattaccaatagcaaacgaatgaaagatacattttctaaagcaatggaacactaatattttagtactctagttgtccctgctgaatcggcattttaaaatgttygtaacctgtcagcttcatgaaacctaacgatcattggtttaaaacatttttgtaaacttgaaagtgtagcttgtgataaacaacaaaaaaagaaagaaaagaaaaatagggttaagtattttacgtatcagatgaattaacatgaactgcagggcaagacttctgtaggtggagctcatccgataactgtgctaaggaacctcctgccgagttccttgctagctgctcgctcgcagcgtggtcctcggccccgacgcgcgctttcgagcttgttccgcagcgggcgctgaagagaggcggccgcgtccggacgctctgatgcggttgcgtacgttttcagcgcttcccgctctccaccggttggactgaggcttttaaactgcagtctgctcccgagtccggcttcctactcggtctggtgccccctggtgctcgtcccctccacatcttgagtagttgcgaagagcacaggggtccaggcagacaaggatgctttcaagaaaaacattccatggcggcaagccgcatggatccacatttcccgggcccagagcctttgtagacattgcatgtggacattcaggagctctagagaaagagggggtgttgtttcacgaagccaccagcagaagaaaggtggaaaataagtttcaaccaactacaaaggcagaagtcagcccagccccccaagtgtggtcaaagacccatagatccgtagaccttatcttttcttgaatccaccgctcccccaaccccccttttattatttttcagacaaagcaaagatagagttcactaggatccccgatttcagtaaggcagcccttttttgagagccagaatatccgtctcggccgggagctgagaatgtggccttaattgatgaggggaggaggatggaaggtaatcctccgtgtctcctcctccaatccgtttaatcaatattaatttcatgcacaatcttcacaaagtttcttttcccctcctccgactcagagctcaggctccggttatcctgctttgcccttcccttccaccctcacagccctgcagtcactcaacactactgaggctctctccattaaagatgaacaacagatcatttttcattgcatggcaaccctaagagctctctagcttagcagagcatgatgggagtctttccatccccccccccccaccccccgcccgctcgttcctcttctttttttttttttttccttcctttccttcttccacaattaatccctaaataatgattttcctaagctcgcgcggacttcgggatggggttgagcgacccgtgatgacgctcccatcagcctttcagaagggacggtttccaaagaaaactacaactcccacgaggcattaggctacagcaaccgcaaggcatcacggaagtcgtaggcacttttcttctaggtcccgttcatccccgccaacccgtaaactataagtcccagggtgcctcggggctagcacgcctgcgcaaaagccccggagcgagttggggggtggggctgctccgggcggcggggggcgggatccgagcgggctgtgtggaggcttcagactcccggcgccatttagcgcggagagtttcccgggtggacgcggctcctctctcggccactccgcacccccatcttcggtgacagaaggcgcctggtgggggtggctgctcttttctctccctgttccccctcacccagtcctctaggtctcctctcctcttgcctcagagaagcagcggagctcgggccccgcggtgagcggccctcccctccccgccgttccctcctccgtcagcccccggcaccggcccgggaggagacgggtttgccaggcrtggggcgggcggggaggcctcggggaagggggggcccgctcctcaggcgccgaggctccgaggctccggcccttcgcctctgggcgatgggcgacctgtgaggccggtccccatcgctgggggcgcgtgtgggaggaggcggccgcccgagtgaccgggagccgggccgcggccttccctcgcccgcctcggcccctcccactcctctgccccggggccgccaccgcccgggcgtcggacctggtcccgtgctcgcggtgccgccgccctctgggcctagcccgcccagctcggcgagcggcggcagtgggagccgcgtccgccgcatccgcctcgactcggtgccggcccctggccctcccctcatgactgcggcgcctctgctgccaccgcccgcccggccgccgctcgccgcaggatggatgcggaccgtgcggcgctaacccccgtggctcagctcccgaatcgcccgccttcgagccctcctcgtgagccgcagcagcctcggtgccagcccccgccgcagctgggcccagcggtccgcctgtccctcgttgcggcttgtcggtgctgagtgaggcgtcgtccgggtcggcgcgaacccgcccggccgcggtkccctgcagacctctgcgcgggcggctcggcccttcacgcccttttcgttcacgaatccgagcccgctcgcctctctccagcgaaccgaccatgtctggcggcgccgcagagaagcagagcagcactcccggttccctgttcctctcgccgccggctcctgcccccaagaatggctccagctccgattcctccgtgggggagaaactgggagccgcggccgccgacgctgtgaccggcaggaccgaggagtacaggcgccgccgccacactatggacaaggacagccgtggggcggccgcgaccactaccaccactgagcaccgcttcttccgccggagcgtcatctgngactccaatgccactgcactggagcttcccggccttcctctttccctgccccagcccagcatccccgcggctgtcccgcagagtgctccaccggakccccaccgggaagagaccgtgaccgccaccgccacttcccaggtagcccagcagcctccagccgctrccgcccctggggaacaggccgtcgcgggccctgccccctcgactgtccccagcagtaccagcaaagaccgcccagtgtcccagcctagccttgtggggagcaaagaggagccgccgccggcgagaagtggcagcggcggcggcagcgccaaggagccacaggaggaacggagccagcagcaggatgatatcgaagagctggagaccaaggccgtgggaatgtctaacgatggccgctttctcaagtttgacatcgaaatcggcagaggctcctttaagacggtctacaaaggtctggacactgaaaccaccgtggaagtcgcctggtgtgaactgcaggtaaagccccacctmctttatttgacngtcctttggatcccaaatttggctcggcgaagccagttgatcgagttcacccttcacttggcattctctgttggactccgagtgggacggggaggccaacttttgaaaggggctgaaattaggagaatgtggagcatgtgcctaggtgttgggataggataagaattattggtagccagagggatttgctaccgggcagcggtggtgaaggtcatcttagtacaaacgaattgtctcctggtttagagtctggcaggaaacttggaatgagtggggaagttgaaagtacagatgcttcttcttctgtgcatttcagtctcatcaaaggctctgcagtgatgagctgcgtctgggtgtagaagcgtgttttcattcctgagatcaggctgttctttttaaatgagaacaaccttgtacctttggatgtattttgcttgatggttgcacaggcatttagtataaaataattattaaaaaaagactcttctctgccccttttggatgtttgatgttgttctacctaatgatgcttaagccttacagtagcagcattgctctgacgttcattaaactaatgtctttcagcccattcactatacagcgaatagtataggagcccatgcaaaattgtgtaagtgctttgagagtcgtaatgtcatcatcattgttttaatcttataaaatatctttaagctgaactttcccaagagtccgaaggagtcgcagcacttccttttttaacctctagtggtgtaaataatggtgtgtcattccggttgactagtacattctaggtttaaacagctgagtttgggctacttgttgcttgacttactgaagcagcttgcttaaatattgccctgattgggcataggtgaacataggttattagtaggagcaggtttatgctgaaggaagtcagccacattatgcatgcataaaaattgccattattgatayagtaatcttgccaagaatatagaccagcctgatacaggatatgaaaataactgaatgatcttggaacttattttatccatgaactaatatgttaacacgtaaccctttgaatgtcaggttccaaataactaaggccatatcaaatgtgaaattaacacagcatgtggaagtaaacttaaaaactaagaagttctttacaaacataatcatttcttaacttttacagttaatgatgtagaacttctaaggtagtgtgaaattaaaactactcattaattttatagtattttagaattgaaaaggtgacagatctttaaaaaaaaaaaacctcgtcaaacgaaaactgttcattttggtcagtcatattcaaaaaacttagtctgggccaggcacggtggctcacgcctgtaatcccagcactttgggaggccaaggcgggtggatcacggggttaggagttcgagaccagcctgaccaacatggggaaaccccgactctactaaaaatacaaaaattagccgggtatggtggcgcgcgcctgtaattccaactactcgggaggctgaggcaggagaatatcttgaacccagcaggtggaggttgcagtgagcggagatcgcaccatcgcactgcagcgtggtgacagagcgagactccgtctcaaaaacaaacaaaaacaacaacaamaaaaaaacttatgtccgattccttttggtttacaggcagaaatttacaggtagacacatttctttcttgtactatcgatgcttattgatactgatgctggaattttattcttccattatagttttatatttgaataggtgctttttaacaattttgttttccttaaccggttaccttacttttttaagactggacccaattacttgttgagcactttatgaattaattttgttagttttaattatttcacttctgagacttcttagcatgtgatgtgtgttttccttttatcacctggaattttctgatactttattatcttggaactgataatacagtgaaaaaaacttaatttgtctaatgtcacgataaaaactttgtccaagcttctcaggttttcttagaactcgtaactttttggatttttaattctctatctaggcatgggcattaccaaactaaagaaaatcttacatcgcatattatttttgagtcatttcaggatttggctgcagaactagatgaatcctagcttattaagtggtacctggtttagaaacttccatgttatttgtctgtgcttctgtaattttttgttttgattttgaaaagattatcttacctgaaaaatcctttatagcagtagttaggcagtatttttggttttttgaccaggacacttgcactacatgcctaataaaatattcagtgggtcagtgtttgaacttttatctttggagccaaattaaaggacaagccaagggattactaaagcactggaaagatagaaactttttcgctaaatgtatccttttaatatacatatatttctgaagcaagacaggagaatattgagttaagttgttgagttaaaaatcttagtgtattgaaactgggagaaatcttaggttattctgcccagctatttatttgacaaataaggaacctgaaatcatagagcaggtaaataacttgattaggtagatgaagaacaaaagctagttaggatctaataatttgggagatgacaaagcatttgtagtccagtagatggctaataagtcatttcaaatgaagcaatattgtgttggtgtggaagtggctgttggatttctggagaaacccggtccttatacccatggcaaatttcaggcttctgttttgggtgttgatttttatcacttcaaattgagatataaataggcttttgtggatgggtcaatatggtatacaaatcaagctattttctgtcatgctaatttttttagagtcatgctatgcattgctctttagtaaaacaagcatcaattcttttttttttttttttttttttttaaaaaaaaaaagagacggagtcttgctctatctccaggctagagtgcagtggcgcaatctgagctcactgcaacctccgcctcctgggttcaagcgattctcctgcctcagcctcccaagtagctgggagtacaggcgcaccccaccacacccagctaattacaagcatcaattcttagtaaataatgcctaggtaatattttgataccacaggaccttcagtaattaccgagatgtttaagatgcagatttctttaactggttttattagacaagtagtgcaccttaattttaatatttggttgtcttggtcagaaaatattactgttgggctctatctgcagagtttacattgcttttctagaaagggatctggtttttcaaaaaagatagcataatttcctttaagaaaacattgatggagccgggtgcggtggctcacgcctgtaatcccagcactttgggaggccgaggcgggtggatcacgcggtcaggagttcgagaacagcctggccaacatggcgaaaccccatctctactaaaaatacaaaaattagctgggcgtggtccgcacgcctgtaatcccagctactcgagaggctgaggcaggagaattgtttgaacccgggaggcagaggttgcagtgagtcgagatcgcaccactgcactccagcctgggtgacagggtgagactctgtctctaaaaaaaaaaaaaaaaaaagaaagaaagaaaaagaaaacattgatgcacagatttaagaatgatttattttaagcaccttcccaagttgcctctgaagagttcacatgatgcgttatatgttgatgagattgtttccacatctacctgaaaagagaggttaaatcatatttttgttgaagctccaatatacttaactgcttatttttctctgtcttttattaagactgtgtgtcatgagtacatgacattaatattttgtgaatagtatagcagtgttacagaaatgggatgtggttctgtgattaagaaaccatcatttatttctttgctatagttctttttttttttttttttttttttttgagacggagtctcgctctgtcgcccaggccggactgcggactgcagtggcgcaatctcggctcactgcaagctccacttcctgggttcacgccattctcctgcctcagcctcccgagtagctgggactacaggcgcccgccaccgtgcccggctaattttttgtatttttagtagagacggggtttcaccttgttagccaggatggtctgctatagttcttaaaatatctaattgaactgaatctctctatttgaatgttggtgattttttccctcttatcttttaaatttgtgccacattccttattttttaggatgagaatcagcgtaactttccgtctcagggaatagtttttggagtttgttcttaaatcctcaaagtcaccgattaggagtattggcaaatttttttctcttaccttttttctgacccgtagtaacacagtctgagaagtaatctaaaaacctggaaagaggttgtttttgtgtaaaacaaaccaggaatctattgttgctttgtgacaattcatttcttgacattcaaattctgatgcaagagcctagtcatttaaaatttatcttattccaccagcagcttatcaaagaatttcaaaaaataaaaaatatatgtatataaatataaataaaattcatcttagttcatccctatggaaacattcaactaaaactgggctctcattttcagaaatcatcctaaacctgttatttgggttttctggtagtttttacatttttttagataaagctgtaaaagcagcaagagtagctgtactcaattatcatttctgaaaatatttagcatactatgaaataattcataattaccgttagtacacctttgctataccagttctttaaattatattgataatttaaattatatatttagtaacttgcattttgtttgagttttttgtttttttgtttttgagacagagtctcactctgtcgcccaggctggagtacagtggcgcgatctcggctcactgcaacctccacctcccgggttccagcaatgctcctgcctcagccccctgagtagctgggattacaggcgagcgccaccacgcccggctaatttttgtatttttagtagagatggggtttcaccatgttggccaggctggtcttgaacacctgacctcgtgatctgcccgccttggcctcccaaagtcctgggattacaggcttgagccaccatgctcagccgttttgttttgttttaaaacctggtctgcaggaataggtgagacttagcatgacctcagtttatgtttgaagaggccatttttctgccttgtaacatagtagttaagaactagattgcctgggctcaaatcaaggctcagctacataattgtgtcaccttgagcaagttttgtgctacagtttcctgtctgtaaaatgggtgtaaaaaagagtacccattttatagagttgtgctgattaaatgaatgaacatatataaaacatgtaggatagggcctgccacataaatattaactgtgatgatgcagcatcttttttaggttgtccttttgagggaatctgtgaagattttgtttgtttatatttatgcttgaaaaatcatatagcaaaacttaactactgttcttggaggaggaggaaagcaggtattgatctttatgttactggtgcttttaaattccttagctctacctggcctttgcctaacattttaattttgtgacccatcacccaaatgccaatctttctgaactgcttattttcagaatctgctaagatccttgtctcatctttgcatgtatctagaaagcatattttcttttggtggatctcatatataattcttatagtatttatttatcatattgaaattgtttatatattttgtctaatccattagtctttggaaagttcactatggtgtaatagaatactatacaatgaaaaggagcaccaaggcagaacccttgagttctagattacccaattttctgagctttgagtaaggaacttaatctataatgctcatttattagcaatatgtcttactgatttaggattgttgaagatccactgaaatactatgtgaatgtactttgaaaaatgttaagtgttatataaaatataacagaatacttaaatattcatttagaaggctataaattgtcacctattacaaatggaatatattaaacttagttggattttaggagctttttgctttgtcaacttaatttctcaaatcttaacaggggagcttttcagtttgaagaaacattgtcagaagctcttaatattttatttggaagatgattatgcctttgacaggtagcaggcttaattttatatgtagttttttttttattgttgttgtttttgatggggtcttgctctgtcgcccaggctggagtgcagtggcgtgatcttgggatcttggctcactgaaacctccacctcctgtgttcaagcgattctcctgcctcagcctccagagtagctgggattacaggcacccacaaccacacccggctaattttttttttttttttgtatttttaatagagacagagtttcaccgtgttggacaggctggtctcaaactcctgacctcaggtgatccacctgccttggcctcttaaagtgctgggattacaggcatgagccgccgttcctggtctatatgtagtttttaaaagattggttatttgtgatttttacataagaggaaaagcatcagtaagctgtggttttgtggccaacttaattgatcatataatatctccaccttcacttacattaatttagatttttcaggtggggtttcataaataatttactttttagtgttgtgacttgaatcttggctttgccaaattaccatattaaatacattatgctaaatgaatatgttggaatgattttttagaagagtcctcagataagctgttagtcataacaagcaaataattttctcaggaatgtaagaattcttaagaattttaacagtttgaatttaagagtgtttggaaatttgcttgttgtaatcatcatactcaggttagttaagaaaaaccacagtcattcctgcagataccttttgtgcagctgaggttcagcttctcagagacaatattatttttgtcagtagatacgtggtagatggtctagttaaccaaacacacactaatgtataaaccaaacagtgagagatgaaattaattagtgaatcaaatgattaatgtgcacattctctgttactagatagagattaacagatttcttgggataagatcattttcatggctaagagttttgagctacataacctgatatatctatctttatgtggatcatctccttccatggactggtagattattgtggattaaggtaaatcgggaaatgcaacagatttatctctttaacatgctaaagagttactagatatcattgtcatattaaaatgttctttgaactctccatattgcccctctcacacacagtcatccgtcagtatacacaggagattggttccagacagcccccaccccagggtaccaaaattcacaaatgcacaagtctcttaaataaaatggtgtattttcatataacctacagtagtacatcctcctgtatagtttattttttaatttaatttttttttttttttgaggctgagtcttgctctgttgcccaggctggagtacagtggcacaatctcagctcactgctacctctgcctcctgggttcaagcgattgtcatgcctcagcctcccgagtagctgggattacaggcacatgctaccatgcccaactaatttttgtatttttagtagagatggggtttcatcacgttggccaggctggtctcgaactcctgacctcaagtgatccatcwgcctctgcctcccaaaacgctgggattacaggtgtggctcctcacgtatagtttaagtcatcactaaattacttataatacctaatacaatgtaagtgctatgtaaatagtttttatactgtagtgttttaaaattcatgttgttttttattattgtgttttgttattgttttttcccccaatattttcatctgcagttagttgaatccatggatgcagaacatgtggatatggaacctgaggatgtggagggcggactgttcttatgtgtagaaagtagagagtaactgaagagttgagttttaaacagagaagttaattggttagatttgcatagcagtaattgcccaaaaatagattaaaggcatacagggggaagtgtagagattccagtagtccccactcttcttcttaggggataatggttatttttttctcctgcttttcattttttttttgagacagagtttcactcttgttgcccagctggagtgcaatggcgcgatctcggctcaccacaacatttgcctcctgagttcaagggattctcctgcctcagcctcccgagtagctgggattacaggaaggcgccaccatgcccagctaattttgtatttttagtagaggtggggtttctccatgttggtcaggctggtctccaactcccgacctcaggcgatccgccagcctcggcctcccaaagtgctggaattacaggtgtgagccaccactcctggtccgtatttttatcttttggttctgtttactttgaggtttgcaagacctcccgtggatacctgaagctacagacactactgaaccctatgcatactttgctttttccatcccataacccattagactaagtgactaaaggacgagatgggtgggtggcattaacagtgtgaatatgctgaacaaagggatgacatgtcccattcgagatttcatcacactagtcagaatggcacacaatttaaaagtcgtgaattgttggctaggcgtggtggctcacgcttgtaatcccaacactttgggaggccgaggttagtggataacctgaggtcagaagttggagaccagcctagtcaacatggtgaaaccctgtctctactaaaaatacaaaaaaaaaactagccgggtgtggtggtgcatgcctgtaatcccagctacttgggaggttgaggcaggagaatcacttgaacccgggaggtggaggttgcagtgagccaagattgcgccattgcactccagcctgggcgacaagagggaaactctgtctcaaaaaaaaaagaaaaagttatgaattgtttatttctggaattttccatttaatatttttggacagtgggaagtgaagcctcaagtaagggagggctactctagttaggatatgagtgtgagatttttaggacctaaactagggagataatagaaggaatagaacatttagatatttaggagataaaatatttagggtttagtggataatttagtgattaattggtgtttggaggaaaaatgaagcatggataagaggttaggggatgatagtgctgtcaactgagagagaaaaatcaaaggttttttttaagttttaaggttttttgttttttagatgggaggaggtatggagatgtattcaattggacatgttgagtttgagattcttatgtaatctccagtaagaagttcaataggcagttggatatattactaaaacttgaagactaggtctgagatgaagataaaagctgatgattcccaaaaatgtctatattagttgtagctgaaataatggaagtaaatgagatacgctagggagaggatatgaagagatagaaaaattagagagagggagagggaagagtaatggtcctcaggcaaaatagtaacaattaccaagggaataaaatttcaagaaaataatacatcagagaagttctattttcatagtagtaattgtggagaatgaatttaacaagtagtaaagaaatgtagtagttaggctgttgaaattgttgcacttggctattaacaaatcattaacacagcacggtggctcacgcctgtaatcccagcactttgggaggctgaagtgggcggatcacctgaggtcaggagttagagaccagcctgaccaacatggagaaaccccgtctctactaaaaatacaaaaattagctgggcctggtggcacatgcctatattcccaactactcggcaggctgaggcagaagaatcgcttgaaccggggaggtggaggttgtggtgagccgagatcacagcattgcactccagcctgggcaacgagcgaaactccgtctcaaaaaaaaaaaaaaaaaaaagaaagaaaaatcattaacattcccactgagaaacagccctgacaaaaagaaattaaaaaaaaagtcagtaacaattaaatttaaggttgcctcagtaagggggaggttgaataagagagaagcacataaatacatgtaagtcactggtaatgccctagatttctgcactgttcactatctaatacaatatccaccagcctcacgtggctatttcgctcttgccacccaggctggagtgcagtggcgtgatcttggctcactgtaacctctgcctgccaggttcaagcaattctgcctcagcctcctgagtagctgggattacaggcacgtgccaccacacccagctaattttgtatttttagtagagacagggttttgccatgttggccaggctggtctggaactcctcaggtgatccacccatctcagtcttccaaagtgctgggagtacaggtgtgagccactgcgtccagcctttatgtggctatttaaatttaaataaattaaaatgaaatttttagaacttcattgtcttgtactagccacatttcaagtgctcagtgacaacatgtggctacgatattggattgcacagataaagaacattttcaggctgggcatggtggcttatacctgtaatctcaatactttggaaggctgaggcaggaggattgcttgggcccaggagttcaagaccagcctgggcaacatagcaagaccctgtctacaaaaaattaaaaaattagctgggcctggtggtgtgcatctgtaaccccagctactttaagagactgaactgggtggattgcttgagctggggaggtcagggctgcagtgaggcttgatcatgccacttgcacttcagcctaggtgacagagctatgaccctgtctcaaaaacaatttttttttaatcattgcagaaaattcttttggaatgtgctgtatccagatcttgggtcaagttgtgcttttaaaaaatataacgatatgaggactgtgcatggtggctcatacttctaatctcagcacttctgggaggccgaggtgagagcattgcttgaggccaggagtttaagactaggctgggcaatgtagcaagatctgggtctccaaaaaattttaaaaataaaaataataactttatccaaaaagttcaactttaaccataaagttcatccttttaaagtatatagagtgttgtttttagaactgaagttacacatttaaatatgtatactctattaataaagaaaaaatagttattttttgggaaactgtacaaaggatgttatcacatacatgcagaattaataaaggttaacaatatgtcatagttactcaaaatatttggtgaccttacagtttcagaagaagggaaaatttgcagtgggtttaatgagtggatgagaggaagtttagaaagtagagacaataagtgtaggctggggtgagggttgaaaaattacatattggatacaatgttcactatttgggtgataaggcgataaggttaggtaactagaaaccctaacctcaccattatgcagtatatccatgtaacaaacttgcacatgtacccctgaatccataataaaatatatgtatgtaaataaaaattaaaaaataaaaccatgaacaaaataagtgtaggctgtttattctggtaattttaaatgaataagttcagggaaggttgggtacaaggatgagatggatagatgagctggaaaaggtctttaaaagttgaaacattgaactgtcatgttttgtctgctttggtatctatcataagtctgttccaagccaattactgctttagctttgattattctttttttttttgagacagtctcgctctgtcacccaggctggagtgcagtggcatgatcttggctcactgcaacctccgcctcctgggttcaagtgattcttctgccttagcctcccgagtagctgggactacwggcgcgcaccaccatgcccagctaatttttgtttttttagtagagacgaggtttcaccatgttggttgggctggtattgaactcctgacctcatgatccgcctgccttggcctcccaaagtgctgggatgacaggtgtgagccaccacacccggcttattttattattatttttgagatggagtcttgctctgtcgcccaggctggagtgcagtggcatgatctcagttcactgcagcctccgcctcccaggttcaagtgattctcctgcctcagcctcccaagcagctgggattacaggtgtctgccaccccacctggctaatttttgtgtttttagtagagacagggtttcaacatgttggccaggctgatcttgaactcctgacctcaagcggtctgcccacctgggcctcccaaagtgttgggattacaggcgtgagccaccgtgcccggccctagatgttctttagattaaaatagttcattgtggtcaaacaggttcatgctctcttacaccaggggtaatccatacttggacacacaagagcttatgtcaaaatatggcagatttcttaaaatattcctgttgtggcagactttctgggttgataggttttttttttttttttttttttttgggagacagagtcttgctctgtcgctcacgctggagcgcagtggtgcagtcttggctcactgcaacctacgcctcccggattcaagcaattctcctgcctcagcctgctgagtagctgggattacaggcgcgcgccaccatgcctggctaatttttgtatttttagtagagacggggtttcaccatattggtcgggctggtctcaaactcctgaccccgtgatccaccctccttggcctcccaaagtgctgggataacaggcatgacccaccacgcctggccgggttgataggggttttcagccttacctacacatgcaaatctcctttccctctgtaatccccaaatttagactttaattctcctgtctttcaaggggagttgccttactctgtgtgggttcagggtgagggaaacttttcagccagtttatgtcattgaagtacattgaagtttatcagggaatttctaataatagtaaacttaaaatggaaggccttggagttgtagttgtttaccagaagagtttttggctttttctgcatacttctacacacctcttacctcccttcctaattgatagagacagatttttatcaggtcacacatggaatctgctactccctttgaattcaggtctgtttgcttcaacgacgtaactgagaaggaccactctagatggctcctttctacctagacatgctcttttctacctagacaaaaaaagccaccagccattaataaatggtaaactatcaacttaaatatttgttctgcctacccaggcaccctactacatagaggggctagtttaggttttagtttggtgacaaattgtttgtgttgcattgtatcaggttttttttgttcgtttgtttttgaggcagagtctctctctgtccaggcccaggctgtagtgcagtagagagatatattggctcactgcaacctccatctcccgggttcaggcaattatcgttcctcaacctcccaagtagctggggttacaggcgcttgcaaccatgaccagctaatttttatatttttagtagagacgggatttcatcatgttggccaggctggcctagaactcctgacttcaagtgatctgcccgcctcggcctcccaaagtgctgggattacaggcgtgagctaccatgcccggcctgcttgtatcggtttctttatgtctccacagatttttttgttttcatggacataagtggggagcatagagatattttgctagtgatcatcctctggctaaagcatagtttgatttctgtgataagaatcttgaccatattctatccctcttagaagggcagaagtgaaactgccatattacccataaataccactattataggctttcacaaatctgtatttactgagtgtgtacttggtgtgaatacctcattaatgttttaaacatctgccattcttattctcttaatgagtaaagttaacttcttcaacaaccagtacttagctaaatattacacaatataatttttccctttcttcatgtaatggatgaagtttttttgttttttttttgagacggagtcttgctctgtcaccaaactggagtgcagtggtgcaatctcagctcactgcaacctccgcttcccaggttcaagcgattcttctgcctcagcctcccgagtagctgggattacaggcacgcaccaccacacccggctaattttttgtattttagtagagatggggtttcaccatgttgaccaggctggtctcaaactcctgacctcatgatccacccgcctcagcctcccaaactgctgggattgtaggcgtgagccactgtgcccagcctggatgtagtatttaaagaaaaaacaaaaaactctttactgtgaaatactttcaaacataacagttgtcccagatttggctagaagctaccttccgtttccttttttttttgacagattctcactctgttacccaggctggagtgcagtggcaccatctctgctcactgcaacctccgcctcctgggttcaagtgattctcatgcctcagcctcccaaattgctgggattacaggcgcatgccaccacgaccggctagtttttgtatttttagtagagacaggttttgccatgttggccaggctggtctcaaactcctgactgacctcaagtgatcttcccgtctcagcctcccaaagtgctgggattacaggtgtgggccacaatgcctggccccttctgcatccttgttattaacatgtccctatcatttttttatgacatccttactttctgtagaagatgttctcagttcattttattatttccccaccccagtcctgcagcagcaatttctcctggagccctggttctttttattgtagaaaggtattcagaaaaatctgggtgccaggtgtgctcggctactgggcctgttttcggtgaagaattagtgtcttagttcatttgcgctactataacataatatataaagaacagaagtttatttcctcgcagttctgtaggcctagaagtccaggcaagacagaggcatctgttgaggtctttcttgccacgtgctcacatggcagagggcttcagggcaagagagtgtgaacccactctcaaaagccttttttatagctgcattaattcattcatggaggcagagccccacttcccaaaacactgttacattgcataagtttcttttttttttttttgagacggagtttcactcttgttgcccaggctggagtgcaatggcgtgatctcagcccaccacaacctccgcctcccaggttcaagcgattctcctgcctcagcctccctgagtagctgggattacaggcatgcgccaccatgtctggctaattttttatttttagtagagacatggtttctctatgttggtcaggctggtctcaaactcctgacctcaggtgatccacctgcctcggcctcccaaagtgctgggattataggcgtgagccactgcgcccggccaggaattaagtttctgatacatgaatttggtggggaggaagcatttagaccatagcagttaggaaatatttataagtaagcatgtgtgttttggattttgaaaatttagtatgaaaaagaaaagcatttgttttcaaaaaattggattacatattgaaatgatgatgtttagatatatttgttaaatatattaatctgtttctttttacatttttaatgtgactactagaaaattaaatttcatttagctcacattatgtttctgttaaccatcgctaatttagactattctattaaaatgctgtgaaagttgatgctacagcaaatttactacttccttttaaaaaatatcttaataccttcctttttgtggtttcttgcattagcatcctctacaggccataattctttgctgttgctgaacacagaaatttggggttttaaactcttagtggtttgtgatgcttttcataccagattgttaagaaaattggaatcctcatcctttaaaatattatcttttgttatttgccagcatgtccggtaatcagaaatggcatttctttatggctttgttctttgagaactttaattgttgttaagagaatattagaagtgtttactataaatatcttgaaatatttgggaaatattttggtttatttcagataaactgctagtgtatgtttggaatacgttaaatgcataaacttactgctttatattttctttttttttggagacggagtcttcgctttgtctcgcccaggctggagtgcagtggtgtgatctcagctcactgcaacctctgcctcctgggttcaagcgactctcctgcctctgcctcctgattagctgggactacaggtgcatgccaccacgcccrgctaattttttgtatttttagtagagatggggtttcaccgtgttagccaggatggtctccatctcctgacctcgtgatccgcccgcctctgcctcccaaagtgctgggatgacaggtgtgagctactatgcccggcgctttatattctttagtaatttctggccattgtggctccttaagcttgttaattaatttagtgtccatattcatatcttaatgatactgagaaattggttaaattggtttttggtgtctgtctcttgcttatgaaagataaactgtagttcagctatttattagcattgagtttttctagaatagttaaatttttttgtttgtttttgagacagggtcttattctgccccctgggttcaagcgattctcctgacccagcctcctgagtagctgggattacaggggtatgccaccacgtccagctaatttttgtatttttagtagagacacggtttcaccatattggcccggttgatctcgaactcctgacctcaggtgatctgcccgcctcggcctcccaaagtgttgggattacaggcatgagcctctgcacccagccttaactgctttattttaataaagttgtaatatatttgagatggcaagaccattctcttcagactgttaatggtaattttttaaaattattttttatttttagactgggttgcacactgtcacctaggctggtcttgaacttctagcttcaagcaatcctcctgtttcagcctcccaaagtattgggattacaggcttgagaaaccctcttaatttaaggactgcagaagcttactttttttttttgcataagggcctttgatagtcattgtttatggctacaaactaatttgattttgactaaattatctgagttataaacttcatttatttccaccttagttattgtaaccatccttaattcatacacaaaaaagatgctttaaaaaattagtaaaacactctcgttataaaaattaggaaattagaggaggaaaaaggaaataaaaaatcacctgcagtcagtatctttatccagagataagcattgttactgtgtatgacacactggtttctgtgtgtttgaactctgtttttatagttatcgttatattgtatggttgtacagtttgcctgttttaccacatagcaaaagcattttcccatttaagatcttgaggtttttagattaaaaagcagcaaaatatttgtacacagtaatcataattggggtgtgtgtgtgtgtgtgtgtatgtatgtatgtgtgtgtgtatgtataggggtgtgtgtatgtgtatgtatgtatgtatgccaccatacagcagcgtaattatgtgtatacatacgtatgcacacacggttatgttgctgtatggtggcatcatttgcctgatttaccttatagaaaaaccatttcccacattaaaattttgaagttatatataaaaaacacttgaattcttgagtatatattatttttttaattctcagtaagagaaaattagaatgtttgtcccacagatgcaaacatttagttagaactaaatctagtaaattgatcattgatacatttgattgctctgaacagaagtttagaagtcatggttgatatattacaaagctaaattatttttttcacttccagtctttgttcagagatttgcaagaaagtccattcactgcttcgcatataatttggggtattatcagtagtttgtttttagaacagtggtactgtgtggttcagaaatttgtaaaagccaagtgttagggtgtttaataacagtacattgtaagttctttgaggagctgggcacggtggctcacacctgtaatccagcactttgggaggccaaggcgggcagatcacctgaggtcaggagttcgagaccagcctgaccaacatggagaaaccccatctctactaaaaatacaaaattagccgggtgtggtgacgcatgcctgttatcccagctacttgggaggctgaggcaggagaatcgcttgaacccgggaggcggaggttgcggtgagctgagattgcgccattgcattccagcctgggcaataagagcaaaactccatctcaaaaaaaaaaaagttckttaaagaagtttagtttcgtatattgactaagctatagggggaaaagccttactgtgccttttccacttcctacccactcaagataacctaagttggcttcctttatttaaagtgttaaatctactctagagcataccaaagatattttgaaaatataggaaattcttaatgcatttaaaaggaactacttcccaatcagtttttttcccatcatagaagtaatgtatactcagagatatcttaaaaaacaaggaaaaataaaaaccaaaataaccccactgaagtttcatcactaaaagacaatgtcgatatagcatttagaatgtttgcctgttcctccctctcatgatggattttaatatttattcaccaaatgtttattgtactcctatgtgcttgaggctgtctcaggtagcaaatagagaaaaaaattctgcccttgtgaaacttatgtttcagtgggatcataggtgtatgtttgcaattttatatcctgaaaattttataattcagtataacataagaattagtataaatatttttaatagctgcttgacagttccttatgtgcatatgccataatttccttcatttccccacagtgttaagtatgttatttttgctattgtaaatatagtgggcgagggtcttactccacaaggttgtaaccatgaaataatatttctgttttatgaaaaccaaatttaatctgtgttgtatccttacctaattgagwtggccattatttccctgcacaaatccccctccctctaatccttggtgagcttcttacattccagaactttatcaggaaagggctttcctccagtctttcacctacaccgcttgtcattgacatgcccatttatgtaagtctggaaggtttctttaaggcctcgttacagagaatattgggtaataggatctttgcacaattttccgaaggaaagtttttaccattattgtctctcccttctccctgcagctcccaaggagggtgagtgtattgatcttttctggatgaatcctctaatcccttcctttcctccagcatctacctctcaaactccattctcatcccctccctcttgagtataatccaaccagactccttcctttgggcctggactttctcagacagaagccagctgaggagactgtcttctaattgctggttctaaaataacagtcttgaggctagaggcccacaagggcttggaataggagaagggaatttgcctacttagccttgtgaacaaaacactgatcagtacctcagatttcactgtttagaactattttcttaggattaaatttcagaaatggaattactggttctaagggcatgataagggcatgaacatttaaatactttctattcattgtaagattgttttccagaagagttatatagattttcagtgtcccaagtgagagttcttattttattaaccccatttatcaatactgttaaatatttcataaactatagtttatgtctgcagaacttcccccatatgctttgataataataactaattgtatttcctcttttgtcttttgttatatttttgccttcaggtgcttttctcccctaaccagttttcataagttccttatatcagaatgaatccttttatattttctgcaaatatttttcaatgccgagaatttaatgtcaatagtatatcactgtttataccatcaaattggttagtcatcttaattctgtttttctttttttcatttaagtatagtgaatctttgaacttgataggtgaatttctggttttttatcttcttgatattggtgtttaaaatggatttatcttcatggawatatttatgttatagtattaaaatctgaaattgaacttagtatacaaaaaatagatttttaaaatgtttatactagctccttatcaatgtttaaaattttgcttttgcagttacaataatggttattcccttatttctgtatttactagtagagagtaaattaagacattactgaatacaatgagataaatggcttatcaagtaatagtctttcttgtaacacaaatgagttcttagatcagttgtctttaaatttgtcttgttatggcaagttgtgttttcagtggcaactttttttagggcctaacgtaaagtttgatcagaagtttgacgtgtaatcccagcactttgggaggccaaagccagagaggatcacttaaggccaagaatttgagaccagcctgagcaacatagcaagacctcatctctgcaaaaaaaaattaacatattagctgagtgaggtggtacatgcctggagtcctagctatagttcaaggctgcagtgagctatggtcgtgccactctactctagcctgggcaatagagcaacaccttgtctcaaaaaaaagtttgagctatgtatgtttgaagggcttgtgttctcaaawtggtgagaaaagggtggcgatttgatactatttatgaaccagacactgtgttttatatatattctcttttattcttgtgtcatatattcttatgtcacctgaatgaggtatcagtcccattttacagggtgaagagactgaaatgaagtaatttgccaagcttgtgttcaacaaacgtagaagtggcagtggagcctagatcattcttgtttgtttgtttttcatttttgttttaaaagctgagcatgcttctcttcaaactttatgattaccttgtagtgcacgttaaaactaatagctcaggttgtctgtgaccccaaagacaataaagacaggatctcattctgtggcccagactggagtgaagtggcaggatcatggcttactgcagctttgaactcctgggctcaagcagtccttcccctttagcctcccgagtagctgggactacaggcatgtaccaccatgcctggctaatttttaaaagtttttgtagagatggggtcaagctatgttgctcaggctggtctccaactcttggccacaagtgatcctttgcctcagcctcccaacgtgctgggattacaggtgtgagacactgtggcctttttcagttttcaagctgctgtttgttgttacattttaaaaatgtgaagttaaagtcagatctctgtgtgtgtttgtgtgtttgtgtgtgtgtgtgtgtgtgtgtgtgtgtgtgtgtttcttgagatggagtctcgctttatccccaggctgagtgcagtggcgcaatcttggctcactgcaacctccacctcccaggttcaagcgattcttctgcttcagcctcccgagtagctgggactacaggtgygtgccaccgtgcctggctaattttttgtatttttaggagagacagggtttcaccatgttggccaggatggtcttgctctcttgacctcgtgatctgcccgccttggcctcccaaagcgctgggattacaggtgtgagctaccgcgcctggcccagatcttaatgtgttcttgctctgcgtggtgtttgtacctgggctggtgctttgggagagaagttgcattgtatggttgtccaaggacttccaagaagacagtaaaagaaaattaagatttattataaattagaatgtgaactatagagaattgacccatagtgctatgtttgagtcataataactgactagtgtttacaaagacttattcacacagagtagctattcattcagaagtgttgaagataaaaagactgtactaaatgacctcttggtccctttattgttactattctgtgatttattgagaattatgtgtatatttaaactcattccatgatgtgcagtgttaactttttagttacttttcttattggataaaattagtcagcatctgtgctttttttcatttggagggattttttttgtttttttttttgtttttttttttgagatggagtctcgctctgtcaccaggctggagtgcagtggtgcgatcttggcccactgcagcctccgcctcctgggttcaaggaattctgcctcagcctcctcagtagctgggactacaggtgcacgccaccacgcccagctaatttttgtatttttagtagagacagggtttcaccatgttggccaggatggtctcattctcctgaggtagtgatgtgcctgcctcggcctcccaaagtgctgggattacaggtgtgagccaccgcgcccagcctggaatttttaagtagctaaagaattagatttgtttttatgtgaaagatatgattttgtcatagagttaggcacttgtgttactttggaccaaacgtagtctgctagaattttgagatagagctagatatgatctaccatggaacataattcagctatgtaatttcttaagtactagtatattatgaactgggaagcatttgaagagaaacagtgaaagcaaagctcctggtatttttcatgaaatgacaagtggtaaatagtatctattaaaattcactgtagttgctcagtgaaacacatcaatagctacatggtagctatttaagaaaaataacttaccacagactcaggaaactttacagtgtttgacttccaacagtttacagtatttatcatctgtgtttgtttgctgttcagatatggtagattcgtcatattaaacacaagcttcatgcggtaaatgtgactctaaaacataatccaaaactttggcagtggatgccttgttactttagaaagactttaaacctcactttgtatttagtgctctagctatcaaatctataagtagtagctgagtcctggttacttaaatgatttaaatgatgatattctcacctaaaagggctcatttaccaacctaagcaatttcacctttttgcttataattagggttaaattgtgcttaaactgtttacttgacctgtgggaaaccagaagaaggctactcccttatactactgaatgtttagaattttaatacctgtgattgtggtttgatgttttagttttaaaaggcattgaaaatcttgaaatttatgtaaaattctctttttaaattttttattattaatttttttttcgtcttttcctttttctttctttttttctgagacggagtctcaccctgtcacccaggctagagtgcagtggcgccatcttggctcactgcaacctccacctcccgggttcaagcagttctcctgcctcagccttccgagtagctgggattacaggcatgccatcacgcctggctaatttttatattttcagtagagacaggctttcaccatgttggccaggctggcctcaaactcctgacctcaactgatccacctgcctcagcctgccaaagtgctgggattacaggtgtgagccaccgtgcccggccaatgatcttttttttttttttttttaaagtcattcgtagaaattggaaggaaatatctatcgtgctaacattcattagagtttaagattatgaatgacttattaaaatataaaatgataaggacagtacrtgtaaactctagaacgaattttaaattcttagtaatactggtaatagttattaatacaggtatgacttctctctcgtgctgtttctggtgaacaccaccacagggtcacagtaaggttctaaaaatatgagcaaaagctggtactaccaggaaattcaaattccatacctgggaatctcagaactcagggaggaataaacattacagggggagcaaacaataatggggagtattgtttgagaaataagaaattaagaattttactgctctaaaatgtaaaagtaaaacaggtgaagtctggattttcttttgtttttatgaagttcagtgggagagcattctcttctgttaaaattgccactaattatgtgttttttctaaatcatattgtctncttttctccaaaacagttgaataatgtactcattttcataaaattttagaaaaattagtgagtaaatttttggcagttattttatttgacatgtgagtggtatttgcyttcagatttcgaattccctgttgggaaagtaatatggttatgttgctgtgactataatattaaaatgcacagacacactataaattccctttcccttaattttctttgcctttcttttctttcttttcttttctgtttttttttttcttttttttttttgagacatagtttcactttgtagcccgggctggagtgcagtggcacgatctgggctcactgcaacctcygcctcctgagttcaagtgattctcctgtctcagcctcctgagtagctggaattacaggtgcgcgccgcacctggctaatctttgtatttttagtagagacagggtttcgccatgttggccaggctggtcttgaattcttgacctcaagtgatccacctgcctcaccctcccaaagtgctgggattacaggcrtgagccaccgcgcctggctcctttcccttaattttctgaaagaaaaattcacatacagccgtgtgaattgactggactgtgaaattaaaataatggatttttttggtctttatactgcaagtttgagaaataaagaacaaagcattttctctgtggatgcgaagaactctgtacttgactcagcttcctttttctcttgcctgcattttttgtttacttcactggcttgattagtcataataaggctcagtacctctgccattcccaatgttaagcaattttttaaaatttggaattttgtggataatcattaacagagttgcttaatgggtaatgttgttttctttatggaaataatttgaggcaccttttctggggttcttggcaagaaatatgagtttattatggatatttaggaaagaggatgtagaaataaacctttgtttgtagtatgaagctgtgataatctgccccatctttgtctaattccgttttaacttctgtccttaacatgtttctcttcttaatcagttgtcagtgaagatttatttatcaggagatgggaatggagtattttggatatacttcaagttttgaatgataaccgttaaaatacatacaatgttttaatagtgagatacactgatcacaaaaatatggtctgatttaactttattttgtggtacttttcttctaagtttagacagatgatagaaattcacaaaaatttcagtcatagttatggccacagttaggcattcccaaaggaagtgtgttgcattcctaagtgtagtgtgttgcatgcactactgagcataatgggaaaagaaaagtgctataaaaacctaagtaccaagtaactagctagaaaaagcttttaatgggagagctggcatggtcattaatctggtagaatagtatttgaggaaacagttgcatgtgttaagctgcagtttcttttggttattgaaaaccaaataggaarttctgaattaatacttacatgctgaagtatctttgtggagcttattttgagcgttagagtgggagactkagttctaatgcaaactatagaagaatgaccttgggtaagtttgttgtctaattagtaaactgagtggtagagttggataatcctgtcagctttaggcccatgccttaaatatgcttcttatcctctcacagtcaaaaaggatttttaccttggtacagtctgattcctgcaacacctctctagttattgaatgtatagtagtttgctatagacagactactttgcagtggctatcaaacctttctgagactcattctaagaaatacatttacattgtgacttagtatatgcacacataaaaagaagaaagtttcacaaaatagtttccttactagcaatgagctgttttttgttttatttcgttaacaacaacaacaaaaactgctaaccatctttttcttggggttgcactactgtccaatgagcacatagtgagggcagtacygctaacgcctacataacatgcctgcatcatctagagctttgctttaccttggtacaatttttggaagaatgaaaaactgcttttccacagggggaaaatactgtttactgcccatctttgaaaaacattttacttagagcataaacttgaagctagatccttttaaccacttaattaaatcatacagtaagttgttgatagctatttgccacaaaatgaaaatatagtggctatatgaattttagctgctgtcactgttcattaatcataacataagctctgaacacagtgtttcttcttagaaaggtacaaatgattatgattttgtataacaactgaagttaggtgtgtgtgaagttttataattgctggtcttcattagataaattaaattataattaaatgatctgttttatttttgctttttatttggtctcttattaataggcacaatactggcattagctataacacaaaccaatggcactaaaaatcttcagaacctttttggatttgagtttttgaaagatattttgtggagactacagatttaattttaaagtataaatatgctcttattttaaataaatggggtttatactttgtgttctaatgattgagataacttttttttttgagaacttaaattaaaattcccagtcttctctagttctgtcagatttctttgttccccctcccagtggttgagttcttatgggatttgtggcttatttttaaaatccaatgattaaaatgaagttttctggcaatattaatatttgtgtgaatctggatatcctcctcacttaacttctaaggctttttcttcatctgaaaatgacaattttgtatacttggctggattattttaagtaacaagtaacaaacactgtggtagactaacatttgagtttgaagtttcatataattttaaatcattgtcatcgactgactttggaaagtaacttctgagatttttggtctgaagtgaccctgaaagtttatgacctaattatcattttattaggtctgaatgtgaatgttgcactttgagaggaaatagtatagaagtagttacattgctgggtgactgatctagcaagtccctaacagtgccattaagctgtcctgtagtacatcttatttagttctctcaataactacatagtatgttgtcagtcctattttatagatgagaaaaccaagggaacaatttgatagaataatgtttccaaaatcagagatctaatcttagaaggcttagttgaataacattggatatattactctgcggttcctaagtctrtgaattaatgggaattttgaaatctaattgaaatccaaggagaaagtgatagaaataaaattgtagtgagcgatgtcggctcactgcaacctccacctcccaggtttaagcgattctcctgccttggccttccgagcagctaggattacaggcatgcaccaccacgcccagctaatttttatatttttatagagacggggttttaccatgttggccaggctgatctcgaactcctgacctgaagtgatccacctgcctcagcctcccaaagtgctgggattacagacatgagccactgcgcccaacctagtttaaattttctagtagccacatttaaaaaaaaacaggtggaattaatttcatgaatatgtttcatataacccaatatatatccaaacatagtttctttttttttttctgagacagggtcttgccctgtcacccaggctggagtgcagtgagtggtgcacgattatggctcactgcagcttcgaactcctgggcttaagcgatcctccagccttagctttccaagtagctgggactacaagcacgtgccaccacaccctgctaatgtttaaatttttttgtagagacgggggtagggtgggtctcactatgttacccacactggtctcgaactcctggcctcaagtgaacctcctgcctcagcctcccaaagtgctgagattataagtgtgagccaccatcctggcctaaatatctttcagcatataatcagtataaaaattataaagatagtatatattcttttctattacatcttcaaaatctgctgtgtgttttacacttaacatatctcggttcacaccagcaacatttcagtgaagtactcaataaccatacttggggctgggcgtggtgacacatacatgcctgaatcccagcactttgggaggctgaggtgggaggattgcttgagcccaggagtttgagaccaggctaggcaacaaaccaagatgctgtctccaccaaaaaaaaaaacaaaacaaaaattatccaggcacagtggcatgtgcctgtagtcccagctacctcggaggctgaggtgggaggattgcttgagcccaggagtttgagaccaggctaggcaacaaaccaagatgctgtctccaccaaaaaaaaaaaaaaattatccaggcacagcggcatgtgcctgtagtcccagctacctgggaggctgaggtgggaggattgcttgagcccaggagtttgagaccaggctaggcaacaaaccaagatgctgtctccaccaaaaaaaaaaaaaaaattatccaggcacagcggcatgtgcctgtagtcccagctacctgggaggctgaggtgggaggattgcttgagcccaggagtttgagaccaggctaggcaacaaaccaagatgctgtctccaccaaaaaaaaaaaaaaaaaaaaaaaaaaattatccaggcacagcggcatgtgcctgtagtcccagctactggggaggctgaggtgggaggattgcttgagcccaggagtttgagaccaggctaggcaacaaaccaagatgctgtctccaccaaaaaaaaaaaaaagtatccaggcacagtggcatgtgcctgtagtcccagctacctgggaggctgaggtgggaggattgcttgagcccaggagttttgagaccacagtgagccatgattgtgcccctgtgctccaacctgggtatcagagcaagactcccatctctaaagaaattgtattttatttattttatttttacaacccagatgtgtgaatcttgaaggaatttttttttaattggctaatggctactattactggacagctcaatttctgaatgccaagtacctcttgttaaactgttcaacagcctttccctaccatctcaagaagttggtgataaaaattatcaataatgaattacagttttttaatttttgcctttgatgygattgtcttattttataatatgttagcatttaatatgaatatttttgttgacatttattttttatttttaaaaatagcattattgaagtatagttgacataataaaatgtacatatttaaaaggtacaaatttaataagttgtccacatccatgaaaccatcaccacagtcaagatatttattactattttcctgaagtcttccctcctagctgtgcaaatctcctgtcactacattaaaacttttagatattcttcttttttggagataacctctcttaaacttctaaacttcaccatttgtactggttgcattctaggttgatgcttaggttggggatcttcattcattctmattttggagattcttcttatatctagctggtttttgatcctgcttccagaatcccatttctttctctttcttggtctcctcatttgtgaaagaataacttcataactctttgagaaaggtcatttgggagataaatgtatttttgagaacttacatgtctgaaaatattttccttcatcttcctttccctttcctctttaataggtagttcggataacaaattctagattggaaataatttatttcagaattttaaagacatttattctattttcttctagcttccagtattgctgttaaagtctgaggctagtaggattctctgttccctgtaacctattgtttttttcctctggaagttttcaggttttttgtcttgtcctcagcgttttgaaatttcagcaatgtgccttggtatgggtctcttttttccattgtggctttttgtctggaaactcactggccatcaattctgaaaatttaccttctactcatttcatttcttgccctctgttttttatgttgccccttccagaactcctgttacatatatgttggttctcctagaccaatggtctaacgtccatatcattttctcccccccccccaccccctcgaagtggagtcttgctctgtcacccagagctggagtgcaatggtgtgatcttggctcactgcagcctccacctcccaggttcaagcagttctgcctcagcctcccgagtagctgggattacaggcacccgccaccacgcccagctaattttttgtatttttagtagagacggggtttcaccgtgttcgccagggtgatctggatctcctgacctcgtgatccacccgcctcagcctcccaaagtgctgggattacaagcgtgagccaccacatgaccctgccttttccaggttcctttttttggttgttgttatttgttactgattttagttgctctttaattttatttatttatttttttgcttcccatgtagattggatgctctttaaagacttttttcaagtaatcccatgagccttggttgtcgcatttgagttgggcactgaaaactgataaataaatgcggtttgctgattgtgggccccagtataatctgactgtactgttctggcatcttatgaaatgcagatgttgggatctttagagctgttcatttatgctactcagatccctagttttatatgccaaagtataacttatgctttatgtgatttccactttagagattttattaaaactttttatttatagtctaatgtatgctgttgtaaaaattgaagttctatgtttatttgaaaatagtatttattaagggaaaaaatctgtatttgttaattgtattgcttaaattccatgtatttttgttgccttagactacttgattagctgatatttgataaacgtgtcagccctacaaaataattgtggatttgtcaatttccgtttgtatttctaacagtttttatgttatatattcatagctttatatttaggctgggttaagcatgaatgttatatacgtaaataattgtactttttatcaatataaaatatgcagcattttctcaaataattctctttgcttaacacattccctttttatattgtcattcttttttcacatttgttttatttgttcctctatcttcccttttttttttttttttgagacagaatttcactcttgttgcccaggctggagtgcagtggcacaatcttggctcactgcaacttctgcctcatgggtttaagtgattctcctgcctcagtttcctgagtaactgagattataggctcctgccaccaggcctggctaatttttgcattttagtagcgacagggtttcatcatgttggtcaggctggtgtcgaactccttacctcaggtgatccacccaccttggcctcccaaagtgctgggattaccagtgtgagccactgtgcctggccctttatcttcttttttatgtcattttaattttgatgtgtttcttataaataaacagtgtttagacttttttttaaagcctgttccacaggttttttgtaatagagaactttaacgtacatttatagtaataattggtatgtttggagttggtcttcttcctgccttctatgtgttttaattggtatgtttggagttggtcttcttcctgccttctatgtgttttatttctgccttgcctttcttagatagatttattttctttgcattttacacctagtagtctatcttttatgtaattttcattatttaagtgacttaaatgaaattatgtatttttcattgttaatttttaaaacacctacatattagactataaatctactttataaaaataaaattatttctctacttttataggtggtattgtggaatggcaaagcacagactctagaacaaggcagcttctgtttacaccttggcttggctttgccacttttttattgtaatcctcttgtgcatccatttcttttttggttaaagtagagatggggtctcactgttgctgatctgaaactctgggctcaagtgatcctcctgcctcagcctcccaaagtgctaggatttcaggcgtgagccaccaagcccacgtaggtacctacttcacagaggtgttgttgagtttaaatatgttaatatatgtaaagcaccagaacagggtctggaagtcaataaatgttagctattattaggtgtcagttattaacaaaagcttgaaactacattattagcgtagttcttgtgggttcctgtgtttaatgcttgcctggttcttaacctatattagctttctgtgtgtttaaaaaaaatctttatcttttgtgtaagtcggttttccttattcttacacactttaatgtatgtaggctgctctgttgtaaagaccatctgtcttctgctgggctgaggacctctgtgcatttccactctttgaccatctcaggacaggcacaacaaaaaaatgttaaaaacttggatgttgtcatggatatgtggatgctttacattgtgtgtgtgtgcgtgtgtgtgtaattttagtgtgaaaaatggtatcaggtttctccaaggcaacaaaaccattaggagattttgtatataacagatagatattatatgtaatttcaaggaattagtttacttggttgttggggctggcaagtctgaaatctgtcttctggttgagctggccattgggttgggaactctagcacaggagctgatgctgcacctttagccaggatttctcaggaaatcccagtttactgccttgtaagtgattagatgagacccaaccacataattgagggtagtctcctttacwtaaagtcagctgattgtaggtttaaccatatctacaaaaatacctttatagcaacacctagttagtatttgatagaataattgaatactgtagcaaaattgtaacataaaactaaccatcacagatgagtatattatttcacaatagattgtccttcatatcagcttcttgaaattaaaaaaaaagctactgtgtgtaatactatatggaaattaaacattgtccatatttttagtaaaataataattcatacttatactctgctaacatgagatcaacttatgcactaatggaccatatttctaaaagtttgtgagttgtttgttgacttaagtgagaaaggcctgtaatgccagtaccggaaatgattgttcccagaataaccagcaaaagctgatacccagacagtatatctgaaatatgttacatatgaaaaatatatttaaaaatgaaagtgagaggaccgggtgaggtggctcacgcctgtaatcctagcactttgggaggccgaggcaagtggatcacaaagtcaggtgtttgagacaagcctggccaaaatggtgaaaccccgtctctactaagaatataaaaattagccgggcgtggtggcagttgcctgtaatcccagctacccaggaggctgagggaggagaattgcttgaacccaggaggcggaggttgcagtgagccgagatcgtgccactacactccagtctgggtgacagagcaagactctgtctcggggggnaaaaaraaaggtaagtgagcaaacatctgtttggtgccagtaatattaatagtttagactttaacctttgcttataacagtttttgtgggaaggtttattagttggttctcaaatgtgaaggccacatgcttccttcaattaaggcataataatgaaaggacatactgaggctacattacatctttgttggtgaaatcaggagtagaggaaagggtagaaactagaacagatacagattgggaagtggagaggtaagattcttakcccataattttcagagaaagtagttgtttgttgatggcaccaaacagggctcctgatttatgataaagaatcatanatttggtaaaagttacagtctgaagtacaaaaccccaatgattttccattctagtgcttcagtgagaagcttaacagtgtactatgtataggtagataagaataaagtaaaagacagaattctttgctgttaaaatgaaagaataacttttacttagcatagtatggtagtatactaataaatggtacacactgctagtcataaaatttagattttgtccccagttctacctgtatacctgtattattagtcctttgttctctgttcagtgtcctagtagaaactgtgtggttatactccttttttttttttttttttttgagacagagtctcgctctgtcactcagactggaatgcagtgattcaatactcactgcagcctcaaactcctgggctcaagcagtcctcccactgagtagctgagactacaggtgtatgccaccaaacgccaggctaagttttttaaagaacttctgaaagcatagagttttcaggatgtttttataatatttcatagatggtaaggcagtgtcagattgattcagttatgtcatcaaatgtctctctgccattctcagcatgtatttcaggctaatgccccttatggccctattttcagccatcacatgcatcctggatagcattcagcagcagaagcagcaatttctttaacaatgcttcatatcttactggtcagagttgtgggtcacatggctttgtctagatcaaatactgaaaatggaacttccatgattgggttaggccagttatgactgtcttgacaggagatggggcttgcttttcctctagtacaagatagatacttaaaccaaataaaggattatggttagcaaggaggagggggtttgggaatgacccagtagtagactgccaacagtgcctgctacttaactcactcttgcgagatggggaagtaagatagtcttgagggttggggctatagtagaatagaaggaaatgactttttggagaaagtgatttctttttatcttttcatgtttttattttttattacattttgttttttacttagggatggggtcttgctatgttgaccaagctgatctcaaactcctggcctcaagccatcctgtcatctcggcctcccaaaatggtgggattacaggcatgagtcaccgtgccacatctggagaaagtggtctgtaaactaagttttgtggacaaatggagattattagggagaaagacttttccttatccttctgagcccttggttgtctatgggtactgttgcttgttttcatttttaaggatagtaaacatacttaacatttcccaaggaatctgtcttgacctgtgtatgtgtgtgtaaaagctgcattgtggactttttgaaaaagaacatataataaccagttcagttgaatgcaacgtgctctgtgagattaagggctcacaagaaactgctaatcacagttttaaaaagacaatcttttgatgtctcatatcttagtgttactatgagtttatagcctgttattttgtttagtgtttactctgtcttgcctttcttttttccttccttcctttccttttctttcttttcttttggaagggaacttaagtacatcttctggttctttctgcctgatctcttcctcttaattttagaaatgaagatgtagaagtccaaagaggatttacttgatgatttgactagaaaagctaggtttaaccaggtcttctatggaaatgaattatagctgtagtgaaaaaataagggaaatgtgctatgtttggattctagagacagttctctagaatagaaaatcttctaaacccaagacagcttgatatttgaaaaagggggtataaaacctttttttaaggattggcagatcgtagtaaatattgtggatgtcatagtaccacaatatataataattaagtaacatacttagaatagaaatctagaaatgtcagtaacagaattttactatttctctcaccacacacacacacacacacacacacacacacatacacaaaattatgaacacataataaaggacttccttataactaagaaaaagataatacatgaatagagaggcctatctggaaattttcatgtatatgcacaacatttcagtgataacagagtggctgttataaataatgatcgtaaagtgcggttataaattatatcatgtatgtgaaaattattttttgtacagtatggttctttatctaaaacgtagatctttgcttttctataataacattctcttctaggtttcagcttatacttgacgcaagaggttctttgagagagcttcttttttaaaaaaaaaaaactacatttcctattacattttatatctagcctgccaccctaagatggaaatccattttagttcatcaggtatttattaatggtttcactttgtgaaagatattgaagagggcagataaaattgtcatttacagcttacttagcatagtacattgtgcttaaaatatatgacattaatataaatgatgccctttcttgataattttttttatctctaatcttaaattgggggatgatgtttctttttagcctttttatttttatacatatggttgtccaagagtcatgtattaacccaggtttagaacacatcataatgtcactgcctccacttcccagactccaatagggaatagcagctttattctacccaggtcctatcagagggtgcacaacagatgaggggaattgcaggatttcccagtacaccaaactgttggtcagccttcctgcctttattccccatgtagacctaaatacagaaactttttaattatcttggttatacctaaacattgctactcccctacgctagccccgcaaaagtgagagagcttgtcaaggcaaagttttttgaaggaagaagccacatgaaatgagagagggaaataatgtatactgtgagcttaggaagagcaaaggtataaaggtgatagagagattggcacagaactacagtagtatatgtattagttctgattaataaatgtttcaatttttatgatactgttattctttttttttttttttttttttgaggcggagtctcactgtgtcacccaggctggagygcagtggtgcaatctcggctcactgcaacctccacttcccagcctcaagtgattctccctgcctcagcctcctgagtagctgggactacaggcacccgccaccacgcccagctaatttttttgtacttttagtagatgtggggtttcaccatgttggccagcctggtctagaactcctgacctcgtgatccgcccacctcagcctcccaaagtgctgggattacaggtatgagtcaccacgcccggctgatactgttattcttgtaacaaaaaagcttacaatgaggaatacatttatattgttttgcttaagattaaagccatataaaaaatttacagcagaacctggaagttctttcttgaccctaacctcctttactcctttgcccagaggcaaccatatatttgtatgtatttccaattcttcatgcttttacacaaatatgtactcacattaaaaaaaatatatataaacatattattctatgactttttttttctttaattcatagagttcttaatcaggtctagtgaactcaggacaagagacacaacttggatataaatacctttaagcctctgttttcttcatgtgtaaaatgagggtaatgttttagtgttattacaaggtttaaatgagactacatgtggacaccttagcctggtaactaagtcacggtagctgctattattaataaacaaggctaacatgcttctatatgatcctcctgtacctaagaaataaacttatagcaatagagcacaatcagccagccatttaattttagagaataacatcttcatgtggcctagtaaaaatgactgttaccaaataataggctttttatgatgaatgaatgagtcagatgttttctctgtagtttttagaatcattgagataccaaattcttagctgttttatggaagaactttataaagtagagtttactgaagttgggtgactagaaaagcctataaagttaaaaaggagaaaacgtgttggttctcctaattaatgtaaattaaaacaaggagactgcccacaagagctaaatagtaaatttcggtcaaaaataatgatagtatttcttttttcaattggtagtaaaacattggaaataattattccaaatgaaaagacaggttgataacagttttcaaaaggatcaggataatagagattcatattgggtgacggtatggttttagaactgtcttccctattcttcctaaatgaagtgggccatttcttctcactatatgtatattcttgtctggccctgagacagaacactggattagaagcactataggttgactaaatatggcagttcttaaatctatatgatgatagtttgcattattttattgttaacttaccatttgcatttttataaacagctttattgagataattcacatactatacaattcacttggttaaaatatacaattcagtggtttttaaagtatattcagaattgtgcaaccatcacagtactaagttttagaacattttaatcacttcctccaaaaaaaaagaaaacnccatttcccctcaactcttccagttgtgtggataaccactaacctactatgtctctagatttgcctattctggacattttatataagtggaaccatataatatgtgatctcttgtgactggcttttttcactcagtgtaatgtttttaatgttcatccatgttatagcatggatcagcacttcatttttatggttgagtaattaatatttgattgtatggagataccattgtgtttattcatcagttgattgacatttgtgttgtttcccgttttgggttattatgaataatgctgctataaacgttcatttataaggttttatattaacatatacttgaatttctcttgagcagatagtaaagagtgaaattgctgggttatatggtaattctgttgaaccttttaaggaactgcaaacctgtttttcaaggtgactaccattttacattctctacagcagcgaatgagggttccaatttctttacatcttcatctgcgctaataaggttaagcataatgttagctgtggggttttcctagatgccctttatccaactgaagatgttcctttttcctagttggttgaatgttttttttttttttttaaatgaaagggtgttggacttcggtgctttttctgtgtctatggagataatcgtatgggctttgtactgtatggggtgtactacactaatttttggatgctaaaccttggattcctgggataaatcccatgtggccatgggaaataatcctttttagttgctggatttggtttgcttgtattttggtgaggatttttgtgtttgtattaataaggaatattcttcttttaaaatatttatgtattcatttattagagacagtcttgctctgtcatcttggctggagtgcagaggcacaatcatggctcactgtaacctcaaactcctgagctcaagcagttctcccacctctgtctcccaagtagctaagactatgggtgcgtatcatcgtgcctggctaatttttttaaaaaattgtgtagagatgtggtcttgctgtgttgcccaagctggtcttgttctaacctcaagtgatcctcctgccttggcctcctgaagagctaggattacagtcatgagctaccatgcctggccaagatactgtcctttagtttccttgtgatgtttctatctggcattggtgttaggttaatactggcctcatagaattcctcttatattttttggaagaatttgtgaataattgatgtcaattatttaagtgttttatagaactcatcagtgaagtgatctgggcctgggcttttcattgtggaaagtttgttaaattactaattcagtctcctttcttgttataggtctattcagattttccgttgttttttttttttttttcttgagtcagtttctgatatggtttggctctgtatccccccacccaagtctcactttgaaatgtaataatcttcatgtgtcagtggcggggccagctggaggtaattgaatcatgggggccgtttcctccatactgttctcatgatagtgaataagtctcagagatctgatggtttgataaggggaaactgttttgcttggttggttctcattctctgtctgccaccattgatgtaagacatgacttgctcctccttgccttctgccacgattctgaggcctccccagccacatagaactgtgagtacagttaaacccagtcttggatatgtctttatcagcagcatgaaaacnaatacagtttctatagttcgtgtctttctaggaatttctttccattttatctagatcatctactctcttgctatacagtttcttgaagtttgcccattataatactgatactgttgcttactgttttctctttgttcctttaaagaaaaaaatttttatgctttgggggtcatttaacatttctctttttatccattggcttaacaagtatcttcttttctccttcttctttttgagacagagtcacactctgtcacccaggccagagtgcactggtgcaaatctcagctgactgcaacctctgcctcccgggttcaagtgaccttcccaccgcagcctcttgagtagccctccaccatgcccagctaatttttgtatgcgtttgtagagacagggtttcaccatgttgtccaggctggtcttgaattcctgagctcaggtgatctgcccttcctggcctcccaaagtgttgggattacagacgtgagccaccactcctgaccatgtatcttatttttaattttttttagtggttgctcttgtgcttataatatacattttaaattaatctgccttcaaataatattctacccttcaagattagtataaggaccttgtaacagtatattcttaattcctttattccatctgttgtgctacttgtcatgtatttttctgaagtataggaaccagagaaattataaggcagaggagtaggaaacacatactttcctgtattacgcaataaggagcttgataattggaaagggaaagggaaatgaatatatgagaaattcagaaagaatataatcagaattcttaatgaaatttgaaacctcaggtgatccacccaccttggcctcccaaagtgctgggattacaggcatgagccactgcgcccagctgaaatctcaaattgaagttgaatgatcaatttgggataacttaaatttctttgtggctatagacagatctatttcaagaagtctccctacctaaccatttttcctgcccctaaaaaacaaaaccagaaagttctgagaatcatcctagacttctcttcctcctttatatcttcattttccatttctaatcagccaccttgtcatcttgattctccctcatctgtaccaatatatcaaccaaaaatgatcttcctaagtctaattacacttctctctgttccacaccaatgcaagcatgatcaatcttatgaagatgcaaatctgatcacatcttttaaaattttcggtggtgccctattctccacagtataaattttaatctccttattgttatgtgaagttctcaagattttagtgtttatccaatcttctctcctaccatctcttctaaaattatataaacaattcccagactttattttaagttactatacatatgctgattttcatttccacacccacgttcttctttttgcattcctattaaattcatattcatgaaaataaataaatgtttctttaaagaatcctctcagaaattaatctcttttttgtctccttgttgtacttatacgctcttctcataatgattgtgtcattcttactgtgattactgtgttctttaaggctgtagctataattgttggatggatattgtgttcaataaagattggcagaatttagctagagtttagtaacatttttatgattaccttctatataagagaaacatcagattagtggttttgaatcagtattgtaatgtaaaatttctttataccaataaatttaagttttataaaaaggtagattttgggggaatgttagattttcaaatgatcgtaataatacagcagcaatcctaatgatagtatgcaaattatcggcgttcagttggtgtcaatttcaactttaggtattctacctatgccatacttttatttattattgcatcaaatgcagacaggttctactctctactttgtaagatgaccataatactctcactctcttaaaatcactatctggccaggcggctgtggctcacacctgtaatcccagcactttcggaggccgaggcaggtggatcactggaggtcaagagttcgagacgagcctggccaacaccgtgaaacccccatctttactgaaaatacaaaaaaattagccgggcatggtggcgggcgcctgtaatctcagctactcaggaggctgagacaggataatcgcttgaacccgggaagtggaggttgcagtgagccgagatcgcaccactgcactccagcctgggtgacagagtgagactctgtctcaaaaaaaaaaaaaaaatcactgtctaacctctattctatgtattttacattgtgaagatgagtaatattaatatctgccttctgtcttttaaaaatgtctaaaagtgaaaatcaattgtgtctggctgacatttctctaaggtaactagttatggatagagctcctttttatacttccttgttctgcttcctggttttcctgtcatttcaaattgccttggtttttttcttattgcattttctttttttttttgtttttgagacggagtctggctctgtcgcccaggctggagtgcagtggcccgatctcggctcactgcaacctccgcctcccgggttcacgccattctcccacctcagcctcctgaatagctgggactacaggcaccctccaccacgcccggctaattttttatattttttagtagagacggagtttcactgtgttagccaggatggtctcgatctcctgacctcgtgatctgcccgcctcggcctcccaaagtgctgggatgacaggcgtgagccaccaaagcccagccttactattgcattttcaaagttttcattttcccatccagtatatcgagtcttctgccttcctagggaattcttcagacttttctatcctgctgatctgaacgtactgctttctgagtatgctgcacaactgtcttttttttcctttaattgtgttcctctttttaataaattatttaaaaatctatgaatacatatttaagtgtcttgctagtaagaaaatatgcatgtataataaactttgcctccacatatgaacatacttttcctttttaaaaaaatctggttttgtttaggattctgtttatttcattttcctccttgacactcgtggtatttctccccatctcctagatatttttttggttttggaaacttctcttaatttttactttttctctaccatctattgtacggggatgttaaatagacccttgtaaatatgtttttctgttttgggaagtgttctaattcttggataattttcactccttcatttttccctattctcttttttgggggggcatatatttatatgttggaattcttgtaacaaccttccccccgtccccaactacttgcctgatattttaggttgacattattttgcaagctttcattgaatttytgttttggtgagcatgtcttttttgagacagagtcttgctctgttgcccaggctggagtgcagtggcgcaatttcagcttacagcagcctcaacctcctgggctcaagcaatcctcccacctcacctcctgagtagctgagacctcaggcgtgcaccaccatgtctgtctaatttttgtattttttttttttttgtagagatggggttttaccctgtttcccaggctgcccatgaactcctgagctcaagcaatytggctgccttggcctcccaaagtgctgggattacaggcatgagccaccgcacccggcctgcatgtctgtcattttaagagtttcttctgattttctcacccctaatcattttctcttcttgctttatattacagtatttttatgccttctctaaagtaaaagatttcttttaaaattataaaagtagattgggcagggtggcttacaccttgtaatcgcagcattttaggaggctgaaacaggaggatagcttgagaccaagaattcagggccaacctgggcaacatagtgagaccctgacattacaaaaagtttttatttatttattttttgagacggaatcttgctgttgcccaggctggagtgcagtggcacaatctcggcttgttgcaacctctgcctcccgggttcaaatgattctcctgctttagcctcccaagtagctgggattacaggtgcatgccaccacacgtgcctactttttgtatttttagtagagacggggtttcaccatgttggccaggctgttctcaagctcctgacctcaagtgatccacctgcctcggcctcccaaagtgctgggattacaccgcgcttgtcctacaaaaatttttaaagaaagttaattaggcacagtggtgcgcacccatagtcccagctacttgggaggctgagacggtaggattgcttgagcctgggaggttaaggctgcaatggtctaggactggactactgcactccagtctgggcaacagagtaagaccctctgtcaaaaaaaaawtttttttaaactgaatatttatttggactgaaagaagaaatgacaacaaattataaagttaaaagaagtcatatcaaaaaatcacaaaatccagaaaaaaacatttattaagtaccagacacatcctacttttgcttttccttcattttttggcttcatcttctttgatcacctttttatttggcagtgagtttataatactttatatatagaaaataaaaagatcatatagctttcctctagcattcaggtttttttgctatatgggtgttaataatttttattttaattgcctgctataattattttttattttggtaaaatatataacttaaaatttaccattttaaaaagtatattctatttcctgaattttttgtttctctgaggcaatttcccctttttgatgggaagagtgttttatctttgtgagttctcaagtgtgatgatctgtgggcctgctgatatttaagaatgaggcttaccattaggcaaactctgtatttagagtttgtctgtatttagagctcatagtaagcctcattacttgttaatggtcagacttcattctcaagtgaatggtcagggaacccccaaaataacagatggtaactggttttgttctgggatgttaatttgcactctaatggccctactagttgttttgatatctttagagtagaaccttaatttcctgcctacccaagggtaagcattgggtgatcattttgctgtgcgcacagaaggtgagaggcattgatttgtctgtcctacagattcttcgtttttaaaaatctcatgtctcatttctgctttactggatctcattggtttttggaggaaaggtattggttcctttctcaggtaccctccaactatattttaggctgttacttcttgggccagaatttcgccatttgtatctgctgatggctcctctctcatcctctttattgtttgcatttaatattttatttctgtaactttcttgagttatgttaatggaatctggagggaaagtgggtaacagtaaagtaagctgtttatactgtcattctgaattgtaagcccctgcagacttcttgaatgatattaatgaatgttgagtcacctttcaatatggagggacaagcctgttctttggtgtcacgtgtatcgctctttggttgtttgcttagcagcgttgaaaattgaggaggcagaggtgtatgtatgtatttggttcaggatagtatctcactagcaactcccaatataacctttttttctttgtgtgtgtgtgtgtgtgtgtgtgtgtgtgtgtgtgtgtgtagtggcacgatcacactcattgcagcctcaacctcctgggcttaagggatcctcccacctcagcctacccagtagctgggactacagccatgtgccaccatgcctgaccatttttttttttttttaagagacaaggtcttgctctgttgcccaggctggtcttgatctcctggcctcaagtggtcctcctgcctcggcctcccaaagtgctgggattataggtgtcaaccattgtgcccagcaaaccattcctattttcccactaaaattatcataaaatcaggaatgaatgaaagctccaatcattactacaaatgaaaattgacagatataaagacagaactctgggagtaagtggtactaatgatgaggcagattgaatcagagaaatacttatacatttcaatttgtacaatgtgtatttactttgttttttgagtgatgaccaccaggaggaaaaatccttgtctgtccccattgtttgttcaaaagtcagacctggagcccctgctaaccagaaaattgagcagtcatcaacttcccctcacagtttttctgcatgtaagaatattagtaaaattagggtgatggggaagagggctgtggaaatgggaaactgataatgtacatgtagtataattgggcattattatccaaaatatggtacatatacttctagaaatagtagatattttaggttgtacgtgaatgaacgttttaaagccccaaaatttcttttaataactaacagcaatactaattagttacgaggatgctaaaataggtagtaagtacctgttttatgatgttaaaaatatcaagtaaatattatagctggttattagttttggcataacattaatgacagaaacttgagaaacatttcctctagataaaaaagcttgctagaaactggcaacagtactgctttttacacgtatcacagttgtaaatatgagaagggagtttgacttccacttgtgtgtcagacagcggggtcataaacagtaggtttggaggatctatccttgttcagtatagaagttctattatgattgatatggaaatgactttgacttattgttgaagccctgatactaaacaaatctgatttcgtttgaatctttttttccctctagaagtaaaaaaggacaattaaaaaaaaaatcctttacttaattttcagtttcttctttgaataacaaagtttggaagtatagggggttggaactgatctcttgtcacagagtttaaaggttaagactggggaattttatttgtttctaaatgaaaatgttatgatttacataaatgaaactacagtgtgaagatggacagtaaatgagatagatatttttgaagcagcaactgattttctttttgtcagactctgcagccagcctgaggccacaaataaatgtagtcagaactagtttcataaagttagatggatatgttcaataaataagagacattttccatagtattcatattttgaacatgatgaacaagatttagccaaaaaatatgtgcatattcttatgactcagggacatcacacaaaaaagaaaaaagaataaaattgaagaaattaatgtgtgtattcttttttccctggattgataagcagcttctaaaagtatgctaattcaaaggttagttttatgtattgtaaactgtagttagataaataatggttactttgaaaatccacagtaaatgctgctgatttgacaaggaaatgtgtttagttgtactctaaggatggccttctttgttggggtacaaaattagttcatttttaaagatcataaacaaaatagcagaattgagcaatgtaagtacagaaataacatttatataaaaatcaaagtgcaaaacagtatagtatatcattcatgaataagtaatatgttgtaaaactataaaaatatacaatagcgtgataaataccatattccagatagtggctctggggatgtggagagaagaatagtggtattatttcatagaaaataatctaaaagaaatatggcggctgggcacagtggctcacgcctgtaatcccagcactttgggaggctgaggcgggtggatcacctgaggtcaggagttcgagactagcctggccaacatagtgaaaccctgtctactcccagctactcaggagactgaggcaggagaatcgcttgaacccaggaagcagatgttgcagtgagccgagattgtgccactgcactccagcctgtgtgacagagtgagactccatctcaaaaaataaaaataataaaaaaagaaatatggcaaaacattaagaagtgacaaatatcagagggacatatatatattccacatttctgtatgcttgaaaacatttatgtaaatttttctaatgtgtacagtgactttttaaaagtaatatgctaaaaccaatccattgagtgaaatgacaattggattaaattataacaacaatattaatgcagacaactctattttctagttacacttatcaagagattagtattgaattatttacttgctttgcaaataagaaaatgtaaaattttaaacttttctcttatttaaagacctaagatgaccaatagacactttttctcatgtacctcaagtccttaccaagtataagaagcagaacagtatctgtatcttcgaagctctcagtgtacttctccctagtaacatctccctgcctcccctgtcctgaattttacatttcattttattgtcttaagtgccaagggcaaggtttgtcaaaatcaagtaatgttcagcctttttggtagtgaaatatacataacataaatttaccattgtaaccatttacaagtaacttagaagtatacagttttgtggcattaagcacatttacaatgttgtgcaattactatcatccatatctagaactttttcagcatcccaaactgaaagttttttttttttttggcgcgatctcagctcactgcaacctatgcgtcccaggttcaagcgattctcctgcctcaccctcccgagtagctgagattacaggctcccgctgccacgcccagctaatttttgtatttttagtagaggtggggtttcaccatgttgaccatgctggtctcaaactccttacctcaggtgatccacctgccttggcctmccaaagtgttgggattacaggcgtgagccaccgtgcctggccccaaaccgaaactcttagctcttaaaaactgagtccccattgtcccctttccctggtccctggcaaccttttttctactttctgtctctgtgaatttgcatatgctagatgtacctcatgtaagtagactcagacattatttatccttttgtgtctggcttattttacctagcttaatgttctcaaggttcatttgagttgtaccatgtgtcaaaatttggtacatatttttatattttatatatataattaatattttataaatattttataaatattatatataatataaaatataattaatattttaatattaaataatattcctttatatttatatattttgttttctgttcatttgttgatggacacttgggtcattgtaccctttgactattgtaaaaaatgctgctgttaacattggtgttcatgtatctgttggagtgcctgctttcagtttcttggggcatatacttagaagtgaagttgctgaattgtatggtaattctgtgttcaactttttgaggaactatcgtgctcttttccacattgtctataccattttacaatcacagcagtgcacgaggatttcactttgtccacatccttgccaacacttttttgcttccctactggccctttttttggggaggggcgggtaatagccatcctgattggtgtgaagtggtatcttactgctagacatgttttaaaggaaaaaaggacagttctttaatgtgacttaaattgttaaaacattgtatgtgtaaatggaaaaaatacatatacactccttgtgacttaatgatcttacacagctataacagcaaaaccaatttttagtgtaagtgctaattaaaacctactaaaattaatgtttttgacagtgcaaaccaaattgtggctgtcttcctttataaataacttagtcttatgtgagagtatctatttcagttacaaattataactgcagaaactttaactggtaaaagaattcagagtatatagttaggaaagtttgctgacattaggacgtgccaaactacctatagtcaaaattaattaacaaaattaatgattaatgtgtcaaacttataaattgtcatttaggttatcatttggttggtaatatgattcaaaaaacaaactgcctaatgaaatcttgtggtcacctacatgagccacaatatacatatatttatttttaattaattgtctaagttagaacccaaaattcttttttctgaaatttaaagaagaaaaaaaaattcttttcgccacctctgataatatcgatagtccaaaattaagaaaatgctaacttctcctgatgacttcttcaacagcctatttcagcctgtgaaacatattcaggaatacatatgggagaataaatcaatgtgaatggggtagctgccataaaaataatgttcttaatttgtgtaattattttcagttttcaaagcacacttacaatatgtcgagccctcagaataattcttagctattcaggaaagatggtgttttcattttacaggcaaggaaactaaaactcatggcagttactttagaaataggagtgcaaaagaagaaataagcatggcatgtgagaataacaagagtccttatctgtagtgggttgtttttggaaagtattgagaaataagctggatccaagggactttggaatttggatttgatgtaatggagcattttccaaacttgctggtcataagaaatcccttccttggagactggggccagggtcctagaatcctttcgtaacaagtgcccctgaagattcttgtacttcagcaaagttggttaattatgcatttactatttttgagcaaggagcttggtgtcataaaaatagtgtctgggggaatatctttatctaaagggtaggttgaagggtaaagagagtcatcaggcaatktttattttgatatgacgtagttgtggcttttattagtttgtgaccatggaaatgagatatggggaatcatggaattatagagattgcctgggaagacaaagggaaatagggaatgagtgatttgtggagagactttataggcttggacatatattgagtctttgctcataaaatgtcgtagatatttggaaatctaatttgaattccagaattagtaaaacattacacttaagtcagaccttgccaggcataaagatattgtatatttttatgtacatgctcaatatcgtatattctcaatataaaactcagttgcaggttgcatttgttgtagaaattctgctttcaggttttgtttttcctgactcttcaaatcttctcgctgggcttctgggctagatctccctataaatttgaaatagttattccttattccccaagtaagtatggaaaagagggaaagagggatagaaaggttaagattgagctgataagaagacccttgtggcggggtggggggttggtgtggggagtgggtgggaaggtagtacacagtatttaaagttaacaagagctgggtgtggtggttaatgcctgtaatcccagcactttgggaggccaaggcagagaatcacttgaggccaggaattctagaccagcctgggcaacagagtgagaccctgtctctgtttttttttttttttttccggagattaatgagtcctccctcttttgcttttatttctttaagtgaaagccacatcaggcacactgaaaacctaactctttgtttttatgtactgggcttattttttttcttgatttctttcctgaacaaaatgaaacaattctttgagatgcttgtctttgtgatgtgcacaaccacttttgctttcctgtggtggcagattcttacaggatgacccactaagtttcagtgctaataactccatttgagcttttcagttctgttttgttggtttcccctttggcaaaccctcattaccctattcaaaaaactttgggaactgtttcttccccatttgctgcagagtaacatttgtctctgaagtgtaagatttccttccagtagggagcaataattcttttttttttttttttttttttttttgagacggaatctggctctgtggcccaggctggagtgcagtggcgcaatctcggctcactgcaagctccgcctcccgggttcacgccattctccggcctcagcctcccgagtagctgggactacaggcgcgcgccactacgcctggctaattttttgtatttttagtagagacggggtttcaccgtgttagccaggatggtctcgatctcctgacctcgtgatccgcccgcctcggcctcccaaagtgctgggattccaggcgtgagccaccgcgcccggccgggagcaataattcttctattattattctcattcacatttatctttcctttttctccccttctcagccttcttgctttcttcaggaagacctcctgcaagacctcacctatagtagtttgagtttaaccctgttagctgctttcacattcaaatcaatttaatctactttaataaaaaactttaaaaatttatgtgaatgactaggtatggttctaagttttgctatgcaatagatactgtaagtcacttagtgaaagtagtttgcctttttttttcttttttcttttggagacggggttttgctatgttgtaggctggtctcaagctcctggcctcaagcagttcttctgccctagcctcccaaagtgtgagccgccatgcccagccctagtttgccattttctgttttatttattaatgtatttttatttgttgcctttgtccacatgttctaagccattttctaatagaactaaatgtgttttttttttctttttgtggttcagctattatatgtatctgctacttttagcattaacctaaagcttcctgtatatgccaagtcccaggtattttggaatcccatgtggcttttgtgccctccaaagagaggtggagagaacctcttagactccaacttttacatactcttggcccagatttggggattaagtgaagggtgcctaatgaatagaacctatgcattcgtatacatctggcttgagaaaactgtatctctctcttttttttttttttttttgagaaggagttccactcttgttgcctaggctggaatgcaatggcgagatctcgactcactgcaatctccgcttcccaggttcaagcgattctctggcctcagcctcccaagtacctcggattacaggcgcctgccaccacgcccggctaatttttgtatttttagtagaaatggggtttcaccatcttggccagtctggtcttgaactcctgacctcaggtgatctgcccaccttggcctcccaaagtgctgggattacaggcgtgagccaccgcacctggcctcctatctctcttataagtagacttttcttcttgcttctttgaaacagaaactttttgtaaataaataaagtgtataaaggtgagccatattgggaagaaggggctgatagaggagttagaacaaccaggtaaccagatttttttttcctattcttttgaggaaaaaaaaaaaaaaaaaattttttttttttttggtctttctgaaactggtgctatttcagaatgataggtaaaagtctccatggagaagcaggggatrtgatgccatgtttacctgcccctcccccccataattatgatatcttttcacccattgaggaaagttgggctcacatagactctcttctttatgcgatagaccccaaatttcatctcgtaagagtaccagactggaaggtcataaagaaatctgcagtaggaatttaatctgtagatttggccacataaaatgcaggtgtaatttttatattatacttcaaaacaccttgaaagccatgttagtctttttgctatctttaacagttaagaatttttgcatgagaattattattttgtttctagttgtagtttttccaacctttcccaggccttcaatctctaattctgaagtttttaagaagagttagttacctacagttaatacttctgtcatctttgaattgmtgttataccatataggcctatgagagagttgccagacttaaataattatttatatgcttaatttcttttaacacatagaataattctttaaaaaattgttttctctgtaaactgtaactgaaacccatgctgccctggaaagcaatgttacaaactgctgtaccctctgcctgaagacaagtttttatttctttatcctaatacccaacaacaattagtatcactttaaaagataaaatagaggccsggcacggtggctcacgtctgtaatcccagcactttgggtggctgagatgggcagatcacaaggtcaggagtcccagaccagcctgaccaacatggcgaaaccctgtctctactaaaaatacaaaaattagccaggtgtggtggcacacgcctgtaatcccagctattcaggaggctgaggcagaattgcctgaacccgggaggtggaggttgcagtgagccgagattgtgtcactgcactccagcctgtgcracagagcaagactccgtctcaaaaaaaaaaaaggtgaaatagatgcccatgtcttgctaagtcagtgtggtgcagaaaatgataaggagggagtattccaatattgacctaaaatattttaatcaagaattccagacacttttctccacccatattttgatatgtagagttatcatgtgtggtcttaatttagcagtaaaattttgaatattgcacatatataatactagagaaatttaaatgttaataagacttgaggaccagataattttggggatacagttgttagctgtaaagtaaaaatttcaagtttaatgaatgaaaactagtctcactgctccattagcacaattggtttggaaggtttgcttctgggcaaagtgaacaatagcaaaggatgggattgctactttaaaaatactaaaatatgagggtaaagagagatgtctgtcagaggatgtttaaaatgaaacagcttcttaaaagcaagggacggaagatgtgcaaatggttatgaggtcattgtactaaacattagcattgtgcttctcactccagaaraaattacatcagtggataatctactgagcactgtaatttgggtagtactgagatgagcaattgttttagttgttgcctgacccccaccccacccccagcagcctggaactgtgcatgttatgaagaggtcatgtgacacggatccttggttttgctcatttatcctgtcaaaacaacttaatgtagatggaaagaaatgaacgaaatgaatagaatgggttagctgtatcagctttagtttatattgaaggtaatgaatgctgcaattgggatagtatagtatattaaggccccaggaatatccagctccataatggtgaagagaaggttctaaaaagcaacagtggctaatccattctaagtctcacttgatgttttaatgctactttttgatacggtcttttaaaattttatcattgtattcatgataatttgattgacagttggtaatatttaaacaatatatggttcctcttattttaccttcagctgtaatttagtataaagttcctatttcttttcaataattattatataataacaaacgtggatcttctgagaagaaaattattttagaagttttgcaaaatatttagggtttgtttgttgtcattgaaacatgagctttgaaccaaatcttcatttgtctcttagttctgtttttcatgtgaatttgagggagataataaaattttgtgagtcagttcgtctcacaacatttttctgaggattaaatgaagtgaagcagccaactagtaaatggcaaatacttggcaaaaattatttttaaaaccccaggtgttccttctgatctgtgtcttatgttagttttgatctactttattattgtcttaaagtcttttgggtgctaaaattatgtacttctctaagatattttatgaaatgttcctagattaaaaaaaaaacaatattcagttatagatggaacaagtagacaaactattgaaagaagccccaaattatttgtttaggtttcccccatttcctgctttgttgatgataatctgttgtcatgcatctgtatttctaacttcaaacattaagcaggggttctcagatcccttaaaataaataatacttttcagaaaggataaaaacacttagctatataaagtagcctgtatttatagtatagatgtcttctgggcaaattagagataaaatattctaaatatttctatggaatttttagattgtcattcagtgtattctcaaggaaaattaaatacggatttttgatggcaaagaagtcccccgtttttttccctctatgctttgctataaataagtagttggcagcttttttacaataagcttttacaaaccatttttaaaaatcaaaagctgggacctttgcaagttgatcattctgtatgggttgtgttggacttaactgagactcagaggcccaatttcaattctcatttttcttttaagtcacaggaattttttatccttggggaaatgctaactgcttattaaggacacacacacacacttttaaaggggtattgaggggaaaagacatttatggaattcattcaacaaatggctgttgaacaagtcactatgctaggttgtcaggtgctaaagatagaacacaaaaaggtatcttgtcactgccttttcatgacaaaaagcctctgagggcttattctatgggggataagagtcaatataatgttgcctgtgattaagtgttatgtaagaggcatgtacatagtatccattggttttaatgctattgggcagagtagaaacaggagtagtaacttggtttccttttattacattccttattgggtacttttggcracagagtgagaaccttaaagttcaattaataattgatgtaataactgaagagaaaaattaatgarcaggaaggtagatcagaaaacattgcccagaaagtagcatacagaaggaaatggaaaatgagagagaaattaaaggatattaaggataaactaaagttatacacatactcacacacatttaaaaattgtttaaaaagaaaagaagagttggaaggggaaaaaaagagaatgagaggagacagtgtttagagagatactgagaatttycctgacttgaagacaaatacttgagtatttaagttattgcttaaaagaaaaaaaaaattaggcttcatgcagtggctcacacctgtaatcccaggctttgggatgccaaagtaggaggatcaccagaagttcaagaccagccagtgcatcatagcaagacctcatctctacaaaaaattaaaaaattagccgggcaaggtggcacatgcctgtagtcctagctactctggaggctgaggtgggaggatcccttgagcccaggatttgaggctgcagtgagctatgatagcaccgctgcattccagccttggtcacagagtgacttcctgtcttttaaacaaayaaacaaaaataaaaacaatgttttggttaaagatagattgattttaatcaaggcaaagatagaactggaatttatatttaggtctttgcctccaaagcctatgttcatttcctgacattaaattgcatgtctagcaattgatgacttatgttggatatggaaagttaactgcaccttacaaaaatgagactatatctgagttacacattaacagtaaagatactaaaatgatctcaagcatgaatgtatataatccaaatctatcatttataacttcagcatttgcattttttaaacaccatcgatcatgatttagtaatgtttaagtgtctaagattaactgtctgatttggtgttttatcattttaaaccacattctgttttggtttttgattttaggatcgaaaattaacaaagtctgagaggcagagatttaaagaagaagctgaaatgttaaaaggtcttcagcatcccaatattgttagattttatgattcctgggaatccacagtaaaaggaaagaagtgcattgttttggtgactgaacttatgacgtctggaacacttaaaacgtaagttcatcagtattacaaaagctgaccaagaagtatgagakaatttgattttttaaatttcaggtctaccagtttcactttggttgttcagcctaagaagggaacagtccttccaactgttactgtattagcatatttccttgcccacaaagtcctctagtatataaagtgatttgataattatttcttggtaagtattgaaatgagaagttatggccgagtgtggtggctcatgcctgtaatcccagcactttgggaggccggggcaggcggatcacctgaggttggatcacctgaggtcaggagttcgagaccagcctggccaacatggtgaaaccccgtctctactaaaagtacaaaaattagccgggcatggtggcgtgcacctgtaaccccagctacttgggaggctgaggcaggagaatcgcttgaacctaggaggcggaggttgcagtgagctgagatcacctcacttcattccagcctaggtgagactctgtctccaaaaaaaaaaaaaaagagtggctaaggaatcagaaatcaaatgtcaaggtagccctctagtggttaaaatgagattaaggtttattgagaaactacctatttttttcatttgtattgtgctttgctatatccctgcaacttttatatcagatgcagattatattgtgacagttatcacttaaaaaatacttttagttccatttcccataacatcagaaattaatccccaaatagctagatctatcattcctttcacagaaataggtttaatgcagaaatttcccgttacttattgtaaagagcttttggtaagtgttggagtatgcctttgtaatcccaggtttcttagagcagcagtccccaacctttttggcatcagggattggtttcatggaagacagtttttccatgaactggtgcgggggtggggctggggaagtttggaatgattcaagcacattacatttattgtgcactctatttctattattattacattaaaatatataatgaaatagttatacaactcaccataatgtagaatcagtgggagccctgagcttgttttcctgcaactcaactgtcccatctgggggtgatgggagacagggcagatcatcaggcattagattctcataacgaacgctcaacctagatcccttgcatgcacagttcacagtagggttcatggccctgtgagaaatctaatgctgctgacaggagccagagctcaggtggtaatgcgagcagtgagggagcggctgtaaatacagatgaagctttgcttgctcgcctgccactcacctcctgctgtgtggccaggttcctaaaaggccatggactgatattgatctgtggctcagtggttggggacccctggtatcttagaggatctgtttttactcagagaagaacctgtagtaagttaccttgtataaattttttatttggtgaaattggatatttttaaattatcactgtggcatatattctttattaattgttaaagttaatactgctgagctgattaattccagatcattggaatacagtgttacagcacctggatatagtcacttgcatgttttctgaaatgcttacggttagcatgttgaaacatgaacagatcatttctgtcctgcaaattctaatttctttatccaacttccactcttgtttatggcaatacctttatcctagttagtcaggcttcttgatactctcttttcttccattagaatgtgctaactagcactatatacctagtactatgaacaagtgctagatatcacattctactggaagtgtctaatactgaataataagtgtttgaatgaattaaggagaattatgtggtaataattatgtgtacatcttgagattctttccactggtttggatacttacttggttgtcaacagtttgtctggcatgcctaagattactctaaaatacaatggtttacttgttttaaaaactatattgaggagctttgggtaacatagtggggtaataagcccctgtggaatggctgtcccacaccaacaaactgaaatgtggaatataataaaagttttttccaatacgtgtctaagctttaaggaaagaaaggttaacctccagataataagcagagataactcaaagccaaaacaggaacttatactctgggattttagaccacatattggttgaggagttgatgctagttttaatgtccatgcaaggacagaaagccttagaactaggtagagagrggagctagaacttagcctgtgtcaaaaaactgaactatccgtgaaaagagagacctcagtgctctagccagtgaaagctgcaaggaattttacctgtgtgcagaagactgtggataagaggggagacctatgaaaaatagaaattcacatcaaatgctaccagtgttcttaattattctgtaaactaatcttttctttttctttttttggagacagggtctcactcggttgcccaggacagagtgcagcagcacaatcatagctcactgcagcctcaaactcctgggctcagggaatccttccacctcagcctccccactacctgggactatagttgctcaccaccatacctgtctaataaaaaaacaatttttttttttttagtagagacagtgtctattttgttgcccaggctgctctcaaactcctgagctcatcctgatttggcctcatcccgatttgacctcccaaactgctgggattacaagcatgagccacggtgcccagcctgtttggtattcttccatctcatatgtagatggcgctataacataaatttgtaccatctacttggtacaggaatcccaaaccgaagaacatacatgataattgatcaggaacggaaagaaaactcccggggacattttcacagttccttggtcagtgtccagaggcaaaactgtttccaaagaagatgacctcacaattaaattacaaatcacaccaatgaaggtgaatagacacaaccagaaaatagcactgcaacaattaaggatatcatggacaagtctgaaagtgattacaaacaattatttacataatgatgtcagtaaagatatttgtaagtgtatatgaagtgtataaagagaaaagaaggaattgaaggaaaaagacaccaaagaaaaaaaagacaggcataatttaaaagcttctgaagaacttctagaaataagaacattaaaattcaaacataaatggtctaacggttaaacagcagactgaaytgaattgacaggaatattaactacgaagaaatgagcaacagaacrcacaaaaaagacagaaaatatttaaagaggatgacatagtagtgagaagacccagatagatttaattatctaaaaggggtttccctgtagtcctagctactctggaggctgaggcagagaatcacttgagcccaggaggtggaggttgcaatgagccgagatcgtgcctctgcactccagcctgggtgacagagcgagactccatctcaaaaataaaaatgaaaaagtagagagaatgagaaaaagaaaaatttcagaatttaagaattctgattgagaatgtatacagattcctaagcaagtagattgaaaacattcatattcatttctggaagaatggataactaggaccattggcagcatttggagaggcrgattgggaaggaatgggaattaattccaaaatgcrtgctttttggacctttcgagtttctacctttgttctctatgtatatttacattgaaacagataaaacacccatagntgaaaaataagatgggaatgtatgagtcagaaaatttggattaaggccaggcgtggtagttcacacctgtaatcccagcactttgagaggctgaggcggatggatcacctgaggtcaggatcacctgaggtcagttcgaaaccagcctgtccaacatggtgaaaccccatctctactaaaaatacgaaaaattagctgggcatgatggcgggcgcctgtacccatcagctcccagctacccgggaggctgaggcaagagaatcgcttgaccccggaagtggaggttgcagtgagccgagattgtgccactgcactctagcctgggtgacagagtgagactccatctcaaaaaaagaaaaagaaaaaaaatttggattaaaagttgagataaatttagatgtatttttttaaatagacatgaaattcaaatatcatacaattaacattttagaaagtacaattcagtggcacttagtacattcacaatgttttgtaagtaccacatctatcaagttactcaacattttaatcacctcagaacactctgtgcccattaagcagttactctgcatttcccttcctccagccaggcagcgtattttttctttaattgcacattatctaagttctttttctttttacaattaaaaagaaattttcagtttctgagcttcagaggcttatgccaacaggagggtttattaagtagaaagagcattagacttgcagtagaagttgtgactgctcccaccgctgcctctgaccaactgtgattttgggcaaatagctaaccttatttgggcttcagttccccatgtgtatgtaaaacaagtggttggactgcctgatctctgggaccagccattcgtggatgggatttttttattgtaaaaaacataacaaaatttaccatcttaaccatttttaagtgtatagttcagtagtgttaatacaaacacatttctgtgcaatttctagaatgcttttcatgtcacaaactctatgcccgtggaacaatttcccatttctcccaaccctcagctcctgacaactaccaactttttaccatctctatggatttatctaatcaggatatgtcctataaatagactcaaagtatgttatggatccttgtgtttggcgtctttcacttagcatggtgttttcgaggatcatcgtgattgcacgcatcagtacttcatccccttttatgactgaataacattccattgcatggaaatatcacagtttgtttatttatccattgatgaacatttgggctgtatccaccttttggctattatgagtactgctgctatgaatatttgtgcagaagtatttttttgagtacctgttttcatttcttttggctgtatactaggaatggaattgctgagtcatgtggaaatctttgtttaactttttgaggaggcatcctaccgggagtgacatgatacctcattatggattacatttgcatttccctaatgattaataatgtggaacatcttttcatatgcttattggctatttgtgtatctttggagaaatgtttattcaagttctttgctcattttttattggattgcttgtttttttgttgatttattagagttctttatatattttagaaattagacccttgtccagatccatgatatgcagatattttctcctataggttgccttttttgctccttgataatgttctatgatgtacagattgagtatagtatctcttatccgaaatgcttgggaccagaagggctttgaattttttcagatattggaactttgaattatacttaccagttaagcctcccaaatctgaactccaaaatgttcaaatgagcatttttgttgtrtgtcatgttggtgctcaagttcagattttctattggagcattttggatcttggattttctgatttggatgctcaagcctgtgccaagttttaaattttgataaaatccaatgtatctgctttgtcttttgatggttgggcttttggtgtcatgtaagagtccattgtcataaataaccaagggcatacagatgtatccctaagttttcttctaagagttctatcaatttaacttttctatttaggttattgttccatttttaagttaacttttgtrtatgccgtgaggtagggtctgatttcattcttttacatgttgatgtccagttatcccagcatcatttgttgaagagacttttacctattgaatggtcttggtactcttctcaaaaattatttaatcatatgtataggtttatttctggactctcaattctatttcattggcctrcatgtctgttcttatgccagtaccgcattgctctgattactatagtaatttttgtaaattttgaaaattagaagtgacttctccaattttgttcttctttttcactattgtttttgacagttggggtcttcttgaaattccatgtgaatttgaggattagatttccatttctacaagaaaaggctgttggaattttgacagaaattgtgttgaatctgtagatcattttgtatagtatcaccatctttaactatattgtcttctaatccgtgaacacagggtgtctgtccatttatttatgtcttttttaatttctttcagcaatgttttgtagtttcattatacaagtctttcacatccttggttaaatttattcctagatcctttatatgctattgcaaatgaaattgttttcttaatttccttttcagattgttaattgctggtatatataaatacaactgatttttgtgtgtcagtcttgtacttttgtaactttactgaattcttgtattagctcatctgtgtgtgtkttcattctttggggtttttttttttttttttttttttaaacagatggggtttcactctgtcaccgaggctggagtgcagtggtgcagtcatagctcactacagacttgaactctaggcttaaaggatcctcccacctcagcctcctgagtagctgggactccaggtgtgtaccaccatgcctggctaatttttaaatttttcataaagatagggtctcaatatattgcttatggtagtcacaaattcctggcctcaagtgatctcccttgcctctggctcccaaagtgctgagattacaggtgtgtgccaccacacctagccattctttgggatttttatatattggatcaagtcatatgtgaatagatagttctttcagatttgaatgcctttatttctttttcttgtctaactgttttggctagagcttgaattatgattagcattgattatccttgtcatattactgattttaaggagaaagcttttggtctttcaccattgagtatatgttagctgtgagtttttcataaatgttctttatcatgttgaggaagttctctgctattcctatcctagtttcttgagtttttttttttggaaaggtgttagattttgtcaaatgctcttctgcatcaagttagataatcatgaaaccacttcgttctattagtgtgatatattatactgattaattttcttatgttgaatcacccttgcatttcatagataaatagtgtataatccttttactatgcagttgggtttggcttgccaatattttgttgagagtttttacatctacattaataacggtgttagtctatagttttcttttggtatcttcagtatcagggcaatactggcctcacagaatgatttagaaagtgtttcctccacttttgctttttggaagagtaggatttgtgttaattctcctgtaaatgtttggtagaactcatcaatgaagccatccagtcctagacttttctttggagatttcttgaaggaatgttccatgtacagttgagaatatatattcacttgttgttgggcagtgtgttctaaatatgtctgttaccttttggtggtttataatattgttcaagtcttctgttttcttactcatcttttgtctagatgttttatccgttattgaaagtggaatactgaagtctccaactattactgtagtgtctactaatttcctccctttaattctgtgaatgtttgcttcattatttggtggctttattgtttgatgtatataattgttattttttatggattggcccttttatcaatacatcatgctcttctttatctcttgcatcagtatttttacttattttgcctgatattagttttgctacctcaccctcttttatttactrttagcatagaatatsatttttctttcatcctttgaatttcaacctatttctgtccttggatctataatgagtctcttgtagacagtatatagttggctttttttctttctttttaaaaaatccattctgcccatctctgtttttggtaggagagtttatttacatttaattagtcaaaatgaatgatttgctattttgctgtttgttttctgtatgtcttataccttttttttttttttttttttttttgagacggagcctcgctctgttgcccagactggagtgcagtggcacagtctcagctcactgcaacccccgcctcccgggttcaagcgattctcctgcctcagcctcctgagtagctgggattataggtactcaccaccacgcccagctaatttttgtatttttagtagagacagggtttcaccatgttggtcaggctggtctcaaactcctgaccttgtggtcctgcccacctcagcctcccaaagtgctgggattacaggcgtaagccaccgcccgcagccgtaatatatcacattcctagagacagtcttgtactgttttttgctccttatctccttcattactacctttttaaatgtatttatttttcttttgtagtataccattttcattcctttctcatttccttttgtgtatatatttagatattttttcagtggttaccttgaggatcacaattaacatcataaacctccaacagtctaccctgaattgataccaacttagctttaatacagcatacaaatctctgatcctatacagcctcactcctccttcccattttatgttttcattgtctcaaattttatstttatacattgtgtacccattagcatagttttataatcattattttacatgcatttgtcttttaaatcatgtaggaaataaaaggaattataaaccaaaaatacattaatactggttttaatatttagatgtgtgatggactttaccagagatttgatttggttttatggcttcaagttattgtctagtgttcttttatttcctctaaggattctctttagcatttcttttagggaaagtgtactactgtcaaactcttccagcttttatttacctgggaatatcttaatttctctttcatttctgcagtataattttgctgatatataattcgtggttggcagtcttcaggttttttttggggttttgcttttgtttcttttagcactttaaatatgtcatcccactgctttctgccstctatggtttttgctgaaaaatcagctcataatcttattgaggatcccatggtcataagtcacttctccnttgctactttcaagattctctctttgtctttgccttttaacagtttgaatatagtgtttctcattgtggatctatttgcatttatccttagagtttgttgaactttttggatgtgtagattcatgtcttttactaagtttgggaaatttgtggccattattttcttaaatattctttctgctcttttctgtcttcttnatctaggactcccattgtgtatattttgctcaacttgatggtgtcccacagatctcttagactctgctcatttctgctcctcagactgtacagtttcacttcctattttcaagtttattgcctttttcttctgtgtgttcgcatatgctgttgaaatctgttagtgaatcttcacagtatttttcagcacctcaatttctacttggttcctttttaaagtttctgtctctgttgatattctctacttcaatagaatattctttgtactcttaatatttagcagccattgttctcagcatttagtctgcaaagttttggcataggtactataattatccctatttaaccatgagttgattgtttttagtaaatatcttagtactgaagaactgattaagagctctgcttatgagagtggagcttttcagcaactgggctttgtcttcaatgtggttgggcaaaaatcagtcacaatggaagaccctgaagtgcttgatatatcagagacatctttttttttttttttttttggagatggagtctcgctctgtgttgcccagggtggagtgcagtggcgtgatctcggctaactgcaacctctgcctcccgggttcaagcgattctccaacctcagcctcccgagtagctggggctataggcacatgccaccatgcccagctagtttttatgtttttagtagacaccatgtttcgccatattggtcaggctggtcttgaactcctgacctcaggtgatccatccacctcagcctcccaaagtgctgggagtgagccagcgtcagccactgcacctggcagagacatcttttttttttttttttttgtcctatctgcactgatggtgcctaattgtcacttttctttctcaagatgtggttggttatggtgattttaattaatattcatatttttataaccacttttcattctcaccaaacttagcttctctgagtttagaaatgttccatttgtaatatggagcagattggattccttcttgtccttatactttccttataaacattgctataataatcatgtttgtacacaattcccaaagaataggttcttaaaatgaaatgtgaatcataatatatgtgtaattttcacttgaatagcaattgagacaaagatatgattccctcctgctagctgggataatcttgaaggtctttactaaaatgatagatataatttaagtagatcttaaaggataaacaggttttctgtaattagggaggtgctatgggaatagttaaaaaaaagagagagagaagtaatataaagttcatagtaggataagatacccttttgtttaaaaataggatgtttataaggaggactaacgacaaataaaatttccaatattttattataaaattctaaaaattatatagaaaaggcaaaagaaacatacagtgagcacacactcagcaccaagattctgttgttactaactttttgcatcacttgccttaccatattattaatatgtccatttattcatcctccatccatcttattcattccataataaaataaattgtaaaataaaataattcaatatgcttcacccgtaaacccttcagtatgcatttcgttagagttccagtatttgtgtactttatttttcttttacctccaaacagcatcaggatagaataaattattattgtacgattgaatgagttttgacaaggcattcattcgtgtaaccaaaactctcaagatagagaacatttccatcatatcggaaaatgcccttatgccgctttccaggcagccttttccttaccctccatccagcatgactgttttgatatattttttaaacyrtaaaacccacttttgctattagttttcttcaattagcccacccaaatgaagtaaaattttattttagttctgctatttgatttttagttagatctggatctctgcatgtttttcattttaagtagttgccctgaagattacatttacgttgttacttttcacaatttatttaggactaatactgtacaatttcatgtaaaatacaagacctttgcacaaataaggttttcatataacccctctaccgcttgttctgtatgctgtaattttcatatcttatacaagtacaagattacataagtaatttcatatcttatacaagtacatagataagtcattattaaatgggagtaattatagtacctattcaacaaaattggaatactaaatgcaggaaacagtgacagccaaatgttaacagtatagaaaattttasctcaacaaatagagaatatcagtaaagacatagaaattacaaaaattaaacaaattcaggaactgaaaaacaataattaatagaatatgtaagcatatcatatatatcacagtattatagattttcctttaaccaatcatgtgtgtattttaaagatactgaaaggaaaatgtagtcttttctatttaacatttttagtgctctttttttcctgaatatttccagataaaataggcattggaactcaatccccagatgtatcttttctacagtgggtagcaccagaggtctctgttcagttcttttagcatacttgggctgcttggaatctttcctacattcatgtatttcagaggtcaactagagatttgggcagagtggatacacagaatttagggctctcctttggtgcctgctttctgagatttcctcctttcctttctagatctgtgctgtccagtagaactttctgccattatggaaatgttgtataacgtacaccatccagaatggtagccatttgcctcatgtggctgttcagcacgtgaaatgtggctagtgcaactgagaaatgaaattttttattttagttaatctacatttgagtagtcacatttggctagtggcaactttattggacagaccatccttgcagaaaggtctgttagacagcactgttcttgatgctgtggtcattccaaactcagtcgccatttctgtctggggtttagcagacctgcagaatcagaacaggccctttccttaggtaaaaatgtattataaagaaggaaactcaagtagtgctttccctttttcccttccaactatgactgattttgattgctctccagagccttcaagtaatagttgttttgtatatttttgactagagtttataaatacatctgtgtctgatagaactactccactatttaacagaagcagaactctacctcttaatcatttaaatggtgacctaatgttaaggaattcatatttggtgctttgttaccataattctcttaccaatcactaattaaatatttttggctctgaaatatttagctgatatagccaacttgatctcccatttctttaagaaaaaactagttacctaatactatcattgtttagatgaaaaagcatttggaagacttatttttctgggtctcttaatagaatttttattttaaactatcatagccctgcttactaaaagtattattaacctttagtgttactgaatcttagtatgctaaatttgatattcccatctccagtcatgttagaatttaatggaattcttcaaagcaacaaactcctatcattgataacttgtttggtatactttgctttttctaggtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtatgtttcaggtgtaccttggagcctgactggctttctsacattccttttatttagaatcctggctctgtcagagttttaagtgatataaaccttaagaaattcatagcttgaactcaggaggtgatccattgtacttatgagatataggattctctatatttgtgcttcttggaatcatcttagagactattggtaacattacgttacaagaaataaagtgaactttgttgataaaacctaatgtaatagccttttttgttgttgttgttgttgttgttgttgagatggagtctctctctgtcacccaggctagagtgcagtggcacaatctcagctcactgcaacctccacccaccgggttcaagcgattcttgtgcctcagcctcccgagtagctgggattacaggcatgcatcaccatgcctggctaatttttgtatttttagtagaaatggggtttcaccgtgttggccaggctggtctcgaactcctggcctcaagtgatccacctgccttggcctcctaaagtgttgggattacaggcgtgagccaccccgcccagccagccatcttttcattacacactgttgatacttaacattatacactatttatttaatacatacagtatgtcacttcatgaaagaaatggaatttatatttagttttactttctaaaattaaaagataaaaattaaatttttaaacatataaaatgtctgttggatatatatgtatattcaagaatattggccaagcacaatggctcatgcctgtaatcccagcactttgggaggctgaggtgggagggtcacttgaggtcaggagtttgagaccagtctggctaagatggagaaaccccatctctattaaaaatacaaaaaaaaaaaaattagccgggtgtggtggcgggtgcctgtagtcccagctactcaggaggctgaggcaggagaatcacttgaacccgggaggtggaggttgcagtgagctgagattgcgccactgcactctagcctgggcaacagagcaagactccatctccaaaataaaaaaaataaaaagaataacctcctaacattttgtgaaaataaatatgacaattcattctgaaaagttggttttatcaacttttttcttagtctcactcttcagaatttatgatctatctaaaagagtgtttctcaacctcaatactactgagatttggggttggacaattctttgttgcaaggggctgtcttgtacgttgtaagactctggggcagcattcccagcctctacccactagataccagtagcacgctccctctgtacctgccttctagttgttataaccaaaagtgtgtccagacattgctatatatggccmctagaagacaaaattgccccctgttgagaatcacttatctaaagaacaaggctgtccctttcagactttatatgttagaaactcaaagctggaaaaataatttaatgcctattttgataagctttcactctatgaagaggatatcacaatttaaaaacttgaggtcttcataaacattctatttactccctccaaaaggtgacaataacaaaagaaacccattaatttttaagtgaacttggatactgagtattactaggaaaaacacagaacaccagttatttgtacatctttcaaaaacagtgttctccttggaatattatgtaactagggttaggaatgctttcacattttcttataatacattcacaagaagaatgggaaaagtgtcatttaaagctgaatttctttttttgccttcttcacaggaaacatttctttgattgtctttggcatcctgaaatctctggcccaatagagtttttattttctttgttgattaaatgatagtgtgcatgcctgtttcttggaaatgcctaataatttgaggtatgcagacctaattttctggaagcattacaaaacctagtcttgtgggatcacacactgtgctcataaatcagtctgtatttgggttctatatttgtgtgtgtgtgtttgtctttttgcctgtaggatgtccctcactacatttcttgtgtctgtagtaggcttatttgtgtactgcaggtgggatggtaagtatgtgaagaaaagggctctggtgagtggcctttggagacaattacgttttatttcattttttaaaaaatgtattgaatatcgggtttttcactgcaaggccttcttaaaaagtgaaactaattagattgagtgttaatgccaagagtgtagctgtaaatattaaccctacagctaccatacattagtgggcacacaagtattttgatctttttaaacccatcatcttatcttacagatgtaccattatatttgctttgttccttgcatagtgtctttccttttccttctatttgttttcaatatgaattatattagtttattatcttagccaaggttttattttggcatattgtataaagaaattcawtttacacagtaaatcaataaatagatccttgaccttattccagtttcatataaaggccttgcagtggaagatcttttatgagatatttgatggaacagactgactgagaagatttccttcctcttttctccccctttccttttttctccccattccaatttcttctctctcacaggtcaacccctctgcttctcaccccggtgagtaacgtctgaagcttctgctcgcattgagtctgaatcgttcttttaatttaaggtaccccagagttcatggcccctgagatgtatgaggagaaatatgatgaatccgttgacgtttatgcttttgggatgtgcatgcttgagatggctacatctgaatatccttactcggagtgccaaaatgctgcrcagatctaccgtcgcgtgaccagtgtaagtcttcccctaactgattgttgaacttggggcatatctaacaaagaatcccaaggtggatgacatcaaaccatgtaaaagaggacaatagtggaaggcatactgagtgaactgttggggttgggggggtggtgttgaggtatgtgtaagkctattgctcatgatacagtgaaagataaagatcaaagaaccactagtttatcctgtacccaccttgcattcatttaaatctttattatgtttaaaaacacaccctcattacctactttttaaccccctattaattcagctaaactcctgttgtctcccaccacataggtcagagttaaaagtaatgtttttaattcaagatgctttgtcaaattaatttgttcactgacttttctctgaatgacttgagttgatttattaaatcttatatattagtacctaccatatttaaggcataaataaataccttattgtagtttaaattactcatggtagttcatgtctgctgacagagatattttctacagctgtctaattgaaacctgaaaggtagttgttatgattcattttactttatcactacatgcttcattatgctactctaaaatacattttcttacataaccatattatgcctgaaaaaattaacaatcatttctgcatcatccaataccctgaacctgttcagatattctctccattgtttcaaaaatgtccgttgacagtgttcaaaataggctccatcaaggtccacaaaatatattttattgttgtagttcttaatctagaactattgcttttactttctttttctgcatgcatgtcagagatttattgagaaaattagattatttcgaggaatgttccacattctgaattttcctcgtggtgtcatttaactagtttattcttctatatttctgtaaggagaagtttaccttaaaatggttggggtaggttaacaatgtaaaaataattttgtcttttttactcgcattcacccaagagtgtacgttgttgttttccagaggctatatgatactgcacatatgatattgcagcagagtacatacagaagcatataaaagaattcatttgtagggccgggcgtggtggcttatgcctgtaatctcagcactttgggaggccgaggcaggtggatcccttgaggtcaggagtatgagactagactggccaacatggtgaaaccccatctctactaaaaatacaaaaattagccaggcgtggtggtgcacccctgtaatcctagctactttggaggctgaggcccgagaatctctggaacccrggagatggaggttgcagtgagccaagattgtgccactgcactccagcctgggtgacagagtaagactctgtctcaaaaaaaaaaaaaaattcctttgtcttccattaaaccatatatttaaaaagattacaaaaatgtaaaacaataccagtcttatcactaaatttttcttgttttggaaaatactgactttttaattttaaatatatatttgtaacataatgagttataatttttaatgaattaayatttttaaactttctcaggtttaccatctgccacggtaaatattaatagatgtaacacacatagtcaaaatccctctgaggtccccaataatgttaattttaagagtataaaggggtcctgagacaaaagtttgagaaccactgttcaaaagtcttgataaaatttaggctaaacattttttgcaaggatacttaatatgtggtgctgtatatgttatattgcaccgagaagctcatagtatctcattatttcatttttagtgatgtaatttaattgaattttgatatagaagatgtaattatcaattgcttatttagattttgatagctgaacagaatggaaatgtttatttttaattttttatttatttatttattttttgagayggcgtctcgctctgtcgcccaggctggagtgcagtggcgccatctcggctcactgcaagctctgcctcctgggttcacgctattctcctgcctcagcctcccaagtagctgggactacaggtgcccgccaccacacctggctaattttttgtatttttagtagagatggggtttcactgtgttagccaggatggtctcgatctcctgaccytgtgatctgcccacctctgcctcccaaagtgctggaattacaggcatgagccagaaatgtttattattaaaaactgataggaaacattttgctttaggtagaccaaattttacctcttcataaaggcttgggagaaatctttggagtcaaagattaattataattatttattgctgtgaatattccttcaatatccttgttgtatatttgtatgtgattctgttgttgatggatatggagctactttggacaattagtttaatttcatatgaagtttgaggtttcatacccagtaaaaatgacagctattgtttatggagaaagtgtgtaactctcaagttacttctggctttgtaattgggatggtattttgtcagttattattattaggtgtatgtctacaagtgtctggcctgaggccttactgttaaatttattaacctcttcttaatactcacccagattctaatacacaatataattgtaatccctgaagcactgactctcaatttgggctgaatgggggcaggagaaatttttttatgccttcagatgattctgataagtaccctaatcattattctacatttatgcccttagaaagctcatctgctttgcctttcagagttctgtatcatcattcccagttcatgtctcttattattcccctttcttcccctgatgcgttgtaatttacattctctctttttttttttcctttgagcatagggtcgactgtttattgggtaatttcctcctttattttgtttaaaattgtagaaaacttaagaggtatatttgatttcttgttttttactcgctgcttccactacttccagtttataaggttcttgcttcagaatacctcttcgatgcaagccttcttcattcccattgccacaactctgatttcacatcttccttactgcacaccttgcattatattccagaagtaatttacattgtgaatttatttttttatttcacttaaacttgttgagctttcttgctatcctttcttggtataaggaacttaagataccagtttgctgatatcagagcaagtacaaattcttaatctttgctattcttcatcttcatccaagcactctattttagttaaatcagttctcttcattatctcgcacatatgccacatcctttcctgtattcctatccatttgtaaatgttatataatactgtacctccactataagcttttctgctatccagtcaatccatatacttaacggtcttcctccatgacattttatctgattggtttcactgtataatgatctttgccttttctgagctgattcttctcaattgatatgaatgataaaattttgtttattagtggttattctacttataaattcataaattcaattaatgtacttgcttattatttttattgctttatattccttaaaatattttaatctagtacatctgtataatttcatccttatctgtagcactatcctaaatacaaaataaatctcagtgccagtaaatgcaacattttctgaatccctgctatgtcccatgcccagagcttgatactaagtaaaggtgaataatcatattccctgtcttcagaaaactacctctaatatagaagattaatatgtaaacaaagaattataattacattatggtgagtattgtaatggagacaagcactaaggagagtggaggaacaatggataaccctgctatggattagggaagatttcacaaaaagagctgttgtatgaactgtcaaaaagagaaggtagaagaatggtgagaggccattctaagaagcaggaataggatttacatgaatgctgagatgccaaacaccgtagtacaatggaaggaaaggcaaattgatcaaatagagtgaagctgttgtcttggacaaatcaatttttgatccaaggacaaatcaattgctacttagtttctcctgctcccaaatcctgtctcatctcagagcagagagtttccggttggtaattaagaggcaaacttctgactgctgatatgtgtttttactgctattatattgttgtattttaatggtgaaagagactttatctgtttataggcttttggaaggagcaagaggaagagagagagaagtagaaatcatggtgggtggtggtggatagggtagagtaatatccaggattcaatgggcttgtgacatggtataatggtaagtcttgatagggaaggttttctcctgaggtaagggaagcaagatgggttttggaagcaaagtcttgggttcacatccttgccctagttattgccatacgatcttgagcaattcacttaatttctctgtacttcaattattttgttctctgtaaaagagatactattaccctcttacagattgcttagcacagtagatagtactggtactgatagtaggctgtggttattgtctatgaaatatgagttgtcatcttcttgggggkgtgtgtagaatgaaagatggcctttaaggatgataaaggcttaaaataacatctatgaaactttgaactgattaggaaataataattgtgaagcagcaccaggcatccagaatcttcctttttagtattgataaacactattatgtaaacaatgaatatattgtttgtacgcgtgtctatgtgtatgcaagtggaaaagggcaaatttttacctattacatacttctttcttgtgaataaccaataataggctgggcctgtaggctcacgcctgtaatcccagcactttgggaagccgaggtaggcagattgcttgagctcaggagttcaagactagcctgggcaacatgatgaaacattatctctacaaaaaatacaaaaattagttggccgtggtggtgcatagttggctgtggtgatgcatgcctgtagtcccagccactgggaggctgaggtagaaggatcgcctgagccggggaggtggaggttgcagtgagcctagattgtgccattgcactcgagcctggacaatagagtgaaagcctgtcttaaaaaaacaacaaaaaaacccacaatagcttagattgctaaagtagtcctcagttttctatattctgaattctgtgtatcagggtttgaagaatagaatagaagttattgacataaatgagttaggtttcataggagaaaagttaattttacttggtgtattttctactgaataagtttcatctgtgtatttgtgaatatttattaattataaactgtgaccaagcactatactaggtattggggatataccaagtcaaaaagttgtgcctcacctggagtttacattcagttttgttaaaaaaaaaaaaatgttgatagaagtcagtaagttggctgggcgtgatagctcacgcctgtaatcccagaactttgggaggccaagactgggggatcacttgaggtcaggagtttgagaccagcctggccaacatggtgaaaccccagtctctactaaaaatacaaaaattagctgggcatgatggcatgtgcctgtagttgcagctacttgggaggctgaggtaggagaatcacttgaacccaggagacagaaattgcagtgagctgagatagcgccattgcactccagcctgggtgacagcaagacttggtctaaaaaaaaaaaaaaattgataactctattagagtgataaggtttgtgtctagaatagatgggagataaagggtgagaagctgaactaggtttattgttacagcacagcaaattcaatcatttctttttgcccgaaatgtatgactaggtactaatacaatctgacttttttattaaaacatgtaatgaagtaattagggaggaaayataagccagtagattcaaaactgaggggaaaaataacaaaagttgtagtggatcaaagtagatttgtagatcaacatgctatatgagtgataytgctaaacagtaacaggtgtttctgttatgtgactcctgagccttaatttcctcatatgattatggtagtcataactgccaggcctactaaggttgcgaaaaacaaatctgttgaaattatataagaaagtacatttgaaaaagttgagaaatatatttgttgtatttgacatataactagattgactctgaaatgtcttctatctcaatagattcttgatgtttcagaagggtttgacttaggctttctgctacaaaagattgggaggatagtagcactaactggctttcttaagtgtaatgaggctcatatttgcacagaagttacaaaatctgtgattgtgatatattcaaggaattttatttttaaaaatgcctccaacttttcaataaaaaagtaaatagatggcaaattattctgtgtagagatgaatatctagatattaaaacttaaaagtatgattctgattacataatcaagtcataggctttcagtagtccttaaagtctgctttctatccttcagtgaatttttgaagtttgtttatagaatattttgtgcttatcatattaaatattagaagacctttggggacttgattgattctctgcatggcataacgtgccaagtcagagtattaatcagaaatattttttttttgtatgtgcatactaaaaatgtacatttaggtttttttctatcagtgttactgaatatattatatacctacccatctaaagtgtataattcactggttttagcatcttcacagtgttaaaagaaaaacttcagccaaattaaatttaaaggcgtttaattgagcaatgaacgattcgtgaattgagcagtccccagaatcacagcagattcagagagactccagggatgcctcatggtcagaacagatttatagataagaaaaagggatgtgacatacagaaaccagatgtgaggtacagaaacaactggattggttacagcttgctgtttgccttatttgaacactcagcaatgtatgagtggttgaaatacagccgtgagggctgggcgcagtggctcacgcctgtaattccagcactttgggaggctgaggcaggcagattacctgaggccaggagtttgagaccagcctggccgacatggtgaaaccccgtctctactaaaaatacaaaaattagccatgcgcggtggcgggcgcctgtaatcccagctactagggaggctgaggcaggagagtcacttgaacccgggaggcagaggttgcagtgagccgagatcacgccattgcactcctgcctgggtgacagagtgagaccctgtctaaaaaaaaaaaaaaaaaaaagaaaagaaaagaaaaaagatagaaatttggctgttgggattggccaagactcagcagttgttacgggcatactcctaagttaggttttcagtcttgtctacctgttaagttaggttgcarttagtccacacagactcaaattagaagtacaaagtccttctcgggccatatttagtttgctttaacaacaggtatgtgcagccatcaccacagtcaactttagaataattttatcacatgataaagatattctgcaccctgtagcaatcacttttctatacaaacattccccccactcctgtgcaacccctaatctgtttatgtcactataggtttttctattctggacatttcatctaaatagagtcatttaatatgtggtcttttattactagcttctttcactttgtatagtgttctcaaggttcgtccatgttgtagcaaatgttcatgcttcattcctctttaagtctgagtagtaatattccagtgtgtgtgtgtgtgtgtgtgtgtgtgkatgtataaacacaattgtttagccatttatcgattggtagacatttggactgttcctaccattggctgttgtgaatagagctgctaygaagaatattcatgtacaagtttttgtttgaatatctgtttttacttcctttagatatatacctagaagtgaaattaccatgtgtatatgctaatcctatgtttaaccatttgaagaactgccagcctattttccaatagctgtaccatattacattcccaccatcagtgtaagagaattgtgatctcttcatattcttgccaatccttgttgttattattattattattattttgagacagaatctcactctgtcacccagactggagtgcagtggcacaatctcggctcactgcagtttccatctcctgggctcaagtgattctcccgcctcagcctcctgagtatctgggaccatggacacacaccaccatgctggctaatttttttgtattttttgtagagacgaggttttgtcatgttgcccaggctggtctagaactcctcagatcaagcggtctgcctgctttggccttccaaagtgctgggattacaggtgtgagccactgtgccagcctgtgtcttctgttcttaaaaggacagcagtcattgggttaaggacccacactgctcctggatgacttcatcttaactaattacttaackaattttttttccaaaaaaattcatattgtaaggtactagagattggaaccacaacatatctttttgagggacacagttcaaccccataacaattcatgggttcattcagcaaatattcaagtctcttctatgttccagactgttttctagatcctagatattgaatattattgttatgtcaaacacagtccctgtctctaaagaacttaccaagggaaggggaacaaacaaataaagcaaacagttacaatacaatagaaaacacttattttagggataggtacttaatgaaagcatgtaagagtggtacctaatcaagtttggacaggttagggatatggtgttaaagaattagggaaagactaagatagtgttatatatgaagatgcatgattttgagtatcttgtcaagtttggaagtaggaaaaggacaaggcaagggataagggacaaaaggaaagcttagactttaatgtagagcactgaggggactgttttaaaagtgggtagctatcatgtatgtcaacacctacagacttaaattttagaaagattatttctgactgcagagtggagaatggatttctgaggaaagactaaatgttgaaaactcagttaaaaaggtattgaagtaatctaagggaaatgactaatagtctgaaataaggagttgtaagagagaaggccaaagtggatggattagagagattttgtttgtgaattagatttgagctaacctcatttgtttttttccacttaacatttatgaaaataaatgctcatgtacrtatatatacttaagatcaaacaatatcaaacctgattgtgaggttaaatatataactttagatttggggactataaaatttataatttgtatatgaaatgttttatatattttatttactaacttaccaatcattactttttttgagacagagtcttactctgtctttcaggcaggagtgcatggttcagtcttgtctcactgcaacctccgcctcccaggttcaagtgattttcctgcctcaagcttcctgagtagctgggattgcaggctcccaccaccatgcctggctaatttttttttttttttttttttaaagtagagatggagtttcaccatgttggccatgctgctctcgaactcctgacctcaagtgatccgcccrcctcggcccccaaagtgctgggattacaggtgtgagccaccacacctggcccattctgtcgtattctaaatggagtagcaaactatgcttcttggccaaattcagcctggtgcccatttttgtacagcccatgacataagtatggtttttggttttgtttttaattttttgagagaaagtctcactctgtcaccgaggcttgagtgcagtggtacaatcatagctctctgtagccttgaacttctgggctcaagtgatcctcttgcctcagccttctgaatcgctaggactacagacatgtgccaccatgtccagcttttttttttttttgtagaggtggggtctcactatgttgcccatgctggtctcaaactcctggcctcaagtgatcctcctactttagcctcccaaaatgctgggattacatttacgagtaccatgactggctggtttttatattttttaatgtttggggaaaatgtcaaaagaagagtattttgtatgatacgaaaactacatgaaattcaaatttcagtgtccataaataagtttttctggcatacagccacactcacttgcttccatattatttatggctgttttcacactataatggcagagttgaataattgcaacagactgtatgatacatayagcctacaatatttactattaggcccttaacaggaaaatttacttactcctgtgttaaacatatgtcaccagaactttgtaaaacatgttcccctgtagagtcctgtaagaaattactgatctacgaaagtagtggtgatgttcttctataagaatgcgttagcctctgtatttgtaaagacatgagaatcttggtgcaaacaagtagctacttaacaggtcagaaaatgtgtaggcagtcttttctctctgttaagagtagaactaaaactttaacatttttatttgccaaatgcaaactcaaaagctcagttgagaagaaaatcttcttaaatgaaagatgtctttgatagtaagtttaacagaacctggaaagactggtgtcactgtttctgtattctcagtatagtgtttaacctgttttcagttgttcagcagcttttgttttttattaaactgagacaaaaatcatatatcataaaattaaccattttaaccatttttaagtatactgttcactggtttttagtatatccacaatgttaatgcagttatcactactaattccagaaccttcccatcatccccaaaatgaagccccataccagttagcagtcatttcccattctcctctccaacccatcccctagcgaccactaatctgctttctgtctctggatttgattttcctattctaggtatttcatgtaaatggaattatacaataagtggcattttgtgtctggcttctttcacttagcaaaatgtttgcaaggtacatccatgtggtagcatgtatcagtactttttaatagttaaataatattctattgcatatatatactacattttgttctattcagcaggttttatttcccttwagttctttagtttcttcctctttttctcaatgttaaactgcttgactctatagctgcctcttaatctggagagagattgagaacaatgttttagtccatttgggctgctatatcaaaaatgccataaactaggtggcatataaacaacaaccatttatttctcacagttctgaaggctggaaagcccaagatcaggtgccatcagatttggtatctagtgaggttctgttcctcatagaccggactttctcgtgtcattttcacatggtgaaagagtcaaaaagctccctccggactcatattataagggcagtaatccatttcacggttctgccctcatgacctgatctgctctcatgacctgatcacctcccaaagaccttcacctcttaatactgtctcattggacgttagatttcaacataaaaattttagggggacacaaacattcagactatagcatacatgaaggaggaaatatagagtgtcttaaaaggtattgtcctagagctaggtttattatatcgttgtttgtattcattgtgcacagcacaccgtaggcactcattaatattttgaagaataaatgattcaaagtaatgtcaaatatagtcaaaatcagacattatgtatatttgggagagttgtatttactctgtgaaagagaagtgaaatttgaggtgaccttcagaattatcctactaaaatgaagttgaatagcagcaagtagaaactgatgtacctataaaagcaatatattttatattaatggcaaaaaacacaattacttttgcatgaacctaatagaataggaaaaactatttggtgcaaataaagcagaaaacaataataggtagaaaggctatcccaggactagaaaggctcttctgtaggttctcaaatctcagttgtaatttctgaacaactagtttaactctttccattatggggctaggtctgtattttattttattttatttttttaggtatttccccttaatttttaccctataattactactctcactttgttctttcttccctgagacttcatagggcagaccaaattgtaatttcccttggtgtagtccctaaaatgtttcaagacagtttttctaatgttaggagtccttttttgtcaagacccatcattgtcaatttgtaaaacttgttcctttgaatttcttgagggaaggggcttatatgcattattggaagagggagatgctcagcaactgttttcttgatcttcaggaggttacataagaaggaagagaaactgtaattgaacataagaacttggcaacattgtataatattgcagaggccttggtggtaaaggtttgagattctgtcatctgagaatttttgagaagggaccaagacagctaacagactcaagtgattttatttatttatttatttatttatttttggagacggagtctctcactgtcgcccaggttggaatgtagtggcatgatcccagctcactgcaacctctgcctcctggattcaagcaattctcctgcctcagcctcccaggtagctgggattacaggcacccgccaccatgcccaactaatttttgtatttttagttaaaacgggggttttaccgtgttagtcaggctgttctggaactcctgaggtcaagtgatccacccaccttggcctcccaaagtgctgggattacaggtgtgagcgaccacgcctggcccaggcttgagtgattagttcagcatggtatcagtaatcctttacactctttaaagttattgaggaccccaaagagcttttatttacttgtgttctatctactttaccgtattataaattaaaatagaatttgcaaaagcatttaaaaatgataaataacataagccctgtatatgttggtatcaataacatttttatgacaaataactattttccaaaacaaaatttaaaaacttattgagaagaggggcatttccacatttttgcaaatctaatgtctagtctaaaagaagattgctaaattctcatatctgcttttctgttcagtctgttacaatatgctgtttgggttgaagtatatgaagaaaatctggcctcatgcagatatgtagttgcaaaaggaaatactttatagaccacaagaaaggatattgaggaccctgaagggtctttataccacacctttgagaaccacagttttagcaaaccaaccatgcaaagtgcagtcctcagaccaacagaatcagcatctcagggtgcttgtatttagtgtaaaattttggccccattccaggcctgttaaaatctgcattttacatagtccaagggtgattcatatgtacattaaagtttgagaagtatgagctgggtcagtaatcccttaaggtctttttcagttccatgtacctttatttggttaattaaataaaaagtaggctatatagtataataccaaaatgttatttaaataaactattgttcagtcattcatgtaaacttttaagtagcattataagtaaccaatttgacttaaaaattatattattatagcatttatatgcaattttgcattttttctgcctttttggttgttgctttttaaaaattttctttattttattttatttttttttgagacggggtcttgctctgtcgcccaggctggagtgcagtggtgcgatcttggctccctgcaacctacgcctcctgggttcaagtgattctcccgcttcaacctcccaagtaactgggagggacaataggcatgggccaccacagccggctaacatgtattttctggtagagatgggggtttcaccatgttggccaggctggtctcaaactcctgacctctagcaatccaccagccccggcctcccaaagttctgggattacaggcgtgaacgaccacgccaggcctggttgttgctttttaaaaaggaaaaccggtaaatcaagctgtagaaaatgtggaataaaaaacttgaagagtaagtccattggaactgtgctagaatccttagtttctaaggatgccgcaggtggcatgcatttgtgctttatttttcctctaagctatgaaaatttagttgtgtatgctctacagtccttaattctgcactgtccattaccatacttcttgcctaggaaatactgtctagattttaccaatctccattcccatcttctggcttctagtaaagaataaaaagggctgtggtctttgttactttcctaaaagttttcttatgttttgggtgctgagataaatgtggagggtttaaataagttcttagataatataatttatataattatataagcaatcatgatgattctgtgttgaaataggccttgaaatattgtaccttctcttttttttttttttttttttttgagacggagtctcgctctgtcacccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcagcctcccaaagtgctgggattacaggcgtgagccaccgcgcccggcstgtaccttctcttaagtcagcttgcaatttaaatttttagttagtaaatttaactaattttraaatatgttagtgtctgtctgcttaactattgcatacttattaaagaaacatgcgtggttatccattggaagagatcgatcctagggcttcctgatacaaacacacccacagaccccagccactctagatttctggttttcatcccaggtctattgtgtataccctggctattagtaaccagtaaaccactctcccccttctgtagatttagtactaacttagaaaaaggatacaaagaagagtttgtatttaacagctcaggattgccttttcaggtggaagaaataggctctggagttggatctgcttcctttcaaattccggcaatgtcattgcctagctgtgagaccttgagcaaattatttacttctctgagcctaaagtatttgtgaagattaaatgagaaaggcaaagtgcctggcatacagttatcaatcagtacctaataggtatcaccattatcatcaacatcattattattaatacatatttagtagtgaaataaggtgtctctttttatgttaaccagtgacattcagcaaattgcattaatttaaatgtgcttcctaagtgtcacataaaatcaagctttaaatgggagaacaagctaacatttatttgtaatcttgtcgatcaccttgcaaagtgctttacatatactgttttaatcttttatatcatgataagtagataatgtcttcatttcacaggtaagaaaatagactcagagtttaagcattttgcctaaggacatgcaggagaaataatagtagtcagaaaccaaggttctgttaacatgatactaatacaaacattaacattattttcctttacctcttttttgttttgtttttaacctgttttctagaccgcaaggaaaactgagggtaaaaagtttaggagatgtgagtaacaaaagtctggtactgcagttttgagctctgagtaaaggttcattccccctatttaacagagaaaaacttattaattgtatgctatacttgtagtcttgacccagttgtcatgaaagtctatgccactgataatgagaagatccaagtaaaagtaggaatatatttagcacnactttggtgtgcttttaaaataataaaaaccgtagcaggcaatgatatcaactttttatatgaaggatagtgcgtttgaactggagcagtacacaagctttcatgtattcagagagtaacgagccttggggaatcgtgagtaagttaatttctttgatagagctagcttgatttggtagggagttcaaagaggcttgttttccaatgggatcatagggtatgttcaaattcctgtaaactaatggttcataactgtaagaatctggctgaatccagccctataacaaccaagttagaaataatggggatttttaattactttgtttgtgtaatttgactttgtcactgattccattagcttttggattgcaaggtttgaacattttgtctgggaaaaaacagaactaaagccattagggtaaaattccttttagtttttatataacagattgcaattcaccctacctttttactgaaacaagtgagactgattcctgattagatggtgtttaaaaagttgaaggaaactttgtatttatttctttagcagctagaatttgttgtgctatcagtgaaaatctattggaattagctgaactggttccttaataaattttgtttctatgtctatccagcaaatttaggttataattgtaaaagaaaagttccagtactagggggctatatcttaggaacattttgcatgattttcagaagcatttcattattctgctgtgatttaattaagattaaaggtggtagcattcccagtgttttaggtactaaataataattattaaatcattatttcagaattcctcaaaaaagctgaccttacttacctaccctgaatattgatctgtaattcacaaggcggtagactacagaataaaaacaaaggatatagaaagattgttttccatatttaaatacagcagtactgagttttctgatatactgtaaataacctaaatgctaaaggattcatatagatactttgtaattgctactttctctaatggattgtatgtatatatgatttgaggtataccctgaaagaagcataagactcagttgactgaaaaaagggggcagaataggaaaagtattcttgttggtagaagtgttcactaaagtattcagtgaacaagtaaccagtttgactgaacttactttggggagattgggtaaagatgtgggtggaagttaaattatgattttcacaccacttttaaaagcacaataacatggaccagaaataacattaaactagatgctggaaaatctggattctagtttttgttttaccattgattcggcccgtacttaactggagtataaattatatttatcttctaggtggtgaaggtggtgcagtgtatctagcagattgcctgatagctgttagactagatgagacactccatagtcaactagttgaattaatggattaattctcttttttttttttttttttttttttgagatatagtctcactctgtcgttaggctggagtgcagtggcatgatcttggctcactgcaacctccgcctcccaggtttaagtgataactcctgactcagcctcccgagtagctgggactacaggcatgtgccaacatgcccagctaatgtttgtgtttttagtagagacggggtttcaccatgttggctaggatggtctttcttgacctcctcgtgatctgcccgcttcggccctccaaagtgttgggattacaggcgtgagccaccgcgcctggctggctaatggattaattctaactttgacatagaattaacatttctgttatttgaacaaggaaggactcttaatctggtttattctagatctgtgatcctgtggtcatttagtaggtgtggagaactattaaccgtttttgagcagtgtgattatgagttaaatgataccagatgattggaaatggttaaatgtcagatgcttaaatggagtcagatggtaggagctagccacaatgtaaaacacaaattggagatgaagagaatggaaatatgaggcccatcttaaactggtctaggcttaaagagatgaggtattagaaatcagaactttgatggttacttttgtaatacaaaaacaatgacttgtgaggcagcaaagaagccagtaaaaacttttttttttttttttttttgcttggtcagagatctttggctgttggagaagagtaagaatactagtcacaaaaccatttcccagttgtttttaactttatctttgtgttaagagcccatagagaataatagtagtacttaaatattgtgggggaagaagcatccaatgatgactaaggtttcttctctggactatggaaataatgacacgattgaaagaaataggggaaatccagagaaaggcactgactttgagagaaagaggaataagtttagatatgtaaactgttatctgtgaatggtacttttgttgtaatatattgaaaactcttattttgatttatagaaaaggttgctctttatagaatctagatatttgtgcctacatcgtacctttgtctcctcaagccccccaaagccccctcagtttggtttatttgttgcctaatagagttttaaaactacccacatctttatatctgatggacctttgaggcaggacacgtggcacttgttttctagctctttcatttagccaagcatggtcctacacaggcttgctcatacagttaagttagaggtaggctgcacttttgcagcacacattgctgcatttctgagcaatacctgacatcctagactacttagtagtaacaaattgtgttgagccagagattagtggtagttgctttgagatagcttgttagaattagtagcatttctaacctttagatgtattacttccaaacagcttccaagccattatcttatgtactgttggtaattgaagccttagcattcactgtcttgatcaggattcaagcttacaaaattacaagggagagaggactttaatctgttacccattacaacaaagcaatgagcaatgctgtttctacaatctttgttaatgccctgaagaaaaactttcccttaatcactaaaattaaagtagtttttatttgggtctatgagatcttcctggcaaatggaatgtcttaattttgagacttttataggagggagaagaagaggcaaaaaatttgtaccacttgtgtacataaatactgttgatttttttttattataccttaagttttagggtacatgtgcacaacatgcaggttagttacatatgtatacatgtgccatgttggtgtgctgcacccattaactcatcatttaacattaggtatatctcctaatgctatccctcccccctacccccaccccacaacaggccccggtgtgtgatgttcctcttcctgtgtccatgtgttctcattgttcaattcccacctatgagtgagaacatgtggtgtttggttttttgtccttgcgatagtttgctgagaatgatggtttccagcttcatccatgtccctacaaaggacatgaactcatccttttttatggctgcatagtattccatggtgtatatgtgccacattttcttaatccagtctatcattgttggacatttggattagttccaagtctttgctattgtgaatactgccacaataaacatacatgtgcatgtgtctttatagcagcatgatttataatcctttgggtatatacccagtaatgggatggctgggtcaaatggtatttctagttctagatccctgaggaatcgccacactgacttccacaatggttgaactagtttacagtccctccaacagtgtaaaagtgttcctatttctcsacatcctgtccagcacctgttgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcataacctttgcccactttttgatggggttgtttgatttttttcttgtaaatttgtttgagttcattgtagattctggatattagccctttgtcagatgagtagattgcaaaaattttctcccattctgtaggttgcctsttcactctgatggtagtttcttttgctgtgcagaagctctttagtttaattagatcccatttgtcaattttggctttttttgccattgcttttggtgttttagacatgaagtccttacccatgcctatgtcctgaatggtamtgcctaggttttcttctagggtttttatggttttaggtctaacatttaagtctttaatccatcttgaattaatttttgtatgaggtgtaaggaagggatccagtttcagctttctacatatggctagccagttttcccagcaccatttattagatagggaatcctttccctatttcttgtttttgtcaggtttgtcaaagatcagatggttgtagatatgtggtgttacttctgagggctctgttctgttccattggtctatatctctgttttggtaccagtaccatgctgttttggttactagccttgtagtaatactgttgatttttaaaaaatgttctgtgaaagagtagtaaagtagtctaccttaatatcactgccttttaaattaggtgaacagaggaactattatctccactttaaaaacgaatttaagggatatggtccaggtcatgcaaacatagtatgtgatggattgaactgagaacccagccccagtattgtgattccctgtccagtgttcgtttggctacatattctgagtttacactttgttcattgaactcaatcccttttttcttttaaagtacactttcaaaatgattggaggaagggagtgtttttggtaaatgggtttctagtgtacatagagttaagcatccaagaaaggttttgataggtccaggagatagaaactgtgcgcaaagtaggtggagcattgagcaagtaaaaatcccattttgcttgtctaggatctattactgttggcagagaagcagaaggaatattaacagaatagttttcctgctgttgggcatgcagttttgtccatctagaataaatctgttgttggctgagtagagcaaattcctgtctgagagttggggaagcatggctagtgttaaacaagaaactgtgtttcagtctgactttgatgtctgccttccttatgctgtgggctgatgtacatcagagacattttttccttcattttcctccaataagaaatctgttttgccttttctgatggatattaaaaagaaagatttttgctcagtatttgtcatcataaattctcattgctgctgctgccctcaaaaggattgtataaatgaggtaggtaagaatttccagtatatgtaacagtttatattgtagcctttttggtgatattggtagaaagtttccaatattgaaattgttaactttcagttaaagtattgaaattgttaacttgagaatgctttaaaaatatttagagttctgtaatttagtgaatttatggtgtattctgtgtgaggagggggtaggcttttgtaaattctgaatggttagggaaaagtttacctttattaagagttaatgttaatgttaccctacgacatttgaagcatcagcttttaagaagcaagtgctggcaattcttaggatctgaaagattgcgtcagagaattctgtgttgtgactcacttttatttttctagcagattagttggcaaaacanagtatatagaattcaaatgagaagtcagcctataaaatgtgcatatgtttttgtggggtttttttagttcaaataatacaacataaaatttgataaacatttgtcttatatcggactctcaatgtgctattatagagttacagttgttcatttttttgtaccccatttaaaattgtgcagaagtggcctttgtgttttgtaatgagtgtacaatagatattcaagaaatacttatatttaatgaagaaaaataagctactgtcccatgtcaaaaaacatatgacactactgcctaaagataactcttgtgaattagaaaagtaagagaaaaatatctgtagagccagtgagttgttggctctggaggagtggaatgagagggctgtatgtccttaacaaactctagttttgttctgtgtaagatagtaacccaatttatctagcttagttcttttttcttcttttatcatgaaaacatcttgttatcattactttgttctgtctggtgcttaaaatcgtgtttaagaataatstagttcacctttcaaaaattatcagttataaaaattacattgagttctcatgtcttaagaacgagaaacctatgagtacattttaaaaactgtaactttgtatttattttaaacagctttctattacatgtcccagatgacttttctgtgggtcacttttaggatcagtgaggtttcataatcattccatgtacacatttacttttaatatacaatacctgtatatgcttgcttcttaaatgattcagaatacctcagctaggtattttaataatcctggcttattgatggttgctgactggtaaaattccttgttatatttttcagtatttaagtgggtagcattaagcagtcttaatcttttaataccagctactggactggtaaggtgtgtctcagttttattggctaacttggcacctatggtacattttttaaggcagtagtagtatctaaatatgtggtatagcattggtatggaattttctatacaaaactcttggctgtaggttgaaaaagcagcataacctaccaaatttaaggttgtattatgcacagttattggttttgctatatcttaatatcttttgckcagtgagtattcctatttgtaaagtcatgaattcatatatgtttgcagggataggattaacaagaggattattattaaggataatcaaggatgaaagcaggttcaagaaaagattttccttcctttattatctttggtgattgcctttatactcagaggtagccttgggtcagcaaacttaatacttcaaggagctttgaacccagatacgacatttgaattcagttggacaggtgttatcattattggctagacaggaaacctgaagctcagaactacttctacttgtccagttcacactgaatgtcttttattgttaaatgtttttgtcctttcaatgtgcctatgctagattaaaacagaagaatcagtatacatttgctttgttaaattaatacatagttttattgccagtaggctacatacattcccttgaaatgtatgtgcttatggaagaaggaacttttttttttgagacagggtctcactgtgtcacccaggcgagagtgcagtggcacaatcatggctcactgcagcctttacctcccgggctgaaatgatcctctggcccagcctcctgagtaggtggacctacaggcgtatgtgccgccacaccccactagttttttgtctctttggagagacagggtcttgctttgtgcccatgctggtctcaaacagctgggctcaaacgatcctcctgcctcagcctcccaaagtgctgggactacagstttgagccaccacacctggccctagacttttaaaatgctatcaaaataatcagaagggccaattgtgttagctcatgccagtaatcccagcactttgggaggccaaggtaggaggatcggttgaacccagcagttcaagattagcctggggaacatagcaagactttgtttctccaaaaagacaaaaaattagctgggcatggtggcacacacctgtagtcccagctacttgggaggctgaggcaggaggagtttgaggctgcagtaagccacaatcccaccactgcactccagcctgggcaacagagcaagaacttatcattatcttttttttttttttttttttttgagacagaggtttgctcagtcacccaggctggagtgcagtggcactatctgggctcactgcaacctctgcctcctgggttcaagcgattctcctgcctcagcctcccaagtagctgggattacaggcacccgccatcatgcccagctaatttttgtagagacggggtttcaccatgttggccaggctgtcttgcactcctgacctcaggtgatccacctgcctcggcctcccaaagtgctgggattataggtgtgagccaccatgcctggccaagaacttatctttacaaaaagaaagtttatgcagtttttatatgtttattgtagaaaactaaaaccaaatgtaaaccagaatacagttgttcctccctgtctggggagttggttccaggaccccacactcctgtggataccaaaatttgaagatgctcaagttccagaaatataaaatgacccatagtatttacatgtaaaaattatttacaatagctaatacaccgtgagtgctatgtaagcagttgttatactgtattgtttagataataatgacagggaaaagcctgtatgtgttcagtactgtgatacagttttctcttttgaattttcaatatacagttcgttgaatccacagacgtggaaaccatgaataaggagggccaactgtgctcagttttttactatcagagaatttttagtgtgtggcattcatttttttcttgcatttcctattttcataagtcttaagtttgaaataccagcttgctcaattaaagcaggcttttgcttcagcagcattattttgtcttcactagaattatatgaagataaaaacaagctgggaaaaacttaggtggagttggaaaaataagattgaggaaaatacagatagtgatctttgtagtcattctcataaatgaagcttttaaatacatgaatttaactttagggtcagccctgctacacanttccttgctgtgaaaagttagccctgsgagtagaattctccaaawtgggtcttyggaataatacaatgagtaattgagcattatccagctttggatataactcttgtacttaaaagactttagagcttatcattttatgtatttcatttatttcatttagatccatgagagattacatgcatttctgtgatttattagtcactaattttgttttaccatatctgtcattgacactatagataatcagaatttatgtatatttaataacttaacttttctgaccaccccaccccaactccattccctttgttttatgtgtctgttgacttacagtgccacttgaacagcatatcagtgcttcaactcttgatccgtgtggtgacttagatgaggtcagaatagatgagatctttttctctttcaccccacctcttagacagtagcattttgttcttacatcttatgtatattttccacacattgctgttttgtttttgtttttgtttttgttttttttaaagatggagtcttgctctgtcaccaggctggagtgcagtggcttgatctcagctcactgcaacctctgcctcccgggttcaagagattctcctgcctcagcctcccgagtagctgggactacaggcatgcgccaccacgcccatctaatttttgtatttttagtagagacggggtttcaccatgttggccaggatggtctcgatctcttgacctcgtgatctgcccacctcagcctccccaaagtgctgggattacaggtgtgagccacggcgcccaacctgaaaatttatttttaaagaatttattggctgggtatggtggctcacgcctgtaatcccggcactttgggaggccgaggagggcggatcacctgaggtcaggtgttcgagaccagcctggccaacatggagaaacccccatcccatctgtactaaaaatacaaaaattagctgggcatggtggcgtatacctgtattcccggctactcaggaggctgaggcaggagaatcacgtgaacccaggaggcagaggttgtagtgagccaaggtcacaccactgcactccatactgggcaacagagcaagactccatctcgagggaaaaaaaaaaataagaaagaatttatttatactttataaagattytaaactattactgtgatgactactatgtagtatcacatgtgatagtggtaatgagttttcttctgagattaattgcagagcttgtctttcgtatgggtccaatatattacttttcattgtgttttatttgtgcargacaatttgctcttcagttatcataccaaaacaatataaatcctcaactcctttgagtttgttaaagattactataataatataatccctgccaaactaagcatgtgaattcatgcccacacatgggttcagtgttcaaaatagttaaatgctgtattgatttatgtgtttagggaacaaggttgaacaaaagatcttctaaccaattagaacatttagctttcttttttaggcaataaattcctttacttgaaacacagcagaagatattaacatctgcctaaattttttcgttgtcacatatggaagtaagtgaccccgctgtcactgttccatgttttcttgtgaagagctaagttgtcactacccaactgtgacactgcatggaccaactcctgcaggcragtcagaaaaaaagccgggatagtaagaaaggaacctaaaagaaccttaattggaaatttaaaaaacaaagttcaaaggccctgcttttattaatgtatttctgtttatggttttcagggggtgaagccagccagttttgacaaagtagcaattcctgaagtgaaggaaattattgaaggatgcatacgacaaaacaaagatgaaaggtaagttgcctcttttgatctgggtgatacttgaacaaaacctaaaaagtaatgtgctttgagtacaacacayattctacggtgtatttaatatttgtgattggtttctctatttgtgcctgtaacatttttaaaggtagggttttgttcattgtggttattcagatttgatatactggaacactgtaaaaatatggtttggtagagtttcagtaaaccagaaccaccataaacatagctacattccatgagaactgcttacttaaaacatcagcatgatttataaaactcaaaaaagagtttaatatctaacacaggaaatcttttcttagtcctttaccattgaattctaagtggtgaaataaaactttggctctytaaagtcagctcagctattacaggtctgatttgccgtccttacgccagaattgaagaagagcaaaacatcaaaattccttgagtaaaaagagaagacttggcccaggggttggaaggagatgtggcttagtcatttgtactaacagagggcttctcttagaggagtggcaagtatctgatctgccatgtagctgattcancacccgtcaggcatggcgaaggtccagtgtctgtttctgaaaaacagtctatctttgccacccccttccatcctccaaaaaagaaaaaggagaccagctagtacaaatacaaattgcaaattgagcataatytaccacttgaagaatgagagctatcagatgtatcaaccgaattaaaaaattccatcttttcacctctccagtctcgttctttttataacatcgttatttagaagagcttaacttcatggtttttaagcctttattaagtaaaaatttagtttgagttttcatttttatatatgctgggtacttaaatctctttaagaactttttactataaacaaaggaatgtttgtttcaactcttttttttttttttggacacagtcttgtcacgtcgcctaggctggagtacagtggcatagtctcagcttactgcaacctctgccttccaggttcaagcaattctcctgtctcagcctcctgagtagctgggactacagacgcacatcaccgcacctggctaatttttgtatttttagtagagacagggtttcaccatattggtcaggcgggttgcagactcctgacctgaggtgaaccacccaccttggcctcccaaagtactgggattacaggtgtgagccactgggcccagcctgtttcaactcttgttggagcagtttattagatgattggcatattgaaaccattttatcttaagattgtttcacaatcagacttctgcttgcccagtacacaaattattgaacaaggaattaagagaacttactggtgtaaataaagcttgctgtggtagaaagtaccaaactagaaacaaaaatatttattttctagtttctatttcagcatttacagcttttataactgtgagcaagattctcaacctttctgggcctccatttcctaataatcaggagatgatatcaaattgggtgttggtcagacaagatcataaatatgaagatttgtgttacttataaaatgctatataaatgatcatgtggtattttgaagctttaatagagccaattgtgttagcccaccattactagtatactattactaataagatcattggatttaaaaattatgttacaattgtgttagctcgccattactagtatactattactaatgagatcattggatttaaaaattatcactgtcagctcttattcatgaatgagattgttatgatgttttataacttcagagtaaacctctgtaggcacccttcaaattcagcaatgtaaaaatgagttatactttcccctgtattttttcccatttttttcttctgcgaataacaataattggccacatttgaaaattattttttcaaactaatggtgttttatttttgttccttttcttttccctmtgtttggaagatattccatcaaagaccttttgaaccatgccttyttccaagaggaaacaggagtacgggtagaattagcagaagaagaygatggagaaaaaatagccataaaattatggctacgtattgaagatattaagaaattaaagggaaaatacaaagataatgaagctattgagttttcttttgatttagagagagatgtcccagaagatgttgcacaagaaatggtaaattgacattagccattttaaaattgatttagacttatatatatcaatactatcattaagcaaaaaagcagttgatgaagtgccgtgtgtggcatatcccattgacataaaattgtgatggccctaaaagttatctttgattagtgggattttcgtgtgtgtgtgttttttttttttttaaacttctttgtattgcttttataatgggtgttagattttatagtcctttttaaaagtaaattttttttttttttgatggagagagagacagggtcttgctctgtcaccaggctggagtgcagtggcctgataatcatagcttactgcagccttaaactcctgaactcaagcaatccttctgccttagcctgccgagaagctgggaccatagggacgtgccaccacacctgactaatttttgtatttttagtatagacagggtttcaccatgttggccaggcttgtctcgaactccttatgtcaagtgatcatcccacctcagcctcccaaagtgctgggagtacaggtgtgagccacttcgcccggccaaaagttatttttgagaaaatatgtagatatatatatacatagggatagatagatgagatagataggtagaactagtagaatgcattccgaagtcattttgaaaagtctgtaagattgagtgactcccagtttgtataagcatcattcattaagaatgacaagttatgtttctacatattggtacattagcctttgatcagttatctggatgaactctataaacagacataggaccatgaattgtttttactttgaagagagttttcctgatcaaatactagtaggaagcctttgatgtattattatttgaagtatgtctaaaagatcactcttccataaggaaacccttccccaaatttatgcttgccatagtgcccaaaatagctgattattatggaaagataactcagaatatctctactcggatttatcagaaccattcaaaagtggtagttgcctctgagaggagatcaggtatgagttacttatgtttaattgttagctgtttgtattgtctgagcttttttgcttttttggaggggaggagcagtgttaaatcttcatattcgtaccacagttgttttagcagattaagtagttgccttgtaaaagaaagttaaatcaacacaggttaatgttagtggttacgtgtgagggggaratacagtgaatagaacagagtaccttacttggtttaggaactgaggttttagttgccctattgtttcgttgtttgttataaggagtgaaggtatacctacccttcgagtttctgcaaaaatggtggtacccacccctcaagtatctacaaagatggtagggaaatgcataatgcagattttacagttcggttaaggccagtcctgagagaattctttcttcctcctcttctctactttttttacaatgccttttttttttttggcggggggtggtggtggggggtgttgttttctttcaatatactactgcttaatttacccttttattctgtaggtagagtctgggtatgtctgtgaaggtgatcacaagaccatggctaaagctatcaaagacagagtatcattaattaagaggaaacgagagcagcggcagttggtacgggaggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatgtacgtatcttgggaagtggacagataggctaatgattctcctaattggtttttttagcttcttgttattttgcactggctttttggttttgaattatgaatcctactattatacaaaatttgaaatggttgtcgtctagcttctctttattcttatatctgtgactaggagaatagaaggatggggtggtaaggaaatgtgattaggatacaaaataattttataagcttcaacatcttggaggtttcaatttgtagatttctacttttcacaatttatttaaataaaacagatttaataatgaagaatgaacaagcttggctactaaaattgaacccatcagtctggttgagctcttttagcaaagctgaatggtatatagactaaaaactaatgagaacactggttattaatttaattacttgtttaatactgagaacctcctggcctccataattaagactttgaaagctgtgtcaaatttaaggcttatagtgtttcatgctgtttcccttactcctcaggtggtaagattctgtgatagccatatggattcctcatttaaatatagaaatctactgaatatggctacaattcattttttatttagttcaaatctgtgcaaggaataactagttacccctaatataatgggtctaaatatgagaaaatgtgaacctccattttgtgatttgtctttctctctctcttttttttggcgattcatttttccttcagctgatgggacggttgacagtggtcagggatcctctgtcttcayagaatctcgagtgagcagccaacagrcagtttcatatggttcccaacatgaacaggcacattctacaggcacagtcccagggcatayaccttctactgtccaagcacagtctcagccccatggggtatatccaccctcaagtgtggtaagtaaatgcttaagagcatgtaatactacaatgagagccaatggatagtctgctaaattaaaattctttgtacaaaccaagtaacagtatgagtctgaagtagaaaatataaaatgctgtgtctctaaagccttattatagagtaggatatagacattaatgtgtggrcattagctgaactgcctacatgaagcagctatgtgcaagatttagattagtctgcatttttactaaagggaacgctctctttagcacttaagatgttgaaactattcacagcaacaaaagctggacatacaaatgttttgcgggtggggcgagaagagtttttcaaaagcttgttaaaatgattactaagtatttcctgtaagattccctattgtacaaaacacaggtaagaccttcaaaccattatagaatgctgcatgtgagtactctagattgagggaatcctttatttgaatgactgtttaatttagcgcttgtgttgagttaatcatcagttgctgtgtgtgttcctgccttttaaagtctgtgttggacacaagttccttccccagtatatgttcttttgctttttccctttagttggtaactgttttattactgatttattttcagaatcaactyatagaaattatttcctgaaacattttatgcttgtatacacatacacacacacaattatcctgtgttttacattagacactcttgtttctcatatagagaatgttaaagtagatcatcagataataccccatttcttttgttgacctcagaggaaaataaaatacgtcatctgcctctgaaaggtattagaaaataagtaacttgtcactgtacagcacttgtttagtgagatctttaagcagacagattttccccttctcagaaagcttttaatctaaactttgtggaattcttgctcttctttaaatgaaaatctttctctgttaagaaaatacttctgcttgttcgattttttatcctacagcttggaataaaagatgttcatttgtttcagagtccgtttaatcctgctttggctaggtctcaaaatgaatggccacagtaacacaaataaaaaactaatatactaactttttaaaacaatctactttctgtctttaaaataattgagggtagaatagaagaactttataaagactgcacagaaaatatatttctgtgttctgacaaatattacttgtcagcatttcttgtcagtttctacctttaattgwtttttttctggattattataactagattttgctaagactttttttttaaaattttctcttgtctatactcatcatgggggagcattaggtctctattttagaaagcaagtagaatgacatgaagatattatttgagccattaatctagctatatttattgatgctctaaaagcagacgttcttgctttttaatgacagtattctatggaggtattatgaagaattattaaatattgagaatttaaaaatttgtctaattctattcttgtctcatttcaggaatgtggcttacaataatatggacaaattataagtgaaattttagaaattagaataaaagaaataaggctagagagaaatcaaaacaggaatgaaactaaacaatcatatgatgatatgtaaatacttggtattggtgggccacagatttggcccaaagcattctacacagccaagttttggaaatgaaaacatagtttcatagttcacaacatctaaaaggaaaataacagtcttattcaagacaacctttatggtattgatcatactgccttatagccatattaaaccctgtgcctgaacatttttttaagtttttttttttttttttgacagcstctcactctgtctcccaggtgggaatacagtggcgtgatcttggctcactgcaactttcacctcctgggttcaagtgattctcctgcctcagcctccccagtagctaagattacaggcacccatcaccacgcccagctaatttttgtattttttttagtagagacacagtttcaccgtgttggctaggctggtcttgaactcttgacctcaagtgatccacctgcctcggcctcccaaagtgccaggattacaggtgtgagccaccatgcccggcctaaattattatttagagattcagattgaagatattctcccattgattactttgtaaaagtacaaaatatttcctatatccagttgtgaatttcttctagaaagctaaactttttcctagtagatcatgacttttttacctttacaaataaagagtggcaagtataagaaatactgtgagccaacaactttccatctcatgtcttctaaaatagaaatgagaatctttttctgaggtttccagagctcttgcaaaataatccaatcttaaaattctctgtatcttttaatgtactttaaactaatagaattcattcttgttgaatcttaagtttgccaaagttgcaagctaatattcattgttttccctgtctgcacccttcagtcagttggtcattcttaaattcatacacttgtaacacttggtgttatttcagaatatttagcatgataactgatcattatcatgatcattcattaaacctgtccttgactgacaacgcagaatagttgtgaatagttgtgatctgtcagatgtgctatgttgagttatagctctcctcaaaaaaaaaaactgactttgtggaattgggagaggatggaacatttcttcatgcaactatgccctgttatcattgtacttttgtttattttgttttcacagtactgtgtttttcatgtgtgtgtttgttttgtgttgagcctcgtcgtggccgtagcatgtcggtttgtgttcccatctttctgctgttscctctgtgtcccgcatctctcccagtgctcttccaccccaccgccagtactgtctgcacctctttctccttccctccyccggactgccccgaggaaacttttgccgaaaagctttctaaagcattggagagtgtcctgcctatgcactctgcctctcagcgcaagcaccgacgctccagcctgccttccctctttgtcagtactgtatgtaactgtaaacttctgacaaatgaacaattattaccaatgaatacatccaggcaacaagaattttaattaaaattgaataaagaacaggactaaacttggttatattatgcttctaggataccagttattcctgtaggaaacttttttgtaataaggctttaagggggaataaaaagcaaggaggtaatgagagagaatacctataatgtccttggcacataccagcatgtgtccaataaaatttacctttcattatatcttcctgtttcctatcgacataaaattctttcattttcatattctagttttaaaaggattaattttaaagttattgccttaatcaaaagcaaattttatcaaacattacccaaacattttttctcctcactttattctaaggagacactaataaaactggatgagtcctttttttttttaataaccttagtcagcaaagaataaccttggagtgaacatttattttaatttaatcatttatgtaagatgatgtatcagcaaaccaaagaactacataatgttcccccatggaagtattttttccttaggtttcaacctaaggtgggactgtagctctaatgaatgcattagatgcatatatagtatgtatgactttctttggctccattaatgtttataaaagatctatcttataaaattattttaagcatgtgggtccttgctgctgcttttccaaataaagaatatagttaactttctgaacnagcaaccccagaattttcagatttttacttaggagaatgaagaactatacagtgttattatggctttgagacataccatgagtaaataacaataaaatgagcattctgactgaaaatagaaatccttatttagctattgtgaacagttgatctactttgccagctcgataaggatcttccctatggaagaatgaaactgaattcttttaaaaagcgggggaggctgtgatagtgaattcttactattatttacttatttatttatgttttggagatggaatctcgctctgtcgccaggctggagtgcagtggcacgatctcgactcacggcaacctctgcctcctgggttcaagtgattctcctgcctcagcctcccragtagctaggactacaggcgcatgccaccacacccagctaatttttgtattttagtagagatgggtttcaccatgtttggccaggatggtcttgatctcctgacattgtgatccacccccttcagcctcccacagtgctgggattacaggcgtgagccaccgcgcccagcgggtaatgaattattatagtgtatattgtttgcatttggcaagctgtgtttctaaatttagtcttaaatctagaactgcttctagaataaaaagtgctatcaaataaaattggctgtcatttatattacccttttcagttgattagaacaccaggatgtcagaatcagaaaattcatggttacggccgggctcagtggctcacgcctgtaatcctagcactttgggaggccgaagtgagcagatcacctgaggtcaggagttcgagaccagcctggccaacatggcgaaatgtgtctctactaaaaatacaaaaattagctgggcgtggtggcgcacgcgtgtagtcccagctacttgggaggctgaggcagaagaatcccttgaacccaggaggcggaggttgcagtaagccaagattgtcactgcactccagcctgggcgaaagaggaagactccatctcaaaaaaaagaaaaaagaaatttcatggttatgcaactcttatttatgatcagaaaaatggacattttgtgatttaactctgtaacatgtttcatgtagtaaaaatataataaaactattaatcatctagcttgggagagataggagaaagacattactgtcactagtcaaattatatatcttttactatccaccaaaaatctcttctgatttctggttagaaggcatactattaattgataagaaaataaaactgaaggcctctaacatatcacagggtaataagaatatagggaaagttagttcaatagtttaaattaaagcacacttcttacagtatagaactagtcgggcttttatgccttgttttagttcttactcttcctttaactctttttctgttgatgtaatttacattaatgcttaagagtgaactttttaagtgtgggtaaaaacgaaataattacttacaaagtttaattcttccatttcctttgagagaggaaagttatggaaaagcagctcttatctaaagcaaagagcccacagattgatttcattggccctggatgtatttaatggatttttactatgcacataatttccagaagcattgttatttatttattaattataaatttagtgtaaccatttcatagggttacacagaactacccagttgtgcatgtctgatgtaatttcacatatgaatgtatgaattacttgtcttattcatgttgatacagcctcagtccatggcgcatccgtgtggggggaccccaacatacccagaatcacagatatttttcccaactattcatgaacgtccagtttctttttcaccacctcccacctgcccaccgaaagtagccatttcccagcggcgtaagagcacctccttcctggaagcccaaactcaccacttccaacccctgctgaggactgttggccaaagtcttcttccacctggtggcagcccaactaactggacaccagaggccgtagttatgttgggtactacagccagtagagtaactggagagtcatgtgagatacaggtccatcctatgtttgaaccatctcaagtttacagtgactatagacctggactagtacttccagaagaagctcactattttattcctcaggaagcagtgtatgtagctggggtacattaccaggcccgggtggcagaacagtatgagggcattccatacaactcatcagtactgtcaagtcctatgaaacagatacctgaacagaagccagtacaagggggccctacttcaagttctgtctttgaatttccatctggacaggctttcctggtaggacaccttcagaatctaagattagattctggattgggtccgggatctcccctctctagtatttctgcacctatcagtacagatgctacacgtttgaaatttcaccctgtctttgttcctcattctgcgcctgctgtgttaactcataacaatgagagcagaagcaactgtgtatttgaatttcatgttcacacaccaagctcctcttcaggagaaggaggtggaattttacctcagcgtgtttaccgaaatcggcaggttgcagtggacttgaatcaagaagaactgcctcctcaatcagttggattacatggctacttgcagcctgtgactgaagaaaagcataattaccatgccccagaattgaccgtttctgtggtagagcctatcggacagaactggccaataggaagcccagaatattccagtgattcctcacaaatcacttcttcagaccccagtgattttcagtcacctccccctacagggggagcagctgcaccttttggctctgacgtctcaatgccctttatccatctgcctcagacagtgttacaagaatccccacttttcttctgtttcccccaaggaaccacatctcagcaggtcttaactgcctcattttcttcaggaggatctgcacttcatccacaggttataggaaaacttccacaattattttaaactaccctactttgcaccataacatttaaattttctattccttatttccctgaatcatggattttggagaaatattgtttaattttatcagtagagtttccccatctttggggggttgtgaactacatatatgcatttaaaaacaaaatgtgagagaagctacctgatttacctattatatgtgaaaaccagtggaaaaaacacaaaaactagaattttagtcattcttcacaatcacgacttctatgcacgttattttcaaccagtagtgaaaatgcaagtgtatgtaatgtatggttgacccagcattatttaggaatacaaatcttaagtattactttcttcctccaaacaagtttttaaaaaataggataaattttttttctataaaatataaaacatggaaaatagggaatgctgtttttgaggtaatattaataatacacagaattttcattagtgtcgaaggatctaaaaagacaaagtatatcatgggaataaaaaaagatagaaaaggaaacagtttaggaatttgccttaacaaatgaaaatgcctttttaaaatggcatcagtcaagcaagttgctgtgcattattatatgtccaaataaaatgctaattcataaaattaaggactgattctaatttttagcaactaacaatctagtgagtggtgggctttttttttttgttataagaatttgtgatatgttgcaagctaaggaacagtagacatcttaggccttgtattttcctcaacaaatttaattttagttatttatgtgtatgagcatatacacacttagcaaataaagacaatgtaatgaatgtaatagaattcaaaagtacagtcagtgtttactgtttcatatattcatttggtatattttatcaaatgtgtacatcttataaaatctacatagaagactatgcagttatatattgaagacatttggatatcctacataaagtactatgtgttgttcttcctactttcttcctatgttcttccctcatcaggagcataaacaactcccaaaatgtgcacaaattatcaattatttagtgctgtactaagacacaaaaagatccagaagcttgacagctatacatgggcatgcagtatattcacatcagtattcaagttgcagcccctattataaatattaatgtattgccagtaattatcctttagactttccaaagtaaaaaataccaggtagttaatttatagacatactacagaaggaatcaatatttataatagttaagctgcagtggaatgtgatattatatccatgtaagctttaaggaaccccttgtaaactgaaatggaatgacaaaagtggtagccttttcatttcgttaacatacctatatatagtcctgcatcatttctcactttctagtgagaaacactrtagttggggtttctcagactcaacactgttgacatctgaggttggataattctttgttgtggtgggctgttctatgtattgtaggctatttagaacatccttggtttatacctcctaaatactagtagcagcaatctccctcagttgtgacaaccagaaatgtctccacatattgccaagtgcccccctgggggtggcaggattgctcctggatagcaatgatcgccctaggtacttggcagttgatgataacagattttttgatacttttgataaaagtcattgtggcactacaagaagtattaccaaattagcattaccaaatacctttctttaattcttcagataaatttcagattgatagtattaatactttgttcctgattattgtatttctaataacaaattttattatgaatctgacgattctagccagctaaaattacagcctgagcagcattgacagcttaggttttcactgtcagtgggttttgcatgggttgggatcagaacatgttgtgtggtatgatccttttctaaatttttcttacaaaagttgacccagaggcctctcccatacataatcaggttaatgtttcattttgatcaagcaaactctgaggagattaaatattcattgcaaaagcctgacctctatacacttactttaggccttctctaatttgttgtgttcacttctttccttcaggcacaggggcagagccagggtcagccatcctcaagtagcttaacaggggtttcatcttcccaacccatacaacatcctcagcaggtgagaacaatgcattgcaacattttatgaattagcagtggccagaacactattttaacttttgtgatttgttatataaatggcctgctaagtttttgaaaggaaaattaagaggcataccatgtcttgtgttcagtaacaaagaaaaaaaagagacttttctgtgtttcagaaaaatctcttttgtttaatatacttttgaacaatttagtagacatacattattactgatataattatctttttaaaagaggattctacaccttttttttgagacaaagtctcactctgtcacccaggctggagtgcagtggtgcaatcttagctcactgcaaccaccgcctcccaggttcaagcantcctcctgcctcagctttccacgtagctgggactacaggtgcctgccaccamactcagctaatttttgtatttttagtagagacggggtttcaccatgctggccaggctggtctcaaactcctgacctcaggtaatccaccctcctcggcttcccaaagtgctgggattacaggcatgcgccacctcacccagcctggattctacacataatttacggtacaaagagtatgtcattccttttctctttttttccactgcttgcagcagtgatttgtcattaccttcattgtgcttgcctctactaatcctgcacttctttttaattatttctaatctgtagaatgatgtgtcagattttacgctaagaagcatctaatgaaaacctaagaacaattacttcaagaacatttatttatttatttatttttatttattttgagacagccttgctctgttgcccaggctggagtgcagtggtgcaatcttggctcactgcaacttccatctcccaggttcaagctattctcacgcctcagccgcccgagtagctgggactacaggcgcgtgccactatgcccagctaatttttgtattacgttctacttatgcctggctaatttagtagagatggcgtttcaccatgttggccaggctggtcttgaactcctgacctcaagtgatccacccgctttggcctcccaaagtgctgggagccactgtgcccagccaaaatattttaacttttgttttggggggcttgttccagaaagttcaaggaattcaagagattagtgtcatcctgatacatccaacagtaaaactggtaattctaaaattaaatatttatagtgcatcactgatattagttaatagtaattatttgcaagggaataatgcatttttggcataattgaatacttattagctattctacataaaatttgtagccactatgtatgtaatgcaaacttcctaatgttagttccccatgtgggttttttaatcagcaaactctaaactggcttctgtttctattagtttttggttttgaaacaaagttttcggttcttaattacaaatggccctttttcagtccaacatatggtcatgtagtcattcsatactggtttaagatcaggagttgcttgtacaagatgaaaatcacttaaaggcactttctacagaaacagttgattagtttgtttatacatgcattcactccgtgaactgaaggactgggacttatatgctttgttttgcacctgtcctttcttccaaacaagactggttaaattcaagtaaacatatttttgccaaccttaacaaaatctgttttattctattaacagttcctaattagaatgcaaattacaagtcacataaagctggttgagaatggaagtactgagtactaatctcctaacttgcttatctttggatgtagacraacaccaatgaactgagcaaattgtatgtgctctgttttttcttttccaaaggaattggttatctgtcttgtatttggggatatgtatgtatacttactatcaaatgaagaagataataaaataattcattgagtttcatgttaagaaagagtgtgagaaaagaagagagcagtaccataaatgtcagattaaaagaattaggtagctacctctccaggagaaaaaaatatggctaaatgctatctctacagcagaaacaaaaattaatttttgtttcagtgatgtttttgttttagatacttttatagcatgtgttgtagaatcacaaaattgagccctcgatayatataggaagtgtattcggtctagaataattaacttctccaaagtcacttagataataagggagctacaaattataacccagaattcaagattcctagaatagtattgtttcttccattttaaataaagttctgcagggacttaatgattctgcaaatgtacctcagaagctgtctttatttgttttaattattggagttccacgtttgaaaaaagaaaggttgaaaactttttgtactatatggatagtctatttttagacatgatttttgttttacgtactttcaggtcccaatcccaccttagagaaccatatctcttgttttattttagtgaggaaagaaatatacttttgctaaaatttactttatttcatgcgtttcttgaacatagtaaatgaggaattgcttttttgtgtgtttttgtagggtctcgtatagtgatatactagatcttagcaaggtaccaaaaatagctgcctcctgctgaaaagctttgtgaccacaaacaaagttgtgaactttgtcagacacagtgccagctacttggaaggctgaggcaggaagatcacttgagcccaggagttcaaggctacagtgaactatgatattgccaccatactccagcctgggcaacagagcatgactcatctcaaaaaaaaaaaagcaccgaagttgtgaactacctaccctactatccataaagtctgtttgaactggtttcatgaggcaagcttgggcagagcatgatgctaaactgttaagctagaccacccctgcctggctgaagtgctgattattagtcagtgggactgcgcacagcagatcatcatgtacttctggcatatccagaggtgacacttctccccagatgctctaagatrtaacattaaccgttagccattgtaaacaactggtttagagatctctttaagatgttaatacaagggtcactgtcatagatgcctctcagttgtcttaagcaaagaaataatttgtccataaaactgctcatttttgacagtcctttcagctttttttcctaattgagttsagatactgaaggtctaccgagctggaccaggtatgactactttgaaagagtctaaataatatagtaaatatatatgtaaatttctaaaaaacaaataaggataatagctaatattaaagtgctttgtacattgtacctacattctcatttaatcgttttaagaaccctataagtatagatgctataattatttccattttactgatgggaaagctgagatctggagaaggtgagtagtttacccaaacttacagcttataagaggtaaaaacagaatttaaatccaaataatctaattccncagctcaccatttgactactacccaattatgtccaaaaaaagggaagaaattaacatctctcccaagcaggaaagggaatatcaggaagactttaggaaaaaggaggcatttgaaatggactttgattataagttagactcagatgtagaaataaagaatattccaggccagaagataaaaaaattatactgtgagcaatgtgaaaggccctaagatagaaaaatagggtacaaaaacaaatgtgcctttagtttggtttaactagagcatagatatgtgaaggtataagttcaggaaagagttgatagagtctaaattttgatatgagcataattttgaattaaggaggatgtattgggggctgggagcatatgattaccatatgcccaaagataacatgggaattcttcctcaaatttatccgttagaaaagaggggaataaccatgtattcagacctttatcgtactctcatattacagggttttcactgtcctttactttgaacaacaacaaaccaaaaaaggttaatgaaataaaatgaaacaggtgagaacaaatgtgcctgcaaagacttcagctcatgtagttagaaatgttcattgagaacatcagacagaatatttttaaggaataaacataaatttagtccttattctcagcaatatgacttcactattctgaggactgtatgtgattttaaacaactggcttaaagatctctttaagatgtcaatataaggkttacatgaataaaaacctataagagaaaggaaaaaaaaatctagttttattttaatgttatgtaaataggtgcttttcactgcacattttacctgaagatacaacttagatggaatgtgttatgttatgccagaaaactgcaggagcgttcataatttagcttcagtgaaggtaaagatgctggtgtctttacctatgtagagtttgggggagagggagcagtatttctgaattaatatatttaatatgcaatcttatttacgtgtgtaaattaatgagttagataattatagatatctcattcacattccttaaagtttaaatttgttcaagttggcaaataaaaaaggttttctggttttttagttcctttttctcaggtgggaaattaacaaatttgtcttatattcagagcacctttagaattggctacatgtggtttatcttagtttgcagaaaataaatttcatgtaattcagcagccatttctgcttctttaaaagttaaaataagaatacattatcagaggccggggcgcggtggctcacgcctgtaatcctagcactttgggaggccgaggtgcacggatcacaaggtcaggagatcaagaccatcctggctaacatggtgaaaacccgtctctactaaaaacacaaaaaattagccgggcgtggtggcaggcgcctgtagtcccagctgctcaggaggctgaggcaggagaatggcatgaacctgggaggcggaacttgcagtgagccaagatcgcgccactgcactccagcctgggcaacggagcgagactccgtgtcaaaaaaaaagaatacattatcagaaataattaaataggaataaaccaaacatgactgctgttgccattatattttagcattcttttggtgattttaattgacataaatataagaagagcaaaaatattatttgtagattatcacctaacaaaatctaagacacttatcaaggtggcaagatacataataaatgtacaaataaatagcttatctttataccagcagtaaccaattagtcgtatgggtataccagcacatacgtaaaaggctgttggttgcagcattattttaagtagcaaaaatgaaacaaccaaagtgtttatcattaggagactgatgccatttagaaattaaagtagtatgctatagaacactatgtataggaaaggcatgtttttgttttgtttattttaacaaaaaaagaaaactntgtgaaaatggccacttacgcatagaaaaaaatccatgaaggttatgcaccaaacgactaatagtggttacctctggagaataggattaggggtattttcattaactttataatatgatgtactagttaaaatttttattacaagcagatgttgtattaaagaaaaaatataaattaggtattagaagatcttgaaagtcagccctaaacttcatttttttttttttttttttttttttttggagacagagtttcgatcttgttgcccatgctggagtgcaatggtgcaatctcggctcactgcaacctccgcctcccaggttcaagcaattttcctgcctcagcctcctgagtagctgggattatagatatgtgccaccacgcccggctaattttttgcaattttagtagcgatggggtttctccatgttggtcaggctggtcttgaactctggaccgcaggtgatctgcccacctcagcctcccaaagtgctgggattacaggcgtgagccaccgcgcccagcctcaagtttttatttgttagacagaaggggcagtactctaggggtcatagtcctgttttgtttggttttgtttgcttgatttattacagaatttagtattcgagtacagttatgttccatgcattaaattaggtgtataattacgcaccatgcattaaattatacttgagtccctagtacatagtagattcccaggtgtcattccctttgccccactttgagttaaaaaataatgtccttgtttcaaaaagagaaacttcatttttttaataaaataagcaatctaaggcattaacagctagtaaatattaaagctaaaatttgaaaatgtctgttattccaaatccagtgctttcctccctattttgtagctataatcaaagctattcttcaagcatattaattatacagttgataaaatagggtaaggaaaaaagattaaaggaagctattggatctatctgatataggtgccaaagagagagctgatgccaagagatagggaaaagggaatggcagggatgggatggggaaaggaactgtctggatatgttatgtaaatgtctttgtaaagacctattgttggggtgagggagataattgggtgaagagccaatggtaacttgagtattaaaagattggttaatttttcctggtggcaccatcacaaagaacatcagagggaaaacaaatatataatggaaattgatgaatttgggtttgtgcatgtcttgattactaaaatcatcattatttacagacactgaaggctttaggtaaacatgcttccttagaaacatgctgttattgatttgaaataaaactgaatcattgtattttattcttagcagcagggaatacagcagacagcccctcctcaacagacagtgcagtattcactttcacagacatcaacctccagtgaggccactactgcacagccagtgagtcarcctcaagctccacaagtcttgcctcaagtatcagctggaaaacaggtaaacttttttttttttttttaaacaggtaaactcttaatttctgaaagggtgctaaaagggatttccatgtaacttgtcctttcatgtggatagacttctaccttttcttctaagggtaaccaacccttgaagtaggttaatctcattgcagaaatgaagtgaagatcacctcattggtgcatatgcattatttaatgtaaatgggtacgttactgacagcagtgacaatccaaagtttcacttctagtcttaccagtccaaaattgatgtaacaggtattagaaataacaggttaaataaaggtgctctggtaactgaacctatgacattccctagaattgtgtcagctatgtctgatattctaggtttgaaactatgctttattttcatgtagatttctgcactgtttactgtgtggaatgtttttttttcttaagtagtcctcctaatcacttgagaagtaccctgtagaaggtatgcttttctgaatgaccttttttcaactttatttttgagtactgttgtgcatgtatgtgcacagtgtattgttaccctaatatttcatcacatctgagatgctatcaactttaaaatgtaccatattttatgtaccacattatcagttataaagtagatcccaatttctcacatgttaaaatgatcaggtagtggagagggatgattgcatcctagaatgagtgaaatatgtgaattataccaatttttattgagccatgttrgacttaagaattttagaaataatacgaatgaaatcttaattccactgggaaggaattcatttgaatttcagtaactactgtaacagcagtcgtaactttagtgatagcattatggtatataaaatatattccaataaagctgttaaaaaaaaaagccaaccccttgtctatggaagggtcctcttctattgccaaatgctgaagcattagcaaatatttctatgacaaaaggtgtagaacagtaatagtctatttagcctctttctctcctgctctcctttccatattyttatgtggcatattaacttaacactaatgtatgcagggttttgttggtttggtgtttttttttttgtttgttttttccttctttttggctaatacataaatcttgcttttggcagccttgctttttttttttttttttttttttaagcctgtctgttttgtttttctttaccttcccagcttccagtttcccagccagtaccaactatccaaggcgaacctcagatcccagttgcgacacaaccctcggttgttccagtccactctggtgctcatttccttccagtgggacagccgctccctactcccttgctccctcagtaccctgtctctcarattcccatatcaactcctcatgtgtctacggctcagacaggtttctcatcccttcccatcacaatggcagctggcattactcagcctctgctcacgttggcttcatctgctacaacagctgcgatcccgggggtatcaactgtggttcctagtcagcttccaacccttctgcagcctgtgactcagctgccaagtcaggttcacccacagctcctacaaccagcagttcagtccatgggaataccagctaaccttggacaagctgctgaggttccactttcctctggagatgttctgtaccaggtattgtgttagttagcaaaagagggcaccacagagtttgatcctagtagatcatcaggaacatggaaatctaatagttgagtgtcagaataactagcaataacatgtcaactagagaagcaaaatagtaaaattctgagaaaggattggataatgatgttcagtgattcctgatccatttttctcaagacacttcttcagagaaaaatggttctctcagtattcactgtaagctgattgaatgctagatgtggttaatagtacacctggcaacttttacatatatgggtagaataaatagaatagccaacatggtatcaacaaaaagcttcggggtttagactgggaaaattagcatttcatgatatgactgttatgtggaagaatttttgcatttttccatttaagattggctaggaagaaattgtgttcctcctatttaaatcatctctaggtgaagataaccgacaataaagtagtattgtagagtcctgtctcttctgttggaaccagtctactacttcatttcaagaatgtggtctttatatgccctttagattattagaaagagattggctactattcttctttgctgtgtgcttcttttttttttttttgcatgtcttgctgttttgctaattyattgacccccaacctgctctaactcaccttcctcatttctgtcacagggcttcccacctcgactgccaccacagtacccaggagattcaaatattgctccctcttccaacgtggcttctgtttgcatccattctacagtcctatcccctcccatgccgacagaagtactggctacacctgggtactttcccacagtggtgcagccttatgtggaatcaaatcttttagttcctatgggtggtgtaggaggacaggttcaagtgtcccagccaggagggagtttagcacaagcccccactacatcctcccagcaagcagttttggaggtaaatagaattactgcatgtttatatgtaaaacgtatatatgtaattggacaacaatgataaaggagaaagaaacaggctcccctggtttagaacttatttggagaccatgtcaaactaacttctgcatgactttttcttacagcagaatgaaatgccaatgtggggtccttgtttccactggctgttctgttgggaagtgagtgtgccttggagaagatgaaccctattagcacttcacttctctagctagtactttagccattattcttgtcctttcacaaactttttccattggcagtcataagagtatcttaccctcctgtgctctcagcaatcatttttgccctgctaggagaagatctgaattcatctttgtactatgctctgtctgcgctattgcacactcttggtaagatgctggctgcatggcaagttgtaggttcacactgcctagcagatatgttggctgacctcataccatgcagtctataccagagactagctttagcaacttcctttggaattttaagaccattatctctagatgctgaatattgagaatttactagtaaatttagtgcttctaggacgtagtggggagggataaggaaaaaaataagtagattattggggatagtgaatgataaatctattactaccgaratttgagttatcttttcgattcacagagtactcagggagtctctcaggttgctcctgcagagccagttgcagtagcacagmcccaagctacccagccgaccactttggcttcctctgtagacaggtacgtaaaactagaattctccttccttgactggtaaataagacggtatgaaaygccaaactgtcagacctttaaatctcatattataaactgcacttttttttctttttaaatttcaaagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtaagtattcctaatttgtgagtttcatgttgttaaaggaatttgacactgaaaaagattttagaggtcatcaaatccaaaccactcacttcataaaataaagataactatctgtgtgtgatagataattttttttttttttagacggagtctcgctctgtcgcccaggctggagtgcagtggcatgatctcttctcactgtgattgcagtgcctcctgggttcaagcgattctcctgcctcagcctcccaagtagctgggactacagacacgtgccaccacgcacggctagtttttgtatttttagtagagacagggtttcaccatattggtcaggctggtttcaaactcctgacctcaggtgactcacctgcctcagcctcccaaaccactgggattacaggcacccagccagataatttatatagtactcttctcatttcatgcccacagtctctttgacttaaatatcacatttttagaaaaatgaaaaggtagttcataaagctatgatagggccagcagttaatatcatttaaatatttcttaaggcttagatgaattgatgaatgtataggatcttataattagccaaatgatattcttacattccatatttctatgataaagcactacttatcttttagaaaaagaatagagagttttagtaagtagctcaaaggctaacgtcttctcaaagatttttcttgctaccagtttaagagacaaagtactagtgctccaaggaacagcgataacactatgcttccttagacataaagtcaagtgctaatctgcattgcttttctgaaattcagtaataaagctgaatatggtctttggagatgatgtaccttttttctttttaggtttcaaataaaggagaccgagtagtagaatgtcaattagagactcataataggaaaatggttacattcaaatttgacctagatggtgacaaccccgaggagatagcaacaattatggtaygtctgcatttggagttctaggtttttccttagtacttgatcttaatagccattgctctaggcaaatatgccatattttataatccatgtttttttaaagttatgcatttacttcaatgtgaataaaactatcacacccaacctgtgatttagtgatgtttttgtctaggctatgtctaactagatattgaagttcttaaaaagagaagagctaacttgagtacaaaataaataaaaatataggtaagtatgcagataggacagaagtcataaaagtgacataaagtttgagaaatgacactaattagactgacatcacatttctttwacaggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcaggtaggttcaccactcccatagtgaaactttgttgatttaaaatattttcatagttctaaatttgctatgcaaaatgtccagtgatatcacctgacacccatgaccgacaacaaacttttatgttctcttcacatgtggcagtttgctttgcctagtcattgagattgcatttgagaatgtatttaatcacttttgtttgttgtagaaattggaaggagagttcaaacaaccaattcctgcgtcttccatgccacagcaaataggtgaatttattttctttccttgtttttacctttgacttaagaagccattagccgagggtggtggcaggcttctgtagtcccagctactcaggaggccgaggcacgagaatcgcttgaacccaggaggcggaggttgcagtgagctgagatcgcgccactgcactccagcctgggtgagagaatgagaccgtgcctcaaaaaaagcagttgtatgtgccaataatgaagtctaacaatatttataataataatgctattaagttaygtttgtttgtttgtttttgaccaggcattcctaccagttctttaactcaagttgttcattctgcgggaaggcggtttatagtgagtcctgtgccagaaagccgattacgagaatcaaaagttttccccagtgaaataacagatacaggtaagggattgattctgccacattgttatgtaaattctacagtgcctctgctatgttgaaagcttaatcataaagcagtaatttatgatgacacagataataaaaaagaatagaaaactgaagttataaccaacagataaacatatgggagagggaaatagatgaagaatacagagaattacagaaaaagccaagaagcacggccataccaagatatagtctgtataatagatattgtagtakgtgtttatttctgcacttagtactgttgtctatgttttaagattactccatattttttatcaaaaacagatatttataggagctgacttaggctagcagacaatcttttgaatccatccttttaaaatcagctgattcttatctttttgtattcctttgcagttgctgcctctacagctcagagccctggaatgaacttgtctcactctgcatcatcccttagtctacaacaggccttttctgaacttagacgtgcccaaatgacagaaggacccaanacagcacctccaaactttagtcatacaggaccaacatttccagtagtacctcctttcttaagtagcattgctggagtcccaacyacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtscattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtaaaattattgttataaaataattagataaatatgatcagttttttttctccctaatgagtacatttttcacttcagccttgtaagttagaaacatatttataaaggtacctggcttatagtatttnttaaattgacagcagtttgagggtatatctacaatgaacatgagatttttttttcaagtgtggcaggattttagggttaattatgctgcacagttttccaagatggtataattatcgggtaaaatacaggtatttcttctgaattggtacaaactgaagaagtctgtatcccaaaagggagctaaatgcatctgtcagcaaaatgtacgtaaataatagcagttcatrgtctttgtttcagtgagaatgaagcaaatttttggttttgttgtagattccacagttgtacagtttggggsttataaaaaattggaagttagtaaggaaattgatacagaggagaaataaataatctaatcctaggactgaagtaactaaaatttattatctaattatgctgtggtggatttcctcttgttctgccaccttctccaaataacaaggctgtgttacgtctactgtattgtatgcttcagcctctttctgcattgccattgatgtgaggttctttttatagtaggataatgcagaatcttcactcagataaaatagaaattcttgataatagtattagatttctgatgccttttgttatcagacctgcccattggttatttcttaaccagttactgttttcttttctcagaaaatcttgttttacatggcgaaagtctgatacatactgtaccaaataagtagctcaagaatatctggacactgccacttatgtacatatagcctttgttctgttctccctaggggacaactttttactgtattttactattcattttataggtatatcgtagtaacccctataataacawcattagttgtcacaccgtttttttaagacagataccagagagtaacctcagtgataaacatgtcttaactatatatattttattcttatgtttgtgcattcaaattagttgatttgctcttcagtacgcagtctttatatttagcgtctcayggacttgattttccctttgttgtctgtaggtgctgccagtgggtactgaacttccagcaggtactctacccagcgagcagctgccaccttttccaggaccttctctaacccaggtgcctcaagacttgacaaatttcttcctgtgccctactttctttgacaaagcttgctgaagttctccactacgtggtcttggcttttgcctatttgtctttgacttagtaacacctttcttttaaaatgttataaccaatgacccagttcctacttaagtaagaagcttcatagctcttttgtttgtaatgttgcttccggttatccaaaaacacttgatactaattttttttttatatcttatgaaggaagaaaacagcaaagcaaacattttgtcagacccatatagctccctttatcactcacacttctgtagaatagcgaaattgcgtatataatcaaaattaactttgagagtgccctagaaaggagaagcacaatatggcaactgagaaactttttccgcgagtccagagcaaccagtctcttcttgaatgttgatcatttctttcactagccacctaatgaaggaattagcttacttataggtaggtataggggtgatgtttcatgaaaactatgtgtgctgtctcttttaaaataaaagccaccgagctcagtgagatgctaacattatgagatcactcatggaggaactgagaccagcctcatgaacttgagattcccatctcacagtcagttctgctcacttgagtgcagtggtggacagaattacctgtaatatttattatttctctttcccaccgcagtccaccgccaacacatttgttgaatttccataagaaaagtactaattgtgaatctgttgtgaccaggaaaaatcttctgacatgagacaagccagtaaacttttaaactaaattaggaatttatttttgaatcatatataagaaataagaaaaacatggtaaattgcttacttgagaagctgagttggaatttatccctatttctttggtcccaatgtacaggggaacactatttgaggaacttgccacaatgaagtaaaaaccccaacagagaaagcactccatcagccaccacatttgggggaaagtgcattgtgaaagtccgtaaatcaggagttagaaaattagttttaaacttattttctcatttaaaaacatggattcagatttctaagggagtataaagtgtgacaaaaaatagcaagtgagacatgtggaggggtaagggtaaatagctagtgcctagatagagggaaaggcctaagcaaagactgtgcaagaatagattgatagaagccaagacagatgtaggattagactgtggaagggtagaaggaagctgtgtgcttgcggtggatggaatggttaacaggatggaatacccagacctccttgccaccatctgtagggaagaagtatacatgtaagaaagargaaaataataccctgtgatagtgacagaatatgttaatgccatcttttattcataggggcaccttcccagaaagatgtataaaactgagaaagaaaagagggaacatgagatacagtgaatctaccagtagatctttgtacatttttcacaatatattttaaaggtcgcacaaataaataactctttctaccgttttgagtaacatcaaacatagaatgtaataagacttctcttaaactgcaaaaacatgaactactctgagccttgagagtctgacatacaatcttgagaaactggcaaaataatcaaagcagtacactaaatttgagtatagttttgtatgttccataaagacaaatgttatgttgtgccaatataaagcataaaacagtgtgtcctatctaaattggctatatatcgtgactctgaaggtgccacggaactgtatttactgtgattgttttcattcagtcccagcaacctctagaggatcttgatgctcaattgagaagaacacttagtccagagatkatcacagtgacttctgcggttggtgtaagttttgaaaatcttgataaaatctcctcataaccctaatatattatatgcctgggacacaaactgtaacctaaaccattattaatacctttaacatgtattcagagttcctgcttattctagccaaaagaaatgagactgattaatgaaagattcatgctgactcaggagtatcactatggaaaagattttatttgaaaggtgcttttttagttgtacgtctggtcagattgtgccatagatcaattctatggatttcgtatttttgtttcagaggaggctaaattttgtcagataaaataatgttttgggctaggtgcagtggctcacgcctgtaatcccagcactttgggaggccgaggcrggcggatcacaaggtcaggagatcgagaccgtcctggctaacacggtgaaaccccatctctastaaaaatacaaaaaattatccaggtgtggtggtgcacgcctgtagtcccagctactcgggaggctgaggcaggacaatggcgtaaaacccaggaggcagagcttgcagtgagccgagattgcaccactgcagtccagcctgtgtgacagagcgagactccatctcaaaaataataataatgttttgattgaaactgtttttctgtgaatatccaagttatacccttaagcatcctatgagaaaaattaagaaagcaatcaagaattaagagtagaaattcattcttttaaaatgtacctttttttttttttttttttgagacaggagtcttgcgctgttacccaggctgtagtgcagtggcacgatcttggctcactgcaaccatcacctcccaggttcaagtgattcttctacctcagcctcccgagtagctgggattacaggtgcccgccaccacacccggctaatttttgtgtttttattagaggcggggtttcgccatgttggccaggccggtctcgaactcctgacctcaaatgatctgcccaccttgacctcccaaaatgctgggattacaggtgtgagccaccatgcctggccctaaaaggtgcctttctttacatcagacttttagactttaaaagaaaaaggaaagaagataaaatgttctcagacataagtgtttcatcacatatactgtctttctgcccttttacaaagaccataggaaaggcaacgaggcaaaagtttgagtgactgaagctaaagatttgtggtgtctgtctgtgtgtgttttacagcctgtgtccatggcggctcyaacagcaatcacrgaagcaggaacacagcctcagaagggtggtgagaaacatccttcctccttttatattactaattccagccctacccgtagttgattcaggaggtttaccgtttcaaagacncatttccacgtatttgataactgaggagcattggtagtaatatctaaagcttgaaagattagcaaattaataaatctgttccgttattatttgtcagaggaaaggttatacaggaggtaatgataagacccttcattattagctatgccagatccttgctattagagattaggaaattaaagcatactgtatttagaaaagtaaatttactgataacctcttagcttttgtgacactggatatatagggatagaagcttgaatagtctggacatatatttgtattgaaatacaaatgtaagatttcagttaatcaatttaaacatttttattttcaaggcaattatattctcaattggctctcattttaaaagtgatttgcaaatcattagaatggtctagaaatggaaaaatgaaaggggantgtagattatcaaaatatgtagagtatcaagtatgtacaatgaaaataataaagattactaccaataaaaagagaatgtagaatatgaaaaaggtagcttttcaaatcattggaagatggaatatttctttttttttgaagtggagtttgctcttgttgcccaggctggagtgcagtggcatcatctcgactcattgcaacctccacctcccaggttcaagcgattttcctgcctcagcctcccaagtatctgggattacaggcatgcaccaccacacctggataattttgtatttttagtagagacagggtttctccctgttggtcaggctggtcgcaaactcctgacctcaggtgatctgcccgcctcggcctcccagagtgctgggattacaggcgtgagccaccgcgcctggctgaaagatggaatatttttataagtggtttagaacaacttgaaagccatctggaaaaaagcaaaggtggatcactagcctagacataagtaaagtccaagtggaccaaagatgaaatattatatcataaaatagtactatatgaaatcataaggggattttttttctttttttttttttttttagttttttaatttattagtaataacaacttgagaattgcatagtattaaggcatcagttcttggartgtgggctgaggacccttttggggtgcctatgagggcaacactattttacagtaaaactaagacattattttcctttttcactatagacaaaaatttagccagctgtggtggtgtatgcctgtagtcctagctaatcgggaggctgagacgaggattgcctgagcccaggagttccaggctacagtgagctatggttttgccactgcactccatcctaggtggcagagtgagaccctgtctcaaaaaaaaaatcatgcatgaacaaaaaaatgtataggtcaatggattttaatggccacagttatgaatatcttattactattatttcagatcccacattataactaactttttttttttttgtggcttggaaatcttttttttttttaattttattattattatacttttaagttttagggtacatgtgcacaacgtgcaggtttgttacatatgtatacatgtgccatgttggtgtgctgcacccattaactcgtcatttagcattaggtatatctcctaatgccatccctcccccgtcccaaggggatttttttcaactatctagagcagggttcacaaactctttttctgtaaagggcgagatggtacaaattttaggctttctagaccatatagtctcttgcaacttactcagatctcacaagtagcaatggacaatacataaataaatgagtttgtgtttcaatagaatttatttacaaaaacaggcagtaggctgaatttggtccatggatcagtttggagttctcagataagtttaatagaggtgttaagttcaatgtctaatccagaagcaagtagtaatagatataaaattttcttcatggaagaaaagtgccaccgattgcaaatataaatgaaaaactggggaaatatatatatttgtgggagggggaggggtatgtgtagtcatatcacaaaaagaactcnttttgctaatacaaagagttcctaaaattcaacatgaaccaaaaaacaatcaaaagataacagaaaaggaaacttagacatgaaaatatttaatgtccgtaatgatagaaacacaaagtaaggctacaagtgatagcaattcccacctctcattggtaaattcaggggtctaatagccaccagtgacttggtacagcctctggggggatcartttataatagtgatgtctactacagtcttaaatggaaataattcagcactttcattgtggtatatttattgtacagatctataagagaatatttatttctaaaatagcaagaaattctgggccgggcatggtggctcacacctctaatcccagcactttgggaggccaaagcaggtggattgcttgagcccaggatttcgagaccagcctgggcaatatagtgagacccccatctctgcaagaaattttaaaaattagccggatgtggtggtgtgcacctgttgttctagcttctcaggaggctgaggaggaaggatcacctgagcctgggaggttgagattgtggtgagctgtgatggcatcactgtactccagcctgggtgacagagtgagaccctgtctcagggaaaaaagaaaagaaattctgaataatttaaatgcccatcagtagaagcctgattaaatatgaaatatatatatggtatatacatagggtatgacactatgcaatcattaaaaagaatgaggcattgatatggaatgatctcaaagatatagaattacatgaaaacataaaaatcgctcaatgttctactagctgtataaaataaatatatctctagaaagaaactcaaagcattgttccccggaaaggtttttaaattgcccaaaactaaataattctgagggctgggtgcagtggctcacgcctgtaatcccagcactttgggaggctgaggcgggcagatcacgaggtcaggagatcragaccatcctgactaagacggtgaaaccccgtctctactaaaaatacaaaaaattagtcgggtgtggtggygggcgcctgtggtcccagctactcgagaggctgaggcaggagaatggcatgaacctgggaggtgtagcttgcagtgagccaagatcgcaccactgcactgcaacctgggcaacagagtgagactccatctcaaataataataataataataataataattctgagaactgtactatcctattctagaatttgccagtgttacattgagaaaataaaattagctggttttcatttaacaatggatcttggctggacatggtgattcacacctgtaatcccagcactttgggaggctgaggcaggcatattacctgaggtcaggagttcaagaccagcctggacaacgtggtgaaactccgtctctactaaaaatataaaaattagccgggtgtggtggcacacgcctgtaatcccagctactcaggaggctgaggcaggaggatcacctgaacccagtaggtggaggttgcaatgagctgagatcgcaccactgcactccagcctggccaacagagcgaaactccatctcaataaaataaagatgggtccttaatgtcctcagtaaaatctcatccttcatttcayttacttatatatctgaattaaagaatgagtaattgagtttttaaagcctgttaacctttgtttttatagtatatgttaatgttgtagttggtatctagtagtagagcaaacaataactcttttcccctgttggacagagcctcatggagggaggagataaggaagttctctttgcctctaacagctttcctcatgtgtagtttgattttgctgtatttctagctaaagggaaaagaagttaactggaaggagacacttatgttttcctcatccatgtatttgtttcagtttctcaagtcaaagaaggccctgtcctagcaactagttcaggagctggtgtttttaagatgggacgatttcaggtaagacagtcactttgtgttgccttgattccttcytttggaggagttgtctatataataaaattactgcctacctatttgggacacaattgccagtctagtgatttctgtcacatagtactttatagctctttttagcattttcctaataaaagtaatatatactaaataaaatatagaaatacttagaacagtagagacacggtagatagtcgtactatctatccacccacctcccaagattactttttggggtgtatttccttccactccttgttttctgtacaagtgtttatctaaaattaactaccatttctcctgttccaaatgttacagctttttttcccatccagtaattggtttacctaaccagtctctatcatcatttctcatttttccaacataataagttaagtaacagcaaacatctttgtgtataaaaatgttttccacgtttaaaataattgtcctaagattaattctttaaattaaaacacatgataccatatcactttattttaccaggttgtccaacatgtgagcattttctggctggggagagtaggtgatatttttctcatttgtaaacaggtcctgaacctttataggtgggctgagtttgtatttgtaaatacatggacaaaccagaacaaggatctggatcctcttttttagttaccagttagttgtgttgattcttgaggcataccaggcatttaacatttaccttgtagtttttcttattcacaggcaaccctaaaaattctacaatgccttgctaatttattttatttatttacttttrttttatttttttatttttatctatttatttatttttgagacggagtctcactctgtcacccaggctggaatgcagtggcatgatctcagcccactgcagcctctgcctcccgggtttaagtgattctcctgcctcagcctcccaagtagctgggattacaggcacacgctaccatgcctggctaatttttgtatttttagtagagacagggtttcaccacgttggccaggctgatctgaaactcctgacctcaagtgatccacctgcttcagcctcccaaaatggtgggcttacaggcatgagccactatgcctggccctgaccttttgttatgtatatgttgactaagacataaatctgaattctgtgtatgacatcaaatacgaaagtaaattatttactttataagcgtagccagccacacagaatctgcatctcagtacccatgtgttctctatgatggtattcaatttttcttcctagtcaaaagtggaggcgctatgtaaagagacaatcagcctactctttgacagggaaataaagtgattcttttttyccttttttaaattgtctgtgatagaaattggatattgagaacttaagtttttaatctttgtccttttttatcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagaraagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataagtaagtatattttctcttgtgaaagaatgtcagataaggttttcagacctagatcccagggccaagattaataatatttttcgccacaatatgctaatgtctcatttcttttaaagagacagtgccacagaagccccaccccatacctccccaccacacacacacacacacacacacacacacacacacacacacacacacacacaygattcccaaccactgactcacaggcacaggcagcttctcttgcactcatacagacccatagcatttctagttctagaacttcttcattgttactatattattactgtattattgttactgtattgtattattatttttattaatagcatattgtatcactattaactgctctttatttattagtccactaaatgaatctggcactgggatgtatgattatttggcacgttttgtttggcagattgggtcagagtagcaaattcagctattgtgtgcgtggcctcaaaagtcaggaaatgtttttctcctaaaacattatcaaccatttgttgttggctaggagcttgttggaacatggcttgggtaatgcaggccagcaaggtgagttgacaaactagaatctcgtggtagtacatttggggaaaaggttcattagtaactactacatacttgaaagcaggtttaggaatatgctgttaattcttgtytgaatgaagaggattatggtattttgaattatgtttggttatctttcacagacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaaaaagccctggactaggtcagccacagctgtcctatcttttgtttctgtctccagctgtatgtgacctgctgaacatttgttgtttttgttaaatttcaaaggaatttggctctcctgatatttttgcttccttgactgctgtacttacatttattgtacctctttttgagtctatagaagtagacttagtgaatacaatggcttattccattgtaatccatattgctatctactggtaatctttatttatagttattcttaaggatagacatttagctttgcctgttaactcgtataactcacatttaaccaaactcttgggcagttggaagaaaatacattattctctgtttagtaaaacttgggtagattctttgttttaatggatgacttagtcataattgcaacttagatgaatgtaatcgtcatatagatatttgtgtgtatgtctaagtggtaacttcttgattaaggtttttatttcatttatattgggttaaagaacttgctagtcattggttaggcacggtggctcacgcctgtaatcccagaactttgggaggctgaggcaggcagatcacgaggtcaggagatcaagaccatcctgactaacacggtgaaaccctgtctctactaaaaataaaaaaattaggtgggcatggtggcaggcgcctatagtcccagctactcaggaggctgaggcaggagaatggcatgagcccgggaggcggagcttgcagtgagctgagattgcaccactgcactccagcctcggtgacagagcaagactctgtctcaaaaaaaaaaaaaaaaagaagaacttgctagtcattaaaatcaaagaaatagttaagtgatactcttttgtaatgtagtatatatatatatttatttattttaagagacagggcctcactctgttgcccagactggagtgcagtggtgtgatcatagcacacaacacaacagcctcaaactcctaggctcaggtggtcctcctacmttagcttcctgggtagctgggattacaggcacacactaccatgccctgctaactttgaattttttttttgagacagaatcccgctctgttgcccaggctggagtgcagtggcacgatctcggctcactgcattctccgcctcccagtttcaagtgatcctcctgcctcagccccgcatagtagctgggattacaggcacatgtcaccatgcctggctaatttttgtatttttagtagagatggggtttcactatgttggccaggctggtctcaaactcctggctcaggtgatccacccaccttggcctcccaaagtgctgggattacaggcgtgagcaccgtgcccggccctggactatattttaattgggatagatagagagtttctaatcctttggtgaaattatggtagtgttaacacaattagttgaaaagtaaaagaaggttaaaataygttaaaaagcagttgcaaacttcttagcagttccattctctggaaaggttcacagatatccaaatgtagcacattagggccagttcatgcagcccattagtagagatgtgattgtaagagaaatcagctaatttctgatctgatcccaatcagatcttttttgttttgtttttgtttttgtttttgtttttttgaggcagagtcggcagtggctcaacctccaactcccaggttcaagcaattctcatgccccagcctcccaagtagctgggattacaagcatgtaatcccaaaccaaatgtataagaacacytggctaatttttgtatttttgtatttttagttgcactatgttggccagactggtctgaaacttctggcctcaggtgatccgcccgcctcagcctcccaaagtgcggattacaggcatgagccactatgcccagctatgatcctaatcaaattctaatcctaattttgacatactttttgagtggacttgaattcaactgggaaccggggagcagagagtcaattttaggacaaccgacctattgaaagcaacctaccaaaaataattttaaacacccattgctctgtagtgacctccatcatttttgaacacctcttttgtatttgctctgatgcacgtttataggaaagtctaagcagagactgcctagcaaacctttttgtataatgattcaacacattttctaatagggtaaaaaaaaaagcaatcatggaattgcagaatggaatctgggtatccactaggtactctggtcttcttacgctgctcagacatgtggcccatctaggttttctaaagctaaaaagctctggaatagtacatatggccctattacctatggattcttttcttttttttttttttttttttgagtgcagtggcatgatgtcggctcactgcagcctctgcctctgggttcaagcaattctccttcctcagcctcctgagtagctgggattataggcaccctccaccacgcctggctaatttttatatttttagtagagacagggtttcatcatgttggccaggctggtctcraactcctgacctcaggtgatccgcccaccttggcctcccaaagtgctgggatattataggcgtgagccacaacacccagcctatctattgagtcttagtgtcattcctcacttctcccgttagtgaggactttgttcttctcatcagtttgtagcttttgacccatcattcatcactcagtggaacaaaccaaatgtataagaacagtgcctgatgagtgcatgggaagagctggacatgtttcctcatgccactttatcttttggcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggtaataaagcaaccatcatcgtccaaaaacaataaaatggagatgttgccatacctgggacaaaagcctgttaaggcgsgttgggagactagctgaccagaacacagcctgtgtgttgtacactgaagaatctggrtgaaaagggaagtggagtgataatgagaatcggtgggctcactgctcccattaggtgaaattactttttttcaaggaattacagtgaaaagttacatctgtgtggcctatatgacttgctcatttgggatttggaacttaggctttaatattaggctgagatttcctggatgaaattctaaggtgttttagcagtttctgaagctaatacattttcttagccattgtagaattttgttacttttaagtatgggagtggcatactaaaatgaataaccttacaattcagttttttatccataatctactttccaaatatagctctgtttattagtgattgctgaaaaaattcccacagaggaaagagcttttagtcatattagaacaagaattgaaaagacttgggcatctgggtgagaagaatgaaaaaaayataggtactggcttatgtgcctttgccacagtttcacagaaattagagatcagtctcttcacaggaagaatgcacttgattggtaaggagggcaaactagctagcattattcgaactaagaaaagcttccgcattttgcagatgggtagaattaagacctaatatttcatctcttacatatctgaccttccccccagaagcttgttcttctgtgtgccatcttagtgcatttcaccactccagcctcaagtttctaacatcttgtagttgtgttctgtctcttctcctctctctgttctaccctgtttttcccctctcacaggctgtgcgaagtttaactgtgcatctgaacaggtgacattcaaacctggtggcaggaggacccgatttctgagtacgccctgcttggctctttgtgtgtaacacctttactccttccttgtccttgtgtttctgctgcttggatctgatgtttcacgcagtccattttcatttgtctctttttgtatatcatctactcagtggcttggctgaattactgttaccctcagaagtttgggcccccacattaattatgataaaaaatgtcaaaataacaagttatctacaaatttcaatgtaactttctggtagaagtgcttcttcatggatctgtgacagagagtggatatggtatctaggcaatagattgctgggtcatttagaataatgaagactgaactccacagtcgtagtcagtgctgtctgtctgccctagcattagaaatgagagaaatcagccagacacggtggcgtacacctgtaatcccagcactttgggaggccgaggcgggaagattgcttgaggccaggagctcgagaccaaccctgggcaacatggtgataccccatctctaaaaaaaaaaaaaaagttagcctggcatggtggtgtgcacctatagtcccagctgcccaggaggctgaggcgggaggattaccaccttaagaccaggaggttgagactgcagtgagccatgattgcaccactgcaccccagcctgagcgacagagtgagactctatctcaaaaaaaagaaacgaaatgaagaaagcattttgaccaatgatgctcttagatcctggcagcaggtaaaaattatgtaccatttttttccattctttgtcagagtagattgaaatcttatttttcttctctattaagcctaagcagctaccagttgaaaagatgctaggatctcttcattggatcattccaccactactgtcctctaaccccataaaatcaaaagcggtttttagtttggttattctgataaagcacttagtctaataaagatcaaagcccagcatctgcaagtgaaaattctccttctaacatgatttctgggattttgcagctttctacttaaaaacaaggcacaatagcaagtcaccccatcttccccatatgtgaaatggagatgatgccagtgtcctagggccatcgtacaaatcaagctaagatcatgtacagagaaacaggtagcgcttgaaaagcactcatggtttctctctgatgagtcagtgcctacctggcacagaacaggtagtcaataactgttcgtggaagaacagtttaaaacaaacaaaaacatagttcaagtagaaaaacctttgttataatttgaataaagatcttctctgttaaggcctcaaacttctgatgtgattattgaagtgctttttacatgcatgtgctcaggccatcactgtttctgagtatgggtcagaggcccttgggcctcttcacggtgggaagaatttacaacctccctttgttctctgtagtgactagatttaaagcgaagcatatgacacgtttaactgccatttccctcacacatacccctgttatttttacctgcrttagaaatggattggctccttccagcacccctattatttgtacctgtattagtaatgagttagctgtacttgagaggcagtctttactgactttccccacatgcactagtcccaggctgtttaacaaagaagcgggtggaaggcattacccaattcgatcgttttccaggcttgtgtgattttttttttgaggactcagatcaataatttttctggtcagactttcctggactgtgcatattagcactttgacagttgaataagcatttaatttgcatgtccacctagaaagttgcaaggggggtgtttttgaagtagaatgtgacatgtcaggcctatggtctacagcctgaagtgtctgagagggaagaaagagaaccaaagcttctgtttctgaaatataatgtgacaaataccactttaattaaattccataaattctcatcccacttttaaaggtaggtggtattacccctgttgttcaaatgaaagtggtcagaaatattgaatcttgtcacttccctttgggtgcaaaatgaaaggccctacatccttagaagtcacatcaggatacatcatgtaagcctggtgaacaaatcccaagagacatacttgaaatatggaaaggaaacaggtacttgaaagagtagggcaccttactagcttgagatgtattattctatgctctcaaaatagataatggtttggaagcacggcttggcttactgctatatttatgttcagaggttgcttgttttccacgtacttttaaaaactattctggaagggaaggggttagtatatatatgtgggatgtggaaatataatagccaatttaaatgaacttaaagctgtaacagtgatactrtcagtctactgtggtggggttgctaatgcatttaactgagtgctttttaacagcccagctggagaaacaggaagtgggacaggatcagtggaaacgctgcttgggtatttgaaattcaagcagtgagacctgagagactggagttcctcgccaattccagaacctcagtgcagggcattactcttttagatacaaagattgggtgtagaaactccacatctgtcagccacgtaacacagcccatcagataatcatgttaaggctaacagccagttcgaaacattctgtagaactatatctgttcaagggctaccaggtcctacctatctgtctcacctcctgctttctcttgctgggcgtttgtgtgctgtttggagattctaaatattttacactgatgtttctttatctttaacacattgcttctctctttgtgcttcagggaagatggtgaaaaaagtctgtccttgcaaccagctctgtagtaattatcttttctgttatttttggtccttgattgcaaagcctgttaaccatgagttctttcaactctgcagtctcatagctccctgattcctaacttccatctatctctgtatcctattctaataaatatttaacatgcttaattgagaaatcatctcctagtcggtgccctcagtgataaccccatgtgagcctagcttgtgacagacatggattggtaatggccatgggtatatatagggaggtcagggatgcctagttcctatgggagagcgatcctttggtcagcaaatatgtgccgggcagtgttattaccccaactggaaactcagcagtgacgaaagcatacaaaagtccatgccctcccacgttcacactgaagtgggagatgtgtgctagattgacgaggagaaaaacaccactttctagagtttgtcttcttagactgtggcttctcatactttaatgagaaggccacttacagtgttgtaggtagggtcaacagggaaattctgtacttgggatgttgggctgtaagttatggttcataataggttattgttagtaggatctggtgatgtgggaataggggaaatgtattataatggcaggaggaaatttaaaaatgaatcttgggggtaagtctatactacttattagggcttttcagaagaactaaaaaaggttaagaagttagcatattctctcaaaggcctttctacatcttttatagtcaagtctccttttcttaggarttaatttctggtcagaaaatgataggtttgtttcattctttaatgggaggcctgtatacagaagccagaacgtgaaggtttagctgtatggttgactcttcctcatggtttctctttcctcatagagaatcctgtattaggtaatgtagggtaaaatgaaaagtgaaatttcgttctaaaggggcctcgcagcatcaggggcgacagactagagaggtgtgtctcccagcatgagctctgtggataagcaatggtcacgcctcctgagcttcttgtatttagcttttgacagctctgctcccctgtgattatttctgttttttgttttgattgtctctcacatcaagctcaccaagcaataattgttcaaacaggatgacaatccccatgcatgtgatatgcttgctttctagattgagtcactcactgtcatgactgcccatcctcattgcctgtgcttcccacttcaccactctctcacattggctgttcatggaaggctgttttctgtgctctcatgcttctcccctcgcgtttcctgtactgtagggagcttactcttcccttcacactgtatgtgcaatagcaatccccttgtggctccagcagacaccaagaaatgagctgacactcacactgcagtagttccgtgtcttgccatagcggtaagaagcatgtgaccttcctcactgcagcttcacctcagaattagctgttactgcagcacagacctgcttgtgtgtgccattccccagntggtaggatataagcttgacttgagaccagcgatggtcagtaacaggctttgaagtggcaggattgcgttaggtgtgctgctgtgatctggtgctgctttgaccttgaaagcaggataacgcatgcacttacttacccccgcattacttgggtaccttaaggactagtggttcacaacttactttaggagcttttatttattctgtaacacgtgagatctggtaagacagtggggggtaaggaaaacagacaagaccatgactcttctttccctcttccccaaaacgtgcctcttggaataatcttcagtgtgccctccagcagagccnaaatcaggcaggcatagactccctcctctctcatcaaaccgcagaaatagagttccttcatcataaccgcaaagcttcctcctcccctttgcaccctgcctcagctgcattttcttgtcgcttctacatgggagtgcttgctgttctgggaagagtggggagaagcggtgggaatccttgagccaattgaaactgaggtcatcttcaggaaaaccatgtcttcctgaagttgaaagattcaggcacaccatacagtcctttcctcatgaataatcttgttctttactcatgggaaattgggagaggttaacccctcccaagtttatgtttgcaaattcatgtttatgggtccaggtgaaaaacttttctgaacacagcatgctacttctcttattacctctctctatttaaagaatggctaggctgagcatggtggctcacacctgtaatcccagcactttgggaggctgacatggcaggattgcctgagcccagcagttcatgactaagcaacatatggagattctgtctatataaaaaagtaaaaaattaactgggtgtggaagtgcatacgtctagtcccaagctacttgggaggctgaggcaggaggagttggaggctgcagtgagacgtgattgtgccgctgtatccagcctgggtgacagaaaaagaagagacccttcctttaaaaaaaaaaaaaaaaaaaaaaaaaagccgggcgtggtggctcacgtctgtaatcccagcactttgggaggccaaggcgggcggatcacctgaggtcaggagttcttgagaccagcctggccaacacggcaaaaccctgtctctactaaaatacaaaaattaactgggcatggtggtgcacacctacaatcccagctactctggaggctgagacaggagaatcgcttgaacccaggaggcaggggttgcagttaggtaggatcgtaccactgcactccagcctgagtaatagagtgagactccatctcaaaaaaaaaaaaaaaggctaaagaatgtggcagtgtccaatggtttggaaacccaccttctccttatccttagccaagcatcttttcctactcctactttaaccgtgcccaatgcacaagaaaacctctttttccctgcattctgcaaaattccagagcaactagccttgctgattgtatcacacctccatcagcaacgtgatgctgggaatagcgtactggcgagcagttccaatactcttaggtgctttgtgaatggactgaaagaggcccctgcctgtgtacctaccgtcatcctgagttgttcagccttagcagcagctactgaagagaaactgttttcatcaccctattataccaaaacaaatggctaaacaaaaccttggaatcttcccttcttgcatggcttcccagttcatcctctyctcattctgtggcttgccattcatcatcccgtgaagttttccctcttcctgaaattgtaacctaggcttcttttaatgctcgtattctgttgcttataataggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattangaggtaagtctctcttttgccgcagagaatccgtaacacacatctgagtcaaggtgatagaaacaactaagctgctgcttaacgtcttacgccacgaccttcttcaattttaatactttagaaaaacaaggcaaaaatcccccaggtacccttttatttttccttccctgaattcctaacctcttgttggtcagctcaactttttcttcttcgtttttccttcgtcatcctcaactacacacacacagacacacacgcacatgacatccctccctctcatgaggattattttcacccttacttggtaaatataaagagccaataaatactacagaagactgttctgctgtatcttacaggattatactagaagtatatgttagcgccacacattttataccatggcccacaccagacttgacacgtggtggttttgttttcagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttytttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtargtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgtttggattgctttcctcttgttgcacatgtaccatgcatttctcagcttggggtactacattttgtggaaagttaatctathtatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgaaaatatttccaaccttttacccacgtcaatggcatattctgggaatcaccaccaccaccaccactaccacagaaagaggstggaggctcctgtaccctgttcattccttaagggccctgcttcccttartaagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttayttactgttgatttcatcctcctgtgtatgaaatamcaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaactttgggggtttctcagcagccgttaattgtacattttgcactaactctgggtgttgcgcttcttgtaagattgcgctttgtgcttcagtttgttacctttgtagacttatttaatgaaaccattcaaataaaccaaacttgcttttgttgagctgtggggtttcatttccagaagattccttcacattctcattggcactattttgagttaagtgcaatttataactggatccctaattcctgggagctcctttgctgtctccttaacttcgaaaggaatagaaacggtcggctgccggctagtactttcagacttccttatctcaggttcacagcttcccaaatgggtctgagccaaaaaataggaagtcactgcttcaagattagccacagcccagcccaaaataatacgtctaaaaaaattattaaattggctgggcgcaatggctcatgcctataattctagtactttttactttgggaggccgaggtgggcagatcacttgaggtcagtttgagaccagcctggccaacatggagaaaccccgtctcctctactaaaaatacaaaaattagtcgggcgtcgtggtgggtgtctgtaatcccagctactcgggagcctgaggcaggagaattgcttgaatcctggcaggcggaggctgcaatgagtcaagatggcaccgctgcactccagcctgcgctacagagccagaccccccctctcaaaaaaaaagttgttaaactgcaaacttcattattttgggggaagaattatgaaacatctgagcactatgaaaagccaatttatggtcaaggtgggttacatctcacacctgaaatggggaagtagaaacagttgcgtttgagcatccctaattgaaatgctctgagatcagaaaatttctgagcactgacgtgatgccagaagtggaaaattccacacgtgacctcgtgtgacaagtcgcaaagcaccaggcatacaacagtttatgcagcgaccctaagagaaaaaaaaacccagccctcttcagctgcagtgtatcttcttatacaaaaactctgtttcatgcacaaaattatgtgtatgaggcatatacacgaaacacaggtgaattccacgttcagacttgggtcccatccccaaggtctcattatgtgtatacaaatattcaaaaaatgcaaaacaattctggtttcaagcatttcagataagcaatatatatatatattctattttgttaataaggtatacgatttgctttctcaaaaatgccttttctggccagacacagtggctcacaccagtaatccctgtattttgtaaggcagaggtgggagtatcacttgggcccaagaggttgtggagagagctgtgtttgcaccactgaactccagtcagggcaacacagccagaccccgtctcaaaaaaaaaaaaaaaaaaaaaacaaaaaacagccttttttcgtggtcttagatgattatttccttccttaggaaaaaatgtcagtcttgaaacaatgcaggattgtaatgtcataaatccataaattatttatattaaatgaagattgtagcctggattgatacaaagtagtgaaaagcactgctccaacctttttcctgtcgtgatccacagtgcttaatgtgggcaacattaaaggcatggaccgtaaaggaaagaaggcagacgttatgcaaaacaactgaatgtagacaattgctgaggcaggtgcttaggaccaagtctggcctatattgcttgagggcaaggagccattggtgattcctaaaatgtccatcttcattaacataatagttcagtaataaatagtgggaagcctcacaagccgaagaaaaggtattcatctgtccagagcctctccctactagagtgatggacaagcttttcaaaagtgctcagctctaactgcagtgggctctcagtcagatcctcttgataaggttcagaatgaagcaagataaatcgcaatgacgttcattctccagcagcgatgaacaatttcatgaccaaaaagtagttttccaaagtccctttgtgacagagtccaattatgtggcctgagcctcagttaagatggatcmtatttccttttcttcatgtcctggctcttcctatgagattcccagtttcctatggaagacaaaatggcttaaatgtagctgccataattttaaaataaactgacagctaatgatttctggattatattaatgatcctaatttagactaagcccaagaatgagaattactgttaggaggaaggcagatgattctcctagaccaagtggcctcgtgctcatgacagacctgctgctgggagggacagctctccatgcagtcgtttccgcttcctgctattatcaggagctgaaaagggctgcacctgaagtcaggagcccaaaggaaacgttctggctcttaaatcaattctgttctacttgcagtaccattccctaatagaagttcccgattctatcaaactttaaatgaaatgtcatccttcctcaaaaattcccagaattaaagctaggatctccccttaatttttgtgcctaaacacctctctgctacctgttgtgcgttggtcagcgctataagtttggaggtcccaagatccagattttgcttgtggtttctggtggcaaacgctgtgtggagtcctgttctgggtcaccatctggttgttcaaggctaatgtgtcagaggtctgggctgggtctgctctagacgagggcttgaccacaccatcccctgcatcgggagtcacagcccacttttcagagttgtcttcaagagtctctacagaggtcaaggaaaagtgcgtcatcagcaaataatgaagtattctcacagaaagcactggaaaaactggccctcagaaattccatgtcttcagtaccttctgaaagtttttggaatttctctcccctccccctaaaagtacacttccctttggttaggaccaaagaggaactggacatatgctatcagccagaaccccctcaacaaaaccacacgaaaatgaggatttttatgtcgcctaaaaggtattctgtggctactagaaacatacagcacagtagcttacaagcatttcaaggtatttactgattaattcttgagtcactcctgcaaggaagtctttctccaggagtggttctgagacagttacaggagtgctgtgcgtcacaggaggggccggaggcgctgctacggttcacagaggagagaaaggacaagtcatcatcacatcactgcatgggatttcagagcgtgggtccactcccctcttgttagagggaacactctccgaagcacaacaccgcttagggctgcgctgcttctgccagtaaaaagaacttcagcttcccgagtcccagtcctacctacagatctgtctgtggtttgaattcttctcaccagtgggaaaaacaagtttctttctcctttcacagcaaaagtaaaaggtttctcacaggccatctaatccagtgtctggctcgcttgttacagccataacccttgctcaaacaaaatcttaaactaaaatctgaccaggcacagtggctcacacctgtaaccccagcactttgggaggccaaggtgggaggatcgcttgaaaccaggaattcgagacgccacctctacaaaaaataaaatatcagcgggtgtggtagcatgcacttgtagtcccagccactcaggaggctgaggaaggaggatcacttgagctcaggaaggtcaaagctgcagtgaaccctgatcccgccactgcactccaggctgggtgacagagcaagaccctgtctgaaaacaaaccaacaaacaaaatcttcagccaaaatctgatgtgtgaaatggattaaaataacaatggctcgggttgtctgccaaggggcaggaaaggcctggagggcagcttcctccacaatctacccgggagcttctgcaatggttaagaagctaaacacctgcaataactcaacagtaaggatatccacaggacaggaagtggttctgttttggtttttatgttaatttcagcctgtcggtgctgaggggcatatgaatgaaccaaccatgaagcaagtcctctgtgaatctgcttcacaatttgtagggaaaaactgggcaaaagctcgatgggtctgagacaagccctttctctgtttccactctctgagtaaggactacctaccgctggatgggcaggagagaacaggtggggagacagagaagaaagaaagaaggcatctgtatcactattcccactcaatctggactctgaaataaactaaagttgataaataatctgccaaaagttcccgttattctcaatcccaattttgccttgtattcgaagatatctcagaaacacaaggcttgttttttttttgttttgtttttgttttgagacagggtctcactctgttgcccaggctggagtgcagtggcacgatcttggttcactgcaacctctgccttctggattcaagcaattctgcctcagcctcccgagtaggggggaccacaggcatgcaccaccacacctggctaatttttatgtatttttaatagagacggggtttcgccatgatggccaggctggtctcaaactcctgacctcacgtgatccgcccaccttggcctcccaaagtgctgggattacggacatgagccaccgtgcccggccaaggctttctaatgtagagatggccaaagcattcgaagcaaaaaaaagttctttaccctgaaatttctaattctagaagattttatcaaggcccacttagttccacgggggaaaaaagaaatcattgtctttagaaacgggaaaatgtatagcagatttaaatatctgaatttcctgggctcatctctcctgcgtgtagcttgagagaagtcccagcgaggcctggtttggagccggcccagggttaccgcagagaatcagaagaccctgcggctacacttcctcctgcagacgcctcccagggccctgctcccacccctcgctcaccctcactcttctcagctgacggcgtggagactcgaacctgctgcttctccatccgctcccggaactgctgctgcagctgcttctgccggagcttccgctggtgcgtggcctcgctctccacggcggatgagctcaggcttctgcatgagagggcggcggcgaggacgggctcctgagcaacagccgcggctgctgggaggacacgcacggctggctggctctggaggcctgagtggaggcagccccgtgacacaggaggggccgcagaggaaaggaggggacttaggccgcataccgggagctgcagtcctggtccgccggtatcacagcatggctgggtctggaaggggaggtcacctsctgcagctgtgggtgtcccagggccatgttcggtcggcagctgttgtatcttgcctcctccacagacggttcaagatcttgtctcttcgctttagttaaatccacttcaagaggcaactagaaggaaagaagaaaaacaaattccttcaactggctcttgccctccgctgcttctccctgactcacagattgcgattcctggaaaatcgcatttgacatcctccatccatcacgccttctaggtcctgtaactccatgagcaggaggagccaaacaatttcatgttctgtgttagtgaagttttgataaaaaggaatccttctttggttttgacttagggcagatgttctgtaaaatcgcatttgaatctttcctgggctgctgggtctgtctttgctgcctccttgtcctttttccacggaaatgagcacacacagtctctgtggag

SEQ ID NO: 10704 - DNA, 67403 bp, Homo sapiens
  misc_feature (1)...(67403): n = A,T,C or G, or insertion/deletion polymorphism (see Tables 1-2)
tttcctatattccatactgattccagctgtttatagaatggaatccttggcttttctaggtatataatcatgtaactaggaaatactgatatctttgtctctttcttccaataacccacataaaactagactggcttactgggtctcgaaaccagccacaacatagaatttcactataaaaaatactagtggctgggcacggtggctcacacctgtaatcctagcactttgggagtttgaggcaggcagatcacttgaggtcaggagtttgagaccagcctggccaacatggtgaaactccttctttactaaaaatacaaaaattatcctggggtggtggtgggcacctgtaatcccagcttcttgggaggctgaggcaggacaatctcttgaacctgggaggtggaggttgcagtgagctgagatcataccactggtggacaagagtgaaactccatctcaaaagaaaaaaagaaatactagtcactctcaaatagaactaaaaataaattgaaattttcacataagtcttttaagaatacctaaggaagaatccaaacataaaacaaaaatctttttttctctctatttcctatccatctagtatgtaatattatctcacacagggagttgcccttctctccaacttcctcccaaaactctttctgtcccaaatttcccttcaaaaccatctcacatagaaccaagtcctttgtccctcatctcctccccaaaactgtcctggataattctttgctaccatatttatatgataaatatgctggtttcacctgctggctttcccagttctctacttcaccattgccctcatcaataagaagtgtccccagtggcaaatagtcaatagaagctaacttagaatgtggtgaggatgagagaagaaagggattcaggctacccacatctaaatttaatgtatttattaaacaatgactttgaatgattctcattagccaagaatatctaaatattgttaagtcctgtagttctctaaacaaccttcgaaggcattatttttatggcatttttatgacacatggaagctttcatgaaccaatttttagataattgtatataattttccattttaaaaagtgtgaaaactgatacttccatgaggcaactggggataccctgaatgccctctggggtcaggaaaatgctttggtgccacctgccggtttccaaagatgtttcaggaacttgctcctgttgatttccaaatctttttttttttttttaattcctagctccctcccagtacatttcaaaataaccaaaaaaaaaaaaaaaaaaaaaattataaattttttggtagcaagagcacaagtgctcaagcttataaaaatgcaaataaatttgtttgggatgcaatatgatgaaacacatacttctcaatcatttaactagtcaattttttttagcatattgccaaaatgtagatttcatatgttgactttacattgctaattacacacatcctatttcttttctcgttatttttctttctttctttatttttactttttgcgactccctctggtacccaggctggagttcagtggtgcaatttcagctcacttcaacctctgcctcccaggctcaattgatcctcccaggctcaactgatcctcccattttcagcctcccagggcgtgctaccatgcccggctaatttttgtgctcattgcagaggtggagtttccccatgttgctcagactggtcttgaattcctgggctcaagcgatatgccagccttggcctctcaacctgctgggtttacaagcgtgagccactgagcccagcaacagatatattttcaagtggatggtatcccatcagttgtgatatatgatgtaaacactctactaataattaaactttgaagtttgtgaaaattttacttttattatagttagaataattctaagttattcctataataatgctacacttattcacttgaattctgatacacatttcttgaacaggaaggagatacagatacagcttatgcacatttatattcattcattcattcgataaataaatatgtattgttaaccacgttccaggtactttatttggtagttaggatttagtagtaaacacgagaaagtcttcaacatcatccttagatcgtgatctctgcatatcacaaatcatacaaaataaatttgcttaaaaatgtgggaacctgcctttcaaaacctgccatttagcactactgtggcataacctataaacctaaacatagaccctcatgatttatgcatttaagtttgtgggaaataggtctcttgtcccttgtcctgaaagtaaaagacaaccctgtctgaatacactgaatatccgtggattgtactgtttccggaccctgcctaagagcatagggagaatttgtttttttgtttgttttttgtttcgttttatttttgagacggagtttcgctcttgttgcccaggctggagtgcaaacggcgcgatgtcggctcactgcaacctccacctcccggttcaagagattctcctgcctcagcctccctagtagctgggattacaggcgtgcgccaccacgcccggccaatttttttttagtagagtcaggattagtattattagtagagatggggtttcaccatgttggccaggctggtctcaaactcctgacctcaggtgagccgcccgcctcagcctccaaagtgctgggttacaggcatgagccaccgcacctggccgggacccgaccaggatgctgaatacagaaatgcttaggtaagagaaaagaaaagttaatttgtcacacttttcctttcaaactacatgaacatatttttgcattataaagtattatatctaagtagttccaaacatggaatttcttatttcctttttttccccccaatttatggttctggatatactcaggaattagtgtagaattctcaacaatcagatatggttgctgaggaacatttaacaatattaaacaattcacatgactctgaaatttgaaaataggtagatacagacataacatgaacaaagggtgataccaattctttacactggcaactaggtggacattgaatgatacgcttgtgagtaatttactttaatgaacaatttcattaagtaatatttaccaaaaaaacaaatacaactttagatttatttaaattattttacttaaaattttgtcactaattaaaccccgtctctactaaaaatacaaaaattagctgggtgtggtggcaggcacctgtaatcccagctacttgagaagctgaggcagaggattgcttgaacctgggaggcggaggttgcagtgagctgagatcacgccaccacactcgagcctgggcgacagagcaagactccatctcaaaacaaaaaaaaaatattgtcactaattatactttacatcttataagaaaggtaaatcttttgaaaaaagtgaaaaagatttaatgtattgctttttaatttaatttatatttttattgaaacattcaaactatatgtttggaatataattaaattttatttttaatcctttttgatcattatttctgatagaacacaattacatgaaaatcttgatcaaacagcatacatggtaattttgctgaaatgaaggtaaattttcatgggctaaatatataggaaatgtattaactatagatgtctttatcactcatccaaaataatcagccaatcaataggacacccggacaggaatgatataattaaatgcaatcagattttgctgattttcatctatgtaaaaacatttttattttgccattataaatgtttactcaccaatattgagagttatagcatatcctagttaataatgtgttaagttaatttataacttttaaatatttacacctacagcagtgagtccatctgtactctttctcaggctccataagtcttagggatgggctttatgccaacgtgctgaagccaatattatagtgagggaatacaagaaataaacaggtaaacaaacagacaaatcaggtcatttcaagtagtgataatggctatgaagaaaataccagcttggtacatctgtccgtcagataaaaatatataattcaagattattacattttttttaaaaccaaagcttttttttaaaaaaaaattacatttatgaacatctgacttgttttcctttttactttccaaagtaaaattcggcatggcactatacaccatcacagctgacataggaaggactgagtcaaatctttgtagcactttttcaagtttcacttaaataaagcttttaaaaaatatatagggtattttttaagcaaaaaaagcaaattatcttatcaatgaaacagacctggtgttcatttcttttaaagtaccgaaagctgattgcttctgtaaaggtaaaactcctgtgacatgttagaaagaaaaaaaaaattcctttgagagatatgtttgtaagaatgaaataggtactactagaattttcatgttattctctgcaaggcactcaacaccacatgaaaagaagattattaacagtcagtagaaatactaataactgaagaaaatatttggttgttttaaatgcttttaaagcaaaccaacaacaaaagattctgtttgtaaatgggagagaatctgcatgaggtatagacaaccagggcctccaaatttgtagctgtgtttctgacattctccagggaagacggttacagaaagacttgaccccctggccccgcagagctcttcagagaaattaatgcatccagaaaagacagagcatcagatctcactccttcgtctggaagacgtcagttcatcctagttctagcgcataccggtgttttggaaacagattagctatattcatacataaggatactcttccgcaacactatctgtagtgaggccaagaccagtggttgcgggaatcttcgcaaacaggcaagagacaatttttaggggcgatggaaactgtcattttgactggggaggtcattacacctatacatgcatttgctaaaagtcatcaaactcttccactgacgtgggtgtaaccattgtttgtaaattatacctcaacaggattcgattaatttatttattgagacagtctcgctctgtggagtgcagtggtgcaatcttggcccactgcaacctccgactcccgggttccagcgattcttctgtctcagctttcctagtagctgggattacaggcgcccgccaccacgtccggctaattcttttatttttagtagagacggggtttcgctatgttggccaggctggtcccgaactcctgacctcaggtgatcagctcgcctgagcttcccaaagtgctcggattacaggccgcgcctgactatgattcgttttgaaagaaaaaaatatatgccatttacccctcgggaatggaaacatagaggagtgacaagatctcccccaagctctggggcggtggagtccagcatttatagatcggtttgcactaggagcagaagctcctttcacgacaatctcggcctcttcccactttgtagagtgagtaacaagctcggagagatgaaataatttggtggcgttaacccggccgacaggcgccagcgccaggatttgaacccaaaccacgtgacttcacaacccatagctttcaacactacgcggtgctgctggcacctagtaaaggctggatcactactgaatgaatgattctggctacggatccttaaagcccacagaaggcccatccagagaccgaaagcttcagacacaagccgcagagcagaccgctaaaccggagctacagaggcgaagctcagacttgagcctgagtccggcgggctgaggggcgggctttcgtctcgggaggcggagctgtctcgtcgcattcccggcaagcttgaacctcttcacttgccgtagcgcctgcagcaggaagttgctctacagcatgccttaggtttccgggtgagggttgggctccttggtaccatgtgggaagcgctgtgaagagttgttgccttccaagatatacccaaattcccagttccaggtaagcggcacagagccgcttgatgtggctgcggatgggggcrgcatatcgagggagggtaagagttttccggatatctgcggaatcagggttgaaggaaagccttggcgcggtcgccgctactgkaattagttgttaacgctgctgccatcgtctttgcatctccggggtccacaaatctcaggacacccgcgttgtgtgtccatgacggtgctgagtgcagaagagaattgtttgtttacgaggcgccttataatttcgtagaaacttatcaaagtgcttacgtttttttagcccgtgtcattaaaactccgctggcgtgaaagatgacgtccttagcccagcagctgcaacgactcgccctccctcaaagtgatgccagcctcttatcyagagatgaagttgcttctttgttatttgaccctaaggaagcrgccacaatcgacagggacaccgccttcgccattggtgagccatcttttaacttagaaaagctcttggaagcgtttgttttctggatgttactgttttttttttttccccttsttttctcttctgtcccgtcctcttccttagcagtttctagcatgttgatgtatatttttaagggaaagagaacataacagtcaggtgcttggtgcttgaaatgyttatgagtagaggtatctggatttcacagatgaagaaacaaaattagagaggtcaactaatatgtcaaagagaagaacagctaaaagggggatggaggcagtgactggggtgacggagaagtcctctcagaggactggcctagttattgtaggggatatccaaaaaaaaaaaaaaaaaagtgttccctgccacgaagtactttctgttctagtagatgagataggatttactctaaaagttgaaaactagaaatcagtgtttgggactgtattataaattatatgtacttaaagaattcagaaacttcttaggggtaagtaaaactgtaaaagaggggtgggatgaatttgcttacgaagaattgttaaataaactggccttttttgaaatttaggatgtactggcctggaagagttgcttggaattgatccttcctttgagcagtttgaagcaccgttgttcagtcagctagcaaaaaccttggagcgaagtgttcagaccaaagcagtaaacaaacagttggatgaaaacatttcattattccttattcacttgtcgccttacttcctgcttaagccagcacagaagtgtctggagtggttgattcacaggtagctaatagaattacagaaataactatgggttaatcactttggtcttgtaaaaaattaagtagttgagaacttatcaaattaaagctgaaaaattaggtatattaagagattgatacaatgtccattgtgtgagataagcatgctcttctgcctttaaattcttttttgttgatagtgaaaagtagaactactggtgattttgagtaaatggtctaacctcattagtttttttttgagatagagtcttgctgggcactcaggctggagtgcaatattgaaatcttggctcactgcaacctctgcctcccaggttcaagtgattctcccacctcagcctcccaagtagctgggattacaggcacctgccataatgcctggatgagttttgtgtttttgtagagatggagtttcaccgtgttagccaggctggtctttaacccctgacctcaggtgatccacccgcctcggcctcccaaaatactgggattacaggtgtgagccacctcgcccagcctaacctcgttagttctgaagagcccatgctactttgccattacagcttgttcctgcacacttgaggcagtgagtactaagctgctttcttggcaaaataacaagatggttggggaagcaggcaatgttatcctctgaaataccattycttgagaaaaacaatgatagctaatgtgtttttgagcatttatacactaggccctggtaagcactttatctgcattatctcatttaattctcacagcattcctctggtgagattatttgtattatccttgttttacagttgagaaaactgaggcttagagggattaagtttcttgagtcacacagctagtaagtggcagagctaggatacagctgaagtttatttccaaggtctgatcttttatctgctttgggaattgtctcagtaagcttagtttattttctcacatattggtgtcacatcacagcatacacatttttgttttatttattctcccaatatgtatgtcttttttttttgagacagtctcgcactgtcgcccaggctggagtgcagtggcacgatctcatctcactgcaacctccacctcccaggttcaagcaattctcctgcctcagcctcccaagtagctgggattacaggcacataccactacgcccagttaattttttgtatttttttttttttagtaaagatggggtttcatcacgttggccaggctggtctcaaactcctgacctcgtgatccactcgtcttagcctcccaaagtgctggtgtgagccaccacagccactgcacacggctgtctttttatttttattttattgagtgtcaggatttcactcacccaggctggagtgcagtggtgtgatcgtggcccactcgatctccagggctcaaatgatcctccgatctcagccacccaagtagctgggattacaggcatgcaccaccatgcccacctagttttttktttgtttgtttgtttttgtttttgtttttccattttttgtagagacagtgtctcactttgttgcccaggctggtctggaactcctggcctcaagcgatcctcctgccgagtcggcctcccaaagtgctggggttacaggcatgagccaccacatccagtccaacttacatgttttaaaagtagatttctattccattaattggagacatggcttcaaggccagcctggccagcatggtaaaacctgtctgtgtgaaaaatacaaaaattagctgggcgcagtggcgagcacttgtaattctagctacttgggaggctgaggcaggagaattgcttgaatccaggagacagattttgcagtgagctgagatcacgccactgcactccagcctgggtaacagggagacgccgtatcaaaaaaaaaaaacaaaaaatggagacgtggggataaactaattttttttcaagaagcaagtgagtcatcaagaaaacatgattttaacttgggtcttctgattgtcagaacattagggcaatcagacaaagaatatttaaaagtctgtaatatttccatctgttttctagcacctaactttacccccaaatagatcattaatgtaaggaatactttttgcatttgatttttcattttatgtcttcagataacttatttattcagcaaatactaagttcagtacwtagataagtaggttgccgttgattactgttttgaaataaatgccataataaaggattaagcagagttttgtggatatagttctgcctggaatagttgaagaaagcttcatggaaaaagtaaccgctaaaaccgtatgtcaaactaagaggctgggttcagtggctcacgcctgtaatcccagcactttgagaggctgaggcaggccagtcacttgagatcaggagtttgagacgagcctgaccaacatggtgaatccctgtctctactagaaatacaaaaaaaaattagctgggtgtggtgctgtgcacctgtaattccagctacttgggaggctagggcatgagaatcgcttgaacttgggaggcgaaggttgcagtgagctgagatcacaccactgcactccagcctgggtgaccaagtagactctggaaaaaaaaaaaaatctaataaaaggcaatgtatggtactgtttaaaaaaagtacacgatgtaaaaggataggagagttttcacagaagagggatcagttggcagaattagaaaaaacatcttagccaggcatggtggctcacacctgtagtcctagcactttgggaggctgaggcaggtagattgcctgagctcaggagttggagaccagcctgggcaacatggtgaaaccccatctctactaaagtaaaaaaaaaaaattagctgggcatggtggtatgmgtttgtagtcccagctacttgggaggcggaggcaggagaatcttttaaacttggaggtggaggttgcagtgagccgagattgtgccactgcactccagcctgggcaacagcaagactccctctcaaaaaaaaaaaaaaaaaaaaaaaaaaaatgttgacagaccagcctgggcaacacagggagacctagtctctacacagaaataaaaaattagccagctgtgatggtgctcccctgtggtcccagctactcaggagacctaggtgggaggatcatttgagcctgggaggttgaggctgcagtgacccgtgatcgtgccactgcactccagcctgagtggcagagcaagactctattcaaaaaattaaataaaaattgtaaagctgagagaaagttaatgggatgtatattttgatgtagaatattcaaagatattgcataggaattggctggaccatgttgagggatatgtgaatgcaaaattggggactttttaaatgctctgtatcttataattttgtgatttttactgctactcrttctaggttgttttagcttattaataatacagtttgggcatgtgaggaaataggtgcttattattaagttttgtgttcagttggactgtttgctttttttccccaggttccatatacatctctataatcaagatagcctcattgcttgtgttctgccataccacgagacaagaatatttgtgcgagtcatacagcttctaaaaattaataattcaaagcacagatggttctggttgttgccagttaaggtataattgctgaatgacatatgtctgtaatcattacagatcttgattaagggatttaattaggaaaaaataagtcattgctcctggggatagtccagataactacctccatcatttttatttcctgacttccaattgaaactattattaatgttaataatatttagcttttatttagtatctgacatcaggctaggcaatgtacattatattatcttggattatcacaaaacttcatttttacagatgaggacaggctacttgccaaagttcacataactataaagtggcagagttgagatttgaacccaaatctgattccagagtctgtgcctttgtatcgtaccatgccgtttggcattttaaatttggaactgagaacttaaaaaaaagttgaaggtgaagaaaggcagaaaatacttacaaaaattaaaaggataaggataacttcaggggtttcaagaatttactaaagttgtgaggaagatgctaggagttaatttacagactaagaaaaggatgcttgtataacaggaagggtctgggtaagaaaagacagcatgctattgtaggaaaaccaactgactaaccgttagcactttgtttgcaacatatggtggaggaaagtagatgtatgttgttagcaggaacttgactgcatgttgggcatggtgatccagggtagggggggaggcaaatggggatgaaggtaagctaacagatcacgaggctgtgcacattaggctgatgatggtagtggggtcagtgttcagaattagtaagataggagtaatgaggactttttaattagaaggagaatttaagaatctgaacgtaaagcacttgaactaaagaangttggagaaggccagcctttgataaagctcattaactgctcttcccaacattcactctgcccatagcatcaaaattattcttcctctaatctaccntggatcttgctgctccctaggcactcttattscaggtagccaaactccactcacctactaaagttcacttaaaattctcctttcatttatttaatcagtatttatggagcatctattacataccatgtacaacgctagatggtgggaatagtggtataagttgtgcagtttcctagtctatttctgttcttagtgttattgtaaagcaatgacagaagcgtatcatagtggctcagaaaccaaatcgaaccagtaaagttactaagaatctagagaatccagattttgataaatacctttcaaaatgtgacatacgataagcaaacatctttcactaaatacctctgccctcattgctgaccttctcttttgaatttctaagtttacatgattttatgtgttaatttcatcaccaccaccagttataaggagagattatattttttatttatgaattgtagcagtatgaagacattactagggtaaatgctttaaaataaggatcagttgatgaatgttgctagtagtttgttctttccatcaataacagcaatctggagtgccgttagctaaaggaactttgattacccactgctacaaagatcttggattcatggatttcatttgcagtttggtgacaaaatctgtgaaggtgagcagtctgtttcatgagtatataattttatgaaaagattgcttgctttgaatgaagaaaacatactaaaacattccctaataacaatgatactttggataaatttattttgttaaatggtctggtgttttgaagcaggagcagtttgagagtccgtatcttttttttttttttaagaatcagtcttttatcaccaaaggtgtttttctacaaaaataaatgtctattccttgccagattctagttacagtgactattcaaagagagtgtctagaaatgtcgggaatattcaacctgggaaagctgtttaaaaaattttaaggccaggtgcggtggctcacgcctgtaatcccaacactttgggaggccaaggcaggcggatcacttgaagtcaggagtttgagaccagcctggccaacatggtgaaacaccgtctctactaaaaatacgaaaataaactgggcatggtggggcatgcctgtaattccagctgctcgggaggctgaggcaggaaaatcgcttgaacctgggaggcggaggttgcagtgacccaagatcatgccactgtactgcaacctgggcgacagagactccatctcaaaaaaaaaaaaaaaaaatttttttttaaataaaaatgttaggaatatcattaggcagttaattgttgtcacattgtgtattcattgttgcatatggtaattcaggagagctgtaaatatttatttggcctttcactttttttttttttggagacatggacttgctttgtcgcccaggctagagtacagtggtgccatcatagttcattgaaatctcagccttgaactcctggcctcaagcaatccttctacctccctttcactgttaaatgtgttttgtttgtgttccttgtttcaggtttttgctgagtacccgggcagctcagctcagttgagggtgctcttggctttctatgcttctaccatagtgtcggcgctggtagctgcagaggaygtatcagacaatatcatcgccaaactatttccctatatccaaaaggttggcactgctgatgtgttaagtagattattttgtacttaaaggaattttcttgctttcgaaagtttttttagatttaagtgtttttaaattgacagtttatttcagatgatagctgagatttagcctttaggttgaaaatatgacacttttttattagaaactcactggmctgggaccttaattaggactcttaagaataaatattggctgtctggtcctgcggccatctcctagattgatttccatagcagtctttgtacctcactggaaggaggacggagcagacagtctctttgaggcgtaagcancctctcagtattctttgtgcactggctcctgcctctcagcgtttctccttcccaagtgccttcttgcctgctgccttcccaggtgccctgtggaggtactgctttcacttcccaccagtgtcccaacttgtgacctttcatcagacttgtttcttccattagtgatctgattgaggtctccctacyataagtaggattttatgtataaaagaagagcttactggctcctgtcaggacatgtggtagatgtttgagttgggaaattttctgagatcctttgtctcgttcaacagacttgtctcatctctgtatccactctgaaaaaggggtcagctcctttattgtttatgtctgaagagtgattgactatgcattaggttgtattaatctctatgacatttctaatttgtcagattaacatttaaagtagcagaaaataatatggtttatcatttttccttatatttaaaaaatatttagggattgaaatcatctttaccagattacagagctgcaacatacatgataatatgtcagatttctgtgaaagtgaccatggaaaatacctttgtgaattcattggcatcacagatcatcaaaacattgaccaagattccctctttgatcaaggatgggttaagttgcttgatagtgctcctgcagagacagaagccagagagccttgggaaaaagtatgtacaattgaattgagaaatggtgctagtcagaggtgaataaaattattttgaataatttttttttgtnagataagtgattatatattttcttatattgttactcattgtctaacttgtaaagtcaacacgatatgtacttttgcttcttcaaaggccattccctcacttatgtaatgttcctgatcttattacaatacttcatgggatttctgaaacttacgatgtcagtcctcttctgcnttacatgcttccccatctggtcgtctccatcattcatcatgttacaggtgtgtggttttatattttttgtccagaaattttctaagatttgatcttaaaatagtaaccatatcctggttaacagcttcaaaatatttaaaatttctgttttccagttgttcttgtgtaacttgtctatttcttaagtgagaaacatctggggtggggagcaggttggttgaagaaagatcattgttaattgagtaatttcttagaattttactttttttaagatctgtgttcttaaatacttaaatagtctctacatgaaaaagactggaatacttttaaaatttattactgagtaaacctttgccttctcatttaggtatttaatgaactttagtgattcatttataatgaatatctcatccagttgccaaaaaagttttttccctagagtaattaaaaatataagaccaagaaaatttttatacataaaaatccaaattatgaaacaaagcaaaaagcaaaaagtaataattagagggccaggtggctcaaacctataattctagcactttgagaaactgagatgggcagatcatggcaaaaccccgtctctacaaaaatatacaaaaattaaccgggcatggtgacatgcaactgtggtcccagctgctcgggagactgaggtgggaggatcacctgagtccagggagttcgaggctacagggaactgtgtttgtgccactgcagttcagcctgggcgacagagtgagaccctatctcaaaaataataataataattagaaagtgattatttgcattatgtcttttaataaatacagaaaggctaggaagaaacatttggttctgttgctacttggagaatactaagaaagacttctctaaacttatgtcagtctactgaaaaatgaggtttttgtaaccaaatcttggtttgaacatgcattttagaaaagtgactagcaaaatgaaaatgtattcttcctattctgaaggtaatgagtaatgtcccagtctttgaaagcaagggctaagatcagattcatatgtttattataaatctgaaatagatgacagcttttggttcagtaagggggtgggtactgagataaaagtttaacctcttttcagagatagttgattggcaccatcacaactaatttgtaatgtgacctggggaaagactaattttggacttttgttttgttattgttataagcatgatagtacttgttaaaaatagagaattttagataaaagaaaaatgaaggtgatctatacaaaagagctttaaaaaatataaatgactaaataagtggaatgcacttgtgcaaatagataaaaagctggatatcagtgtgtgtgttttattctgagaacgattttctgctataagtgaatttaataatgttagcttgcaaaataaatttttcccaacacaattttaatttttacatattaaggagaagaaactgaaggaatggatggtcaaatctacaagagacacttagaagctatacttacaaaaatatcactgaagaacaacttagaccatttgttggctaggtaagctattatttttgacatgcttttgatttacatttttgtgactcagtataattttcaagattggttagaaatttcccagcattcctttttaatgtatatcttgttttgrctgtatcatttcattaactataagtacttaatccagtaactggcagcattaaaagcaaaagtaatttttcttgcatgtctttagtgcttatagatgaaaatggaaagttagtggttaagacaaatttgggtaataactaaatgcagtttgtggccgtttgaagttttctcttagtaaatggaccataatatctgaaataacacatcacaattaaaacgcagtaaatgtcatttagaaacaatattgaaggtaagcatagagtaaggattatttctttaaagataattcagtctttttttttttttttttttttttctcttaatgggcaactcgatacagtgaaaagatgtaggcgttgtggtcagacataggtgtaaattctgcgcctaccacttccagggctatagtaagttttggaggttagtctggatgtagctttgccattttgtaggatcaagagagtgcctgtgtgttggtgtgcatcattcatgcccctttgctcagagggttggtttgtgaattaaaggagagtatacacgtgtagtaatgttgagaacataggctctagaatcagactggggcttaaaatgtgaaaccccactctgtggcacagaagggcttactgaatgttgccttttattgctgttctcatgagcaaattggaagacttacactctagtttcttttccttttttttttttctttaagatggagtttcgctcttattgcccaggctggagtgcantggcacaatctcggctcactgcaacctccgcctcccaggttcaagcgattctcctgcctcagcctccctggtagctgggattacaggcatgtgccaccatgcccagctaattttgtatatttagtagagacaaggtttcaccatgttggtcaggctgatctcgaactcctgtcctcakgtgatccgcccaccttggcctcccaaagtactgggattacaggcgtgagccagcaccatttaaaatagcaatgtagtcttactatgttgttcagacaggtctcgaactcctgaccttaagcagttctcctgccccggcctccgaaagtgctgggattataatgccagtggtgtgaaccactacaccaggcctctagtttctttatctgtaaaataagtattaaactataccttgtataagtatgacaattagagataatatttctaaagcacttagaatatagtaggtactcaataaatagtaactcttatgtatgctgatatttctgtttttttttttacagccttctatttgaagagtatatttcatatagttcacaggaagaaatggattctaataaagtgtctttgcttaatgaacaatttcttccactcattaggcttttagaaagcaagtaagttacgtgtgtatgtttatgctcttctaaagtacttcctgttctataaagatatgattcacaagtcacatcttaatatactgaattgtacagagactgtcctttttaaatttgttcttcaagaaggggrgagtatcggaatcaaaaatatttgaaatataagaggaaatagtggttgtgtgggggctatggagagtataattttttatagagagactattttgttattggagtagtcatagtaacacacttgaccaatgtcatttggttttacctacaacatttgttaaaatttaagtcacagtctcagtaatttttaagattttatgtctttcctttatatgtgtatggtgtatgagattaataaatttattaagaataatgaattcactrtttaattgcttcccagataccccagaacattagatgttgtattagaggaacacttaaaggaaattgcagatctgaaaaaacaagagcttttccatcagtttgtttctctttctacaagtggaggaaagtatcaggtatgttgttctccaaaggaattatgacaatttggggtacatttgtatgggtatgtgaagagctccagaaggaaatttgccacttttttcccttgtgtggaaaattttacagagataaccttktacagtttgcctagttgcctgaagtacggctctgaggcaggaatagaataattggagaaaggtacaataatttgtacataactatgaacgtgatacttatttcaggaaaagtattgtttgagaattttgtatgggatattcattaagaatcatcagaggacggcctcatgtaggtttctagcattctctgtctttcatctaggtctatgctttccagtgtaccagccacagatggctatttatattattgattagcaagggggagatgggttctatttcatgatcacattaaaacttgagaaattttctggtgattcaagcctaaagctttatactagaggttagacatttaagcaggagttcttatatttagccttaaaaacagataattatgaagagaaatatgattgttttagtatttctcttccataattagactttcatttttaatggtgttgcatttccaaatcttaggttgatggataagactttctttttagtctaattgcgtaagtgaactaagttgtcacgaatttgagtgtcactatttgttatatcatgtagatgagttgcattctgtcttctggaaggtgctaaaacagggatttatcttaggtgatttatcagatacgcatacaaaatacaaaattactttgtagaattacttgactaaattaaacctacacatagacacaagtatacatgaaatcataccattaacaatacaaattttttcatcaactcatgtgatgttctagaaacaaagattttgcatttttttgtttgttttctgtagttagatggttgttactgaaaatgttgggcaatttggggtggttttctctgggttttattcttgatcatagactgttcagattaagtgaaatcatttgataactatgttgaaccctgtagtttttagcagattctgatacttctttgatgctcagcctgaatcatccacttgctcctgtgagaattctggccatgaatcatttgaaaaagatcatgaaaacatcaaaggtttgtttcagatcgcttttttatatggtttttttttcttatgatgagcagtgtaattctgaataagaaattgaagttaccacctaagtgggtaatgatacagatgagttgaataaacctcatgagagtaccttagactaatatttaggactgtgtatgccagttgtccccattttaacaataacctaataacaactacttttatgtttccacattgacagttgtttatctttagtgtttttcaaactggaatttgtagattaattcacgtaggttcattaattatctgagaatttttttagttttgaaatttgattttgggccggtcacagcagctcatgcctataatcccagcactctgtgagaaggatcacttgagcccaaacgtttgagaccaacctgggcaacatagggagacccccttctctataaaaaagttcaaaaaataaaaaattagccaagtttggtggcacacgctttggtcccagctacttgagaggctgaggtaggaggatctcttgggtgtgagaggttgaggctgcagcgagccatgatcacgccactgctctccagcctgggtgacagggcaagactctttcaaaaaaaaaccgagaaatttgattttgatagtcttaattttagatgaagacatattttgggacatttgaatgataacttttgaacactgttccatgattttggtgcctgcagtttcgtttgtctttaaaatgttagtggtttcaaatatgtattgaggctgactttatttgtaaataatttggtctaatttgcatttataccaaaaggcattggtatgaagacttggtaatgatgcacatagaatagtagtttccaaactttagtcattcaagcagtccctgtacaatttttgctaaattacaaattaccactgatagtagtattattttctcacaatttttctttatttcagatggactcattatttttttacatagccttcaaattgtgggtgtgaggtgctaattgtatatgcattttactatagttactataattaaaataggaatgctccatctgtgtcatatctaaaattatgcaccgtgatttgcatatttgagaaatttctggaacagagtaaagcggttaacagagtttagtttccttgtagcacatggcagtgtaaacgtgccgaactctagaacttgtgtcatagcaattagaagcagattcttactacaagtaaaatcatatgatcagtaaaatttaatttcagctaattacarctaatcacactaagttcatcttcatttgaattttattggttttatagagtttttagtatttcccttgtagatttaaaaaaaaatttttgttttatgtcatctatattttaagaaggagttatacttaattttaagttgatatataaacaacaaacaacatttagatctttgagaatgtttctttgaaagtgactgatgtaatattcaggtttgagaaatgttgctttatttgatctgacatgaattctgcttttgtaaactgccaataggtttattttgtcgatatgttaaataaattcattgaataatagtctttgttgtgataggaggatttcagtgataagaaattcttctagaataaaggggagtcctggaatcttctgtttctgaagttattctcatccttccttcttttactgcctttctctcctgttctctgggtttggttcgtttttcggtgaagggccggccctgcatacattcaacttacaggcttgaggattgtaattgcagttgatgtcctcctttgcataccatgtttcattttcttttctccattgatgacaggacataggttttattctaaactccaggttcagatatatggctgcttattagctcttgaggatttgtttaaatgatggggtcttgctatgttatccaggctggcctcaaactcctgggcttaagcantcctcccacctcagcctccagagtagctgggattatagacatgcaccactgtgcctgactaacttaatttttgtgaattctgtgaattttcatttttctcccaacagagtgacctatgttttttatattatttagttgcctgccacatatagatagggatatattcaggttgattagcagtcctagttttctttctctgtgaatgaatatacattgttttcttttatttgttatatttaaaaaatgatctctatttttggcagactggctttgtagtacatgtccttatccttgtaaaaatttagataatactagctagcttttaacagtactatgtgtaaagcactgtgctacagactgacatgwattttttaatcttctaacaacccttgcaggtaggtattatttattagcaaacctgttttataggtgagaatagtgagatccagaaaggttaagtgacttgactaaagttacacaactagtaagtggtagagctaggatttaaattagacattcttattctttagtctatatcccgtcaatatctgggctctcactttaataagatgaactccttaactacaaaaactatatttggagtataccatatttactatattttcactgaaaacttgaaaaggatttgtaccaaacaattattaatctcaaaaggccctttagcgattatctagttctagtgtgtttcagtcctcatccagagcagagcctgtgttagactgtcattctggagtgtttttcacaaaaccatacttcctttctagtgcaaagccttaagagatttttggcaacagctaaattaatgtttttcttttattgctcaggagggtgttgatgaatctttcataaaagaagctgttttagcccgattaggtgatgataatatagatgttgttttgtcggctataagtgcttttgaggtgagtgaatttgtcatttgttgaggtatacaattttgtaaatttccttgcccttctcacttgattctctgcttgagactagaatatttttggaaattatttttccatgggaaatttgttctctggagagcacagacttaagtctggttaggagaaactcacagaaattcacaatttgatatattaaatatatatggaagttgttcaaacaggaaaaatgttttgtgaatttttatattgcttttaacatatttttatcaatagcaaataccttgggacctgtggaaattgtcttatgaatgccacttttgagaaatagatcttaaaacttttaatttgtactaggattcctgggagaaattccttataattcattctttttaaaattcgcatttaaaaagcgccatacatgtttgaagcaagtacaaatctactctggatatttttttccctttagattttcaaagaacacttcagttcagaagtgacgatttcaaatcttctgaatctctttcaaagagcagaactttcaaagaatggagaatggtatgtattcatttctcctcatactattttgaattgatgaagttcttatatcaagttctttctatttcttcttctttttttttttaaggctttgattacatgacccttttgtcgtggtagtagaacagatcttactgtaatactctctttcattatacagttaattaatttgtgtttgtgtgtgttcattatactgttctctatgtttggaatttctcttaataaaatgcaaaaggaagtatataatgtatgatattgcattctgggaagtaagatgggtaggactttctaatttgctgctttatgtaatttttactttataattaaaaacaaataccaatgtgttaaacaaattaaaaaataagttcagagacacatgataccatctgtggtaagtttttaatgagctctgtttatttcatttttggcaccaaagctttttgcaagaaaaagtaagcaagctccatagrggatgagagtgtgtcttacgtgtttttgtatctatcgtatgggtagatatctatcatgtaggatgtgcttggttcattttttttgagtgcctgagtgaacctgatttccggtagagttgagacatctagtgtgatatgtcttatgttatagttaacctctagtgatttctctaagaaaaattattattttttttttaagattagacaggatgagcagattaaaagtattgttggccaggcacagtggctcatgcctgtaatcccagcacttgtacaaaaaataaataaataaaaatattgtcacagataactctgttattggcatggattttaagtggtgtcttagtgtatctgaataatagttttggtcaggagaccaggatattgtcagttaagctggagtaatgtaatgatraatttttgcccaattgaagccttccaatgtgtctttcaaccaagtgtgcttgcatgtcttttaggtacgaggtacttaagatagccgctgacatattaattaaagaagagatactgagtgaaaatgatcagttgtcaaatcaggtggttgtatgtttgctgccatttytggttatcaataatgatgatacggaatctgctgagatgaaaattgctatatatttatcaaaatcaggaatctgctccctgcaccctctattaagaggctgggaagaaggtaaaaaattcagttgtttttttagaaaaagtgaacagataacacaaaagaaaacaaggaaaatttaaaatttattgttggtcatgcttatatgccagtaaggtcttntaaaatttttgccaagataaaaagtatacagtgaaaaggaagccaattcatagacaaattcagaatcggatacaaggaaaaataraaagcaaaccttcataaacaatagtaaaatgtttgcctgaattcttcatgtgattctttgagtgttggtgacataagagctctctgcattcgattttactttacagctcttgaaaatgtaattaaaagcacaaagccaggaaaactaatcggtgtagcaaatcagaagatgattgagttgttggctgataatataaatttaggagatccttcttcaatgttaaagatggtaagtatgctttgaaagtccaccccctggatttctttctcatactcttattaaattctcagcttttgctttactagatttttcttaaaaaaawtttyttttattcttgagtacttggttttactttaaacgttgcagtgttgtttaatatattctgtgcaatgtttgaaatcttttaacattttatatattttttcaatgtggatccatatcacacccataagaataatatatcctttttaccaccattttttctcattcccatttaaaatattagtctttttgttgttgttgttgttaaaatagcaaaatataatcccaaagaggagaaaattatctttgccttattaaataaacctttgtaaaggattagatgtgtgatttaaatacattaaccagttggcaagtgcaattatgttcattacagtttctgaaattattcttataattacttagaaatcagtgcttagtactttataaaggntttctntttgtcatctcactttaaatgtaaaacacataatacctagatagacctgagttgaaaaarttgttttatgaaaatcaagagcaactggtaatagagtgtgtttatttttcaaggtggaggatttnataagcgtgggtgaggaggagtcctttaacctgaagcagaaagtaacgtttcatgtgatcctgtctgtgctcgtctcttgttgttcatctttaaaagaaacccactttccatttgcgataagagtcttcagtttgttgcagaaaaaaataaagaagcttgaaagtgtcattactgcagtggtaaggaaagcagaatctccagaaagtgggatgttgaataaaacaacagcctggcctattagtcacagcaaaactgaaaatcagaggcgagatgttgagtctgtggatagtagctggatgaaatgtgaagcagtcttgggtagcagtgagatagtcaactaggcactcccttgcttttgcggaaagtttagttgaattataaaattttagggttgcaatattttgtatctgatgcctgactctcctctcttttattgtctttattggataattacccaagctacacctaactacctctagcgatgaagaattcacttggtgtgttagtgcttgaacaaaatactatttcattcaattgtttactaaaaatagatcttttaggctttaaataatkttaatattacatagatgtgtatccctccagcctactactrtctttcatagtattactaarggacatgtttcagctgtttacatttgacatgttttgaggtagcaagactttttttttaatatctgctatatgtaaggattttgtttttatttgtcctccaaattttagagggcttctcattataggatttactaaatgaattatatctttttcacatttacgtatacccgcaggattttataagttctgatcntggccattgttagctaaaatgtgtaaactttaaaaagagtaaartcttcatattttgaaaaatagtccagataggcccttcttaacttttagtttcttggtgtcttttgtgaagtatgatgacctgaactatactggttctcagtgttaaaagtatggacaaatagagtgttttattatacatatgtagataacaggttattttatattgctttacttttaatacctttctcgaggtcatgagcatgttttcgcctgtagcagcangttgasttaatcaaatccctcactggagacgttacattgtaaatctggctttggattattttccttctaagttattactctgtactgcttgtacagagtcaratttgtcattttcttacacctgttctgcattcttttggcacttacagtataatttctaaacacctaacattttgctgcttgtttaaaatcatctgcaggtttggagatttttgccatgtaccttattcagattagtggtaaaacagtgaaatcaaagaattccctttaactatgtcttggcaatccaactgtttatcttcctgttttgaaatatacctattttggccaggcacggtagctcacgcctataatcccagcattttgggaggccgaggcgggtggatcatctgaggacaggagttcgagaccaacctggccaaaatggtgaaacctaatctctactaaagatacaaaaattagccaggcatgatggcgggcacctgtaatccttcctactcsggaggctgaagcagtagaattgcttgaacctgggaagcggaggttgcagtgagctgagattgtgccgctgcactccagcctgggtgacagagcaagactccgtctcaaaaaaaaaaaaaaaaaaagaaatatgcctatttattcctaccctttattggataaacagttcatatgaataaagtttgtttttagagataatgtttcaaggtaagacatagataaaatttaactttgtctttccttgtgaatagtgataaacctctttaaaaatccgaccaaagcagttctgttaatcctttccccaccaaaatgcacacataaacaaaacttttgcatattatgcagaggaattcatataacccatgttcagaacccttagtttgtactagtttttgtttcctttaacatttcaggaaatcccctcagaatggcacattgaactgatgttagacagagggatcccagtrgagctgtgggcacattatgtagaagagctcaacagcactcagagggtggccgtggaggactcggtttttcttgtattttccttgaaaaaatttatttatgcactgaaagctcctaaatcttttcctaaaggtaagatacaagctgtgaatcttttaaatgtgatactstgcaaaactgaatgattgactccacaatgactgtcttgaataaaaagctcccagcatgttcatgtaggatctagcatcatttctctttccatgtccttgtaggtgatatatggtggaatcctgaacaactgaaagaagacagcagggactatctgcacttgctcattgggctgtttgagatgatgctcaatggtgccgatgctgttcatttcagagttctgatgaaacttttcataaaggtacaagcctcctccttttcaggcgtactctacccttaaagaagatatggctggcctgcaatcccagcactttgggaggccgaggcaggcggatcacttgaggtcaggagttcaataccagcctggccaacatagtgaaactccatttctactaaaaatacaaaaattagccaggcatggtgatggggcctgtaatcccagccacttgggaggcagaggcaggagaattcgcttgaacccgggaggcagaggttgcagtgagccgagatcacaccaccgtactccagcctgggtgacaagagtgagactctgtctcaaaaaaaaaagatgggctgggcgcagtagctcacgcctataatccgagcactttgggaggccaaggtgggtggatcacgaggtcaggagatcgagaccatcctggctaacatggtgaaacgccgtctctacgaaaaatacaaaaaaaattagccgggtgtggtggcgggctcctgaagtcccagctactcgggaggctgaggcaggagaatggcatgaacctgggaggtggagcttgcagtgagcggagatcgctccactgcactccagcctgggcgacagagcgagactccatctcaaaaaaaataataaataaataaaaagatactgtgggttatttgggtwatgacagtttataatgtaaacaaaagtagacttgtaaacagtgaagagtatataatadcacrggccctgtaaaagagtacaatcacaatactaatcggtaggttgaatagaaactaacattgctacactcctactaatatgttaggcccattactatatttaaaaataacaacagcccagtctttttgattggttaataccatttaaaaatgtgaatactggtgttcagagaggttatttagcacacgtgaagttactcaggaaatttcatccccagcaccagtgacctccatgttgccaggcccagtggtcagttcctgttcttgcctgacttgttctctctacagcatttgacatggagttggcattgctcagcacattgttgaagtattttcttaattaggcgtcccagatactgctcttgtcttggttctgtgttttcaagtgcaaggttatagtgaggcttctgaatatcactcttcattgacatcttcccagttcattaaaacatggaatatggaataatttgaaatgattagacaaagcaaaactttgccttaaattatttgtttctttataattgtacactagtgagaagaggatttggaaccagcttatttgagtaagaattaaaagtttgcttttttttttttttaattaggtkcatctagaagatgtttttcagttattcaagttctgttctgttttatggacctatggttctagcctttcaaatccactaaactgcagtgtgaaaacagtgctgcagactcaagctctttatgtgggctgtgcaatgctttcttctcagaagacacagtgtaaacaccaactggcatccatatcttctccaggtattaaaagtagcattgttatgttttgtcatgaccaactgttcatgctttctctatatggtttatgtagtttggaaaattataacttaaaaaaaaatagcagagggcaggcgcggtatctcacgcctgtaatcccagcactttgggaggccgaagcaggcagatcatgaggtcaggagatcaagaccatcctgggcaacatggtgaaaccccgtctctactaaaaatacaaaaattagctgggcgtggtggcrtgtgcctgtaatcccagctacttgggaggctgaggctggagaattgcttgaaccagggagttggaggttgcagtgagccgagattgtgccactgcactccagcctggtgacacagcgagactccatctcaaaaaaaaaaaaaatcgataaaggccaggcgaggtggcttacacctatagtctcagcactttgggaggctaaggcaggaggatcacttgaggccaagagtwcaagaccagcttggacaacgtgatgagatcctgcctctacaaaaaatacaaaaattagctgggcgtgatggtrcgtgcctgtagtcccagctactcagttgcctgaggtaggcagatggcttgtgcctgggaggtcaaggctgcagtgagctgtgattgcaccactgcactccaaactgggcaacagagcaagaccctgkctcaaaaaaaaaaaaaaaagggctgtacatctatacatatttctggtcacttctaagtattgcttttaagttactggcactagcaaaatctcaccaaacacaaaagtttaataatagaaatggcaggtgattatatgagttcttaataatcagctattcattttctgagctgtagcagcaatgggttagatatggaagtcagatcatcataatacaatttaataatgagctaacaaaaacaaaaccctcctgcatttatctcttttatcgggcataaatcatattcaggttcggcattctctaatgaaataactgaaagttaagtttttttataatgtagaattgcaaattttgcaaaagatgcagaatttcatgaaacaatgaatgcgatattgaaaagtgggttgacttacagagctattgacatgaggggatgtggcagaattagatcagagaagaatggttgaagatgaaaaaattgattagaataatggacatgattaatgcttcaaactgtaatgttattaatatcagaggcataggagtggccctggggaaatttgaagatgtccttggtttttttttgttttgtttcttgttgttttttttttaattccaaaattactctttgtaaatrttctgtgaaagcaagttagatgatcatatacttttccctgaacaattcctcagtgtttattttttgttagttctttgaaagagcacataattacatttgtaaccaaattttgttacatttaaagtagatatgtaatttcaagttttatttctaaaataaaattccacaaaagtaattttttattcgcttacaaaatttcggtctttattttaggtgagtttactgttaaggtttttctagttatatttggataagaacaactctatacattttttaactttaatttttcaattaatatggacatctttccatattaataaatggaaaaatttatctttttacaactgcctgcagagtattccattgtatggagatagcaatttattaaaatagttattttctgctaaacttgtgggttttcaaaaaggtacatatattttatttagagataactatttctgttttccaatttggtnttaaatgtttactgtcctttgacagtggcctctgagtcatatatgtcattttgactgtaaatagcaagatggaagaacttcagttttccattggtattgccctttgtgggcatgcttgtgtggaagaatttgggctttgtgaaaaagatacattgcagctgcagggggctgggagggtctttttttctgtggggacactgaataaacagttgtatgcctgcattttcactgcagcccgtcacatgaggtcaggtgtggaattttccacttgtgtcatattggtgctccgaaaatttgagattttggaatttttggatcaaggttgctcaacctgtatgaacttcttaggcaggtttgaaaccttgtcaagctttatcttagtatttcagaaatggaaagtataatggaaaatttctagcaaaatataaatgaccgtagtttgctgcagtagatatgaaataaagcttaaataactaattactgtaaaaggaatttagatatctctttgttccaaagacatctttttaaaaaccctagcgcagttggtctcacagatgcattcctactagatctttgaagcagattttttcaatgttgttgaactgggcagggcatagagaagggaagcttccagattctttatttaaaactggcataacattgaaaattgagaaagcctacagacaaaaactataggtcatgttgctttgaataatattatgtaaaaatcctaaagaaaatattcgcaaataggctctagcagcatatttataaaaatcatttacctagctagagttcatgcccagaatataaaattggttcagtaaagggaactatgttaatataattgactgtatcagtgaaggacaaaacccataaagtgtccaaagatttgaaaaggcattagccaaaaatcagtaatcctgattgacagcagaataggagtaacatgatcaaaaattcctcaaatcaaaagctagcgttttcacttcataattgggaaaacaaaggcattcctgctgaaatcatcactctcattgaacatgattctagaagtactagccggcagaaatagacaagtttcaaatacttatggaatgtatgaatatartaaaggcaaaatcaaagatctgtgagatggttatgtggattgttaaatgggacatctggctatccatttggaaacattaggaagtttgactccaacctcattccttagatagaaatttcatgtgaactaaagatttaacataaacttagctctggcattagaagaaagcatgaggtacatatgatctctccctctaaatatagagagaggtactttctaaattcacttagagtgaggagggcctttctaagcaccagaaaaaaagtagaagaaaaacttgactctaacatttctctatcaaaaagtaaaatcaaaacacaccagtctgggaccaaatatttgtagagtacgatgcacaggtgggtaatttcccgtgcacgcttgtacaaggctgtatgtgcagcggtgtttgttgcagcattgttttgatgacaaaagaatagaaacaacctaaactttaccagtaaggtaccggtttttaaaatatggaaaatacattggagtatacaattaaaaaataatgatttggccgggtttgatggctcacacctataatcccagcactttgggaggccgaggtgggcggatcacctgaggttgggagttcgagaccagcctgaccaacatgaagaaaccccgtctctactaaaaatacaaaattagccggatgtggtggcgcgtgcctgtaatcccagctacttgggaggctgaggcaggagaatcgcttgaatccaggaggcagaggttgcagtgagccgagatcgtgccattgcactccagcctgggcaacaagaggaaaactccatctgaaaaaaaaaaaaaaaagaatgatgtaatttggatatgtatgtacttatggaaaacattcgcaagagtttagatgtgtctgtaatcccagcactttgggaggccaaggtgggtggctcacttgaggtcaggagttcgaaaccagcctggccaacatggtgaaacccagtctctactaacaataccaaaattagccaggcgtgtggcgtgcacctgtaatcccagctgctcaagaggctgaggcaggagaattgcttgaacccaggaggcggaggttgcagtgagccgagattgcaccattgcgcaatgtccagctcatatgtgatagcagttggtgtagaacagagtttatagtaygctcttgtgtattttcaaaagaatgcaccaggtaacatatgcctaacctttctctggaatattaaatattcaaacagtgaacagagaaggagtttgaattcgaagggaaactttttatcaagtacctttggtactatgtaaattttgtactgtttcagtttttaaaattgtttcttaaatttttttttcctttgattttagtggtgacatctttactcattaacctgggaagccccgtaaaagaagttcgtagggctgccattcagtgtctccaggccctcagtggagtggcatccccgttttatctgataatagatcatttgatttctaaagcagaggagatcacttcagatgctgcctatgttattcaggtaagctcgttagcaaagaagattgagtgtgttcatgcctstgtgtactggagcaattttctccattctcgacatttcactgtgtagggattttgatggactaagtcattggatttaggaactgataggtcaatatctgtacatctgtgtccccctacttttgaaaagatagcaatgtcatatttcaatttwgttcttttcattggataaaggwttagtgtgtagcttttcatagtaagccagctgtgtgtttttaataacgtttcttattaaggttttaaggagaaatggaaaattataaacaatgtcacatcatttgggtaagagtcttccgtaattaatatatttagcctttgtagtttcttaacccttttttatccaattttctttttggtatcttaggatttggctactttatttgaggaactacagagagaaaagaaactgaaatctcatcagaagttgtctgaaactttgaaaaacttacttagttgtgtgtatagttgcccatcttatatagcaaaagatttgatgaaagtacttcagggagtcaacggtgaggtatgtgccatttaagtggattgtacattcctgtgatgttactaaagaattgttgtaactgcttgtgggtgaagaagacaattgtaagagttgcatgtgtgcnctcagaagagataaatgtaatattaatttgagagggggatgagttgaggtagagaaaaacagatacaagatacaaagacaagtactggtgagtttctttttattttaaaattaaytgtgttgtccctgtctaatcattaagtttattttaaatgaacttaacagtctcgtgtctcatggggctgcactgctgaaagaagctgttgsttcatctctgtttttcaagtgaaaattctatacaaaggaatatatttggacacgagtctatgaaaattccaaaatcatttgctcgtttattatatatatttagagctttcattgtgttttcgaagaagcttgtgttacaaaagaaagcagttgtgaaacacttgttgatgtgatggcatgtgctgaccaacataaaaaaggttctttcatcccagtgttacagaaatgcctgtgtgcttcatcagtcctagactgactgtgggcttagagaactaaaatgagccaaatggattgaagaccatttgattacactttcttggtaggaacaaacaggttgcattcagcccttagttgtccctggtatagtttaaattaataattgacaaatttcttgggtaaaggaccagataggaaatattttatgcttttggggccacacagtctctgttgcagctactcatctctgcagttgtatcaggaaagcagccacagacagggtgtaaacaaatgagcatggctgtgtttcagtaaataaaatttacaaaaacaggtggtctgttgaatttgacctgcaagccataatttgctggcccctagtttagcagttaaagatttacatacataatttgaattaatattaattataccaagttggaaacattgaaggacacatacagtgttttagggaatcttaaactttatttttattctctaaagttttagtttgtgttttctgttctcaagtcttgaggaatgctcacagattatctttctgctcatctctgaagggtttagcacttttgagcattacacatgaactgtcagaaaggacctgagtgccttagtgtgaattaatagctgtctccatgtctaagaagttaccatcattgggttttttcctccaggctaaactcccatcttccagcaggctttgagtgtctctgtagagtgagcaaaaacatatcagtatacataactatttactactaagtctttggatctttagatggtgctttctcagctattgcctatggctgaacaactgctagaaaagatccagaaggagcccacagctgtgctgaaagatgaggccatggttctgcatctcactctgggaaagtataatgaattttcagtttcccttttaaatgaggatccgaagagtctagatatatttataaaagctgtgcacacaacaaaggaactttacgcgggaatgccaaccattcagatcacagcccttgaaaaggtcagtgatttctttcagaaactaaggcatagcatgttcaagcatttaaaggtagaaggcaacaggaacagcgttaaaaaaaaaaagattaatattttatttggagaagatagttacaggtggactagacgttttaaaggaaaatgatgtatttgacccatttttgaaaactgaacgttgtacatgggtcattaaaaagaattgcattttaactgacaaaattaagtgggaaacaattttgtattttgagagaggttgatataaaaattatttctggaatttaaacttgttcactgaactcagttgccttttttctaccccctctagattacaaaaccattttttgcagccatatcagatgaaaaagttcagcagaagcttttaagaatgttgtttgatttattggtgaactgtaaaaactcacattgtgctcagactgtcagcagtgtttttaaaggggtaagctgcaaacttcttgtaattttttttattaatgtttatagtctcttccaagggacaccatgtttaagagtcctgtattttatagtgcttgtaagaggtcagatgttaccattaacaaaaatcatggaaaagtaagtcagagagaggcataaaataaaaattttaaatctttaccattattttattttatgaagtatttgttgataattttaaccagataggatgtgtaggaatatgtgtgtgtgtgatctttctcatattagacggaatctacctattcctttatgcaaggaataggaatgagtcaatggctcagtattgaactgggtaacattattctacttaatttaaatagttgtttaatgacatataatggaattgaaattctgcttgttggttttatacgtatattgaaaccttgttattatcagaatagccacctggttattctcttttttgaatatagaataatacaaagttctagtatctagattcagcagttctcagaattttaacatattaatcttttttccttctttttctttgctgaaatattttaaagtaaatctcataatgtcatgcactttcatccctctgtacttcagtgtgcatcttttgaaaagtggatatgactacaatgccattagaagtaaaaaaaaaaataattccttggtattatctaatacctagttcataatcatatttccatggttatcacaaaagtattttttatagttgttttctttgwatcagaatccaaagatttagttgtgatgttagaaccttataaaaagagatatctggatcccaccccatatctaaagaatctctggggcagtaaatctgtttttgtgcawgtgtgtatatgtcttattccttcctagctgattagaatatacatatctgatccggcacttggaaacaatcggtatggwtgattctgtattgcattactagttgtccactctaagggatgagcgtgaaattgagtgactctggactggagaagtgatactgtatcataatcaagacaagtgcagggctgtaacttgagactcccaagacaaattgtatagaaagcaagtgcatggtagtaggagagcttggttaaaatgaaaatctgaagttgaatttatgttggctagagcttttagtgtatactcttccctactttgctttcttctcattctggtttttcaagaagtctgtaacaaggtagtagcatccaatgctggggggggttcagatgcatatccagtaagtcattcttccctcttaattgaataaatccttcctaggggttaacatttattgctctaattttatcccaatggattatatcatcaactcttcttccttcaatatttcagatttccgttaatgctgaacaagtccgaatagaactggagccaccagataaagctaaacccttgggcacagttcagcaaaaaagaaggcaaaaaatgcagcagaagtaagagctacaaatgcattgagcacatgctgttgttccctgactctgaatgttatgaaaccattggaactttttgatactcatcaatttgctataatcaggcacaatggtttttacttagcacatgatagagtttgcttttccaacgttttgtcttctccattttccagaaaatcacaagatctagaatctgttcaggaagttggaggttcttactggcaaagagtaactctcatcctggaattactgcagcacaaaaagaagctcagaagtcctcagatattggtgccaactctttttaacttgctatcaaggtaatgacacttggctttgatctgtgagagaataggactctaattcttgcccatcttatctaacattctcttttcaacatactcttctcttgtttagatagtctgtaaaataaagcaagtactataggtgaaattaaaagattggttttaggtatccattgctggtgccccaaactgaccttagtgtcctgtgtcatgtagtaaatggccactcactgtacagcctactttcctctgaacttttcagtagcgtgcctgggacgtcattacttgcatttcaagatatagtgttgaatttatatagatatagatatgtgtgtatatagtgtttgctatctaaatatattttcatatatatagatgtatatattctatatacgtagatttgtgtrtgtgtgtgtgtaaattgagtatgaattgtagcgtgtgctttcatgtgaaaggcaaagtaattctgaaggttgtcctgtaagattccagataggctaatggaaagtgcaatagagaggacgtggaatttgacatagcgcctgtctatatgagagaaaattagagttagaaatcttatatcttatttctagacttgatgtttaatgatagtattttagttattccttattgaatgagttccttattgaatgagttctggacaatggccrttaatgtaacaatgaattgtacaacttttacatttcccatcatttctcttttgggtgtcctgaagatgtttagaacccttgccacaagagcagggaaatatggaatacaccaaacaattaattcttagttgtctgctcaacatctgccaaaaactrtctccagatggtggcaaaatacccaaaggtaggtactttttggaaggaaargttagaaaaattatctactttgrgcgtgagtgtacctgccacttagggtttttgtctttctcaccattgtagatattttagatgaggagaagttcaacgtggagttgayagttcagtgcatccgcctttcggagatgccgcagacccatcaccatgcccttttacttttgggcactgttgctggaatatttccggtaagcgttaatgatataagattttagcagatatttcagatatttttcttccacagaaatgcactggcacctgttgattttaaatttaatcaattaggctttggaatcttccagcactggtgagactctcagccctgcctcttcatagctgggactgtataagccagttgatcttgctaagctttggtttccctttttatcaagtgggaataataaccttcttcactggattgttgggggaattcagttggataatttgtggttagtacttagcataatacctggcacactatctatctaataaaacagtaggtattggtgttaattgggaaaagttaatatctcatttatcctcaagtaatcctcaaagtaacctttaaccagtgacttcagaaaattaatttgatcataaactatgtcatttaaagaaatcargtcccttttatgaaaaatatcatttaaacatttgtaaagagattgaagctattttcatattgaggatttgagtcagagctccttaacctggggttctccatgagctttaggggatcttaatctactgaaatcatatgcaaagttttatctgtatgggatttctttttttcttgtaagagagtctgtgcttctcaaaggggttgataatccagaaacagttaagaatcattaatattttttctgtttttattgaaatatagttcagatgccataaaattcacccatttaaagtatacaattaagtgattttagtatattcacgaagtttctgtaatcaccaccacgatctacttgaagagtattttcatcaccccagaaaagaaaccctacacccattaactgtcactcttcctctccctcctccctgccgctgccaccgtcaccaccagcaccaccaccaccaccatgaccaccaccctgctcctggccactagtaatccattttctgtctctctcaatctgcctatgctggacatgtcatataaattgagtcatacaatatgtggccctctgtgtctggtttcttttgcttagcataatgtttttgtttgtttgtttgtttgttttgagacggagtctcgctctgttgccgaggctggagtgcagtggcgcgatctcagctcactgcaagctctgcctcttgggttcatgccattctcctgcctccgcctcccgagtagctrggactacaggcacccgccaccacgcccggctaatttttttgtatttttagtagagacggggtttcaccgtgttagccaggatggtctcgatctcctgatgtcatgatccgcccgcctcggcctcccaaagtgctggaactacaggcgtgagccacygtgcccggctgcttagcataatgtttttgaggttcattcttgttgaagcttgaatccgtattccttttatractgaataatattgttgtatgtgtatgccacattttgtttatctgttcatcggttgatggacatttgggttgtttcaactgtggggctattataaattatgttgctatgaatattgtagacatggttttgtgtggacatgttttcatatctcctgggtatatatacctaggagtggaattgttgggtcacacggaattttatgtttagctttggagtaacttgcaagactattttccatagtggccacaccattttgcttccaccagcagcctgtaaagttcccaatttcttcacatccttgccagtacttgttactgtcttttttatcgccattctagtgggtgtgaagtagtatttgtgcttatattcttttcgtatgaattttttctttgaagaaatgtcttttcaaatcctttgcctgttttttaatcaggttatttctctttttattggtgagttgtaatgaattgttgaaatggaaaatgttagcctgagcaggaatatcacttgtggccaggagttcaagaccagcctgggagttcaagaccagcctgggtaacatagtgagaccccacccttacaaaacagaaaaggaaaaaaaattagctgggcagggtagcatgcacctgtagtcctagctactcaggaggctgaggtggaaggattgcttgagcttaggagtccarggtttcagtgaactgtgatcacacaactgcactgcatcccagcctgaatgacggagcgagacgctatctcttgaaaaaaaaattagtagaaattaacagaaataaaaaatgttgatagttgtgttttctttyaggataaagttttacacaatatcatgtctatttttacatttatgggagccaatgtcatgcgcctagatgatacttacagttttcaagttattaacaagacagtgaaaatggttattcccgcacttattcaggtaaggtctctttataccatcgtggggtttctttttttaatttaaaaattttgcatataaatgacattaaaagccttttttttagttttttttttttgttttttttttttaatatcctcaacagttgtataaaagcctttctgaaatgctgaagtacattgcccttaagttttagaacattgaagctaagaagcagtcttggcaatgtctttctcaataatataaacaaacgtgttatagctggttctgctgtgctgtgagtgtgtaactgtaagtgtcttaacatcattcgggtggggtaaattgacatccaccatctatttcaggacattgcatcagtttgataataccttcttacatgttgatgaggctaggaacttttagagctacagtgacaaatttgttaacatgcagtttagcaaatgtttaccaagcattctctaagagctaaactcagagagagaggtgagatgttctctctcccagtaaggaatgaacaattcaaaagttaaaagtagcctcaagagtaaaagagcttgttcatctacttgagttgtctatgtacccttcacttgttaattaatgtcttttctcatgctattgaccctctgagggatgaccatattcagcaccttcttttaaccttagtattagattggtgttctcagtgtccaccaagttggcaagtataggatatatacctaaaaagaaaaataataatatgcattcatatgatcagtgccagtcgaataagtaaatgctaaagagttcagaataggggaaagtctatatgggccaggatgaccagaaagttctataagaaatagaatttgtaccggtgtgaaagaaggatgggatttgttcagtgatggcagagccaatagtatgagaaaaggcatgatctaggaatgtgcacagcatgtttgaagaatgtaatggtgattgattgatggagagcagagggttgagacaggtagacnttggtttattcattcattcaagtgttttctgtcattctttctgtcatttattcaacaactatattttgatcaccaatacctggagtaaaatggttcaaactttattctgaaagcagcaggaagttgttggccttttctgtgctctgcttatcttcattcttcttgaggcacaacccaaatcctgtgtgatttgtgcagccttcccaggcagtctaagcagacttgctatcagtgtcacatatttggcatstgccattactgcctcctgttatcttttcacacatgtattgtttcttttgtttgtttgagacagagttttgctcttgttgcccaggctagagtgcaatggcatgatcttgggtcactgcyacctctgcctcctggtttcaagtgattctcctgcctcagcctcctgagtagctgggactacaggcacgcaccaccacgcccggctaattttgtatttttagtagagatgggtttaaccatgttggcctggctggtcttgaactcctgaccttaggtgatctgcccagcttggcctcccaaagtgttgggattacaggcgtgagccactgcgcccagccatgtatcctgtttcatacagaaaataaatctcctttggggcagggctcatatcgtacactttgtattccccttggggctaagtagcgcttgggacatgacaggtacttactgaatatttattgttaggcctttgattattaaaactcttgtggctgagtgtggtggcatgcacctgtaacaccagcactttgggaggctgaggtgggattatttgaggccaggagtttgagaacagcccggtcaacatagcaaaaccccrtctctacaaaaatttttaaaaagtggtggtggggtcctgggatgtcccagcttcttcggaggctggggcaggaggatctctttgagctcaggagatccaggctgcrgtgagatatgatcacatcactgcacttcagcctgggccayggagaaagaccctgtctctaaaaaaataaataaaattcttctggcaatttcttggggcccatctaaaagccttatcttgttcacctaaacttgttttgtggaagattacttgcacctactcattgtctctgcttgctgttttgcagtctgatagtggagattctatagaagtttcaagaaacgttgaagagattgtggtaaaaatcattagtgtatttgtggatgcgctgccacacgtcccggagcacaggcgcctgcccatccttgttcaacttgttgatacactgggtgcagagaaattcctctggattctcctcatcttgctttttgaacagtatgtcacaaaaacagtgctggyggctgcctrtggcgaaaaggtcagaacctagggtgggaagataaggaaaatggtgatttctcacacagattttatgatattgtccagtttaaacatgrggctgatgatgcctaatgtgtgttatttagaayctttttgctcagaacctttttcaaaaaggtttttggcattttaaaaaattgcattcagagcccatagcactctgaatatcctcagttgcagcaaaacatctgaaggcgaattaacttttctgagaaacagttctggtgccacgcaagtggttctcttttaagcccagcagagtatggctgaagagtaatgaaacagtgtctcttcaaagcggttttgaaggcagtttgtggggaaatagaggagcgtccgtgtccctgaagtcagtaagacacaaacacaggtgattgtttggataaagccctgtttggataagtcgaggaccatttttaaatgacttcttagacatgggatctgggagtagatctcgacccactstaaataaagtagtatactctgttctgctagaaatcctaacgcacattatcctgaaattatgccttcacaattcctaagtacagatttgttacctttttctttttctacacaggatgctattttagaagcagacactgaattttggttttcagtctgttgtgagtttagtgtccagcatcagatacaaagcttgatgaatatcctccagtacttactaaagctgccagaggaaaaagaaggtaagcgtagatcgggtgtcacttactgttcaatctgaaagctaaagagaaacagaagagaatgcaggttatccttagtacatcttcagaaggatttttaaagtaagttaatcattttaatttgattgtgtagtttcttgaatccttatggaaaatagtcggaattccatttgccattcctcacacattgtcttttatacctctgtgctctgcgctgacgtcttggctgtggaatgttgctggtatccaggatgagttaggttcaaatgacagtaaatgatcaggacctcattagctgtctctcagcttctcattaaaatatctgaagacatttacatgaaaagaaaaaaagtaggtaccacaggagtggcagcaaaatattaaaattgtaccatgcagcagagccttgaagaaaatcccacgaaccgcagcaccactgaggctggcttaggaaagggttgatgaagccaggtgtgatggtgttagcctgtggtcccagctacccaggagaatgagacaggaggatcactttagcgcagttcaagaccagcctgagcaacatagtaagacgccatctctaaaaaaaactttttttcattaagaaagggttgacgtgttgatagttcttagttctctacaattcgaagcagaacgacaaggcacgttagaaggaaggtactctaagagctccgcagagactgttttctgcgtggccagccattggccctgtcatccctgtttggcgaggcagtaacttgtcccatcctgcagtcagctcaggtttggcagggacagacgagggaggtccctggacagtatgtggtgtatgtggtatatgtggtgatgtgggtaaggaagtgtcttagcagtaagtcattctataggctagtggtttttaacactgcactgccaaccccatttacattagacacattgaataaagaaatctacacctgcagttggaagttcagagactccttccgtgatgtggtttcttccatttgattgtccagtttccctgttttgttttttgtcttaaacactcgcttctcagggccactgggtactytcttggcaaatacactcacgtttttcactaatttagaagaggagaaactggatgtaatagatgaacacatttctctgggaaaatgttatcccgttaattgtcctttacttgaaaggttatatctgttaattctgtatgaaggattcaggtgaaaatgagtaaggtcacttgttttattgctgtttcagaaaccattcccaaagcagtgtcatttaataagagtgaatcacaagaagaaatgctacaggtttttaatgtagagactcacactagcaagcaactgcggcattttaaatttttgtcagtgtccttcatgtctcagctcctgtcttccaataattttctgaaaaaggtaatgtgttctttaaatgtgtttataaaaaggtattctgctgtctccaaggaactgttctcaaccagtagaagtagcttggtaaatggctcatgaaaatgggaggcacgcctttaaagataatagaacaagaaagtacgtttcaccatgaaaagccgttcgtcatgatctactgagatggaacataatgtaaactctgtgactcagtggtttcattcttaagtgttgtgtacccatcagaagtttatgaacctgtacaccaaaaaaactacaagaatctttataatattcataacattcttcatggtagcacaaaactggtaacaactccagtgtctaccagcagagtagataaattgcctgtattttattttattttttgagacaggtctcactccatgtcccaggctgaagtgcagtagagcaatcatggctcactgcaacctgaaactcctgggctcaagcaatcctcttgcctcagcctcccaagtagctgggactacaggcgtgtgccacctacatctggctaattttaaaactttttttatagagacagggtctcgctctattacccaggctgatgtcaaattcctggcctcaagcgatcctcccaactcgagttcccatagtgctgggattacaggcatgagccancatgcccagcctttctttacctggatatagtgagttctgcatgtatgatttgtatacatctctgtttgtgtattaaacttgtttaaacaatgagagaaaaggaaggaaagaaaggaatacgaccaggaatacaaaaatggtttgacattagagtactgtaaagtccattaggtcctataatgcgttaacagatgaagaagggaaaccatatgatcattttacatttcacagtgaaataattcagcagactcaatgcttattcacaacttaagagagaaaaatcctcgctcacacctgtaatcccagcactttgggaggccgaggcgggcggatcatgaggtcaggagatcgagaccatcctggctaacatggtctctactaaaaaatacaaaaaattagccgggcgtggtggygggcgcctgtagtcccagctactcgggaggctgaggaaggagaatggcgtgaacccgggaggcatagcttgcagtgagccaagatcgagccaatgcattccaccaacctgggtgacagagcgagattctgtctgaaaaaataaaaaaaataaaaaaaaggaaaaaactcctctcagcagtgcaggatagatgggaattactttggcctaataaaggtgacaatctgaagcttgtggtttatatcatacctaatgatgaaatattaatggtgtgcctgctacagtcagggacaagaatctcctctgtcattgtttctattcaggaaaagaaatgaagtgtaagaatcaggaaagaagagaatcagcaattagaactaataatgagttcagtaagcttgcttaagagagatcagtgtagacactatctagagatcagtgtaggttgtgatctgtatcaagcaggctggctgaactaattagtctcaccactgttatataatattgttattcctcaaattagaaaacagagtagaaaaaaagatttcctgtataatacaaacataaacttaraaggtaccaagaataagcctgacaaaaatatgtgcacaaatattacaggggaaatgtgcaagatatgaagggacacagaagaaaacttggaagaaatagaaagagagacactgtgtttacgcatgaagaagcctcactatttaaaggtggcagatctgcccagattggtctagaaactcagtgtgctttttcaattatatcattttaagaaatgatattgatacattgataccaaactgtaaggggccaaggacagtggtatggtgcaggagtaatcagatggatcaatgtgactgaacagtaggcccagaaacacatgcaggcataggtaagaggtgcagcaggtgattttacaaagcagttgggggagagaatggtccaagtgctggccctggcatgatttgtttcccatttggggaaaagtctgatgtcacaccttgtagaaaagacaactttagtcagagtaaaaacttcattgtaaaaaacaacagttcaaatgtttagaagaaaatcaaggagaacatgattgtgactggaggataggaaagaattcctttaaaattttgattcaatagaaagccacaggctgagagaagattattgctctgcataaatcaaaaagcctcagtttccattagaacaactggcaaagaatatgaattcactgaagaggaattacagatggccagttaatgtacaatgtcatttagcctccagtaagcaggaaatgtgattaaatgtgatacccatcaaattggcaaaactgttgaagtcgttagtaccagggatngggtacgtagtggcagacagtgtgattgttccaaccactttagaaagcaattggcaggatcccatgaggttgaaagttccagtaattcctgtgatctggtcattcccttccttaggtatatatgctgtaaaaacttcccaagatgatcaaagggacataaaaatgttcttctctagcattattagtaaaaggggaaaaaatggacataaactaaacatctaacaacagaggcaaatggatagataagtggtatttatagaggaatatcatatgcagttaaaatgaaggaactagaacataagtcmccatgcatagatctcaaaaatargtttccagaaaaacatgttgttccgtgatatgtagtgtttgaaacatttggaagcagatttgggatgatggttntgtttgtggggcttggggtagagggagaataggaccaaggagcagtacttgggggattccagctgaatctgtaatgtttaacttctcaacaaaggatatgtgagctcaccagntcagcatgtcatagaattcggtagtgctaattgagtgttgattgctgtatttttctgaaccattgtagtactttttagatactaccagtagaatntaattaaaataaattaagagaaatagagttactacagtataatgaagatgntatgaacctgattaaattgtaatgtcagaaaacagttgctgtggaaggtttcagtgaatggtccgagtttcattgaactgacttgaaatgacttttattattgacttccntaccgttctaatgacgtcttctttaaaaattaggtagttgagagtggtggtcctgagattttaaaaggccttgaagagaggtatgtttccttttctttttntactttttatttggaaatgacttcaaacttatagaaaacctggaaaaacagtacagaaaattcatatactctttacaaccaggttcaccatttgataatactttctgccacatttgccttagcgttctccctatgtagggttttttctctgagccatttgaaagtaaatcatatacattatgtctctaagaataagagatgttcttataaaaccacagtacattgatcaaattcagaaaatttaacattgatccaatccagtgatgtaatctacagttcatactccagtctccctaattatcccaacactstcctttacaccgcatgtgtttctgcatcatgatccatgtcaagtctgtgtattgtattgagttgcagtatctgtttagtgtctnaatctggccctgatttctatgggctcatgaattctttattcngtggattctaatccatatgctgccattatatatttgggtgcaggaattttcctttctctcccwtgtcctcggggtttgcctcctggccttgctgtgtacctccttttcagatgcatggcattcccagggccactgtcctgccccttccactggaaagtgcctgccctgcagccaggaatgtgagctgctgagttccagtcctgtgggctgacttgtagcgctaygcgtaggactttcgtttttggagctgattttgtctgcgcccccttctcccctcctctgctgtgcggtgtcaacttctgtctccactcttccctctagctcccccctcaggctggcagcagtggggggatctccagtggcagctgtgttggaatttggtgtgtgcttttctaattacaagttatttgaagtttgtagtcttttttttttgtctcctaataatgtgaaagaagtgggttatatgttcatttctattaatatttctctttatataaatggtgtatggtgtgtgtgcatgtgtatgtgtgcgtgtgtgtgcctgtgtgtgtgtgcgcgcacacacctgccattaacctagggccataactccctgaacaccccacttggacagcccagtgagatccactgagcatgagctagatatgagtgagttccttaaacgctttcagcatctgttgcttattcagcacctcacagagtctgagcgaggtcgatgcttctgcacagaagcgcctagttacttcttgatgatctctgtctatggcaataatccctcatttcctttctttccgagtagtttttgaaayaatttagtacagaattatttaactcgtctttctacttgaaacatttagcataaggtagacatgaacaagttctctgagtkycttcagctgccgtttgctgagcgagcctctgtgtttcaggttgctggagaccgttctcggctatatcantgcagttgcacagtccatggaaaggaacgcagacaaactcaccgtgaagttctggcgcgcgctccttagtaaagcttacgacctgttagataaggtaggtgttcatttctccctggaattactgttttgttgctgttttttaaattattgtgaaattatgtaaagtttttaagaataaacttagcaattccttttatgaatataatgaagctcagatttttcttagaaaacaatctcttgatgactagaaatagatttgtctggaaaaaattgtttccttaccagttatgagaacatgtacctcgtatattttaataattaagtcatataatatatactgttctactttattcaagtggaataaaataaaagtatgaagtatattacatacatatcactggcctcgaagttaggattgctgattcaaatctagctcagtcatttagctgcatgcctttggcacttcctcctgacatcaggcttttgttttgttcgataatgtgtggttggtaatgcctacctgaaaggttattttaagaattaaataagaaaatgtgtgtggaagtgcctggtgcctggaggtgtgcagtggacagcagtctgtcttaattgaagttgnttttttttttaatttgtttttcttttcatgttaaatataaaatttctctttaggtcaatgccttgctgcccacagagacattcattcctgtgatcagagggctggtgggcaatcccctgccatctgttcgccgcaaagcgctggaccttttgaataacaagctgcagcaaaatatatcctggaagaagacaatagtgagtgaagacccaggacacacccatttactgtacttygctttatcaaagagctgcatttaactcccttcaatttctctagtggtacaatttcaaattgaagtatattattwtctgaatataataccatgacatgttttaaaatgtgacgttaattctaacgggaatatatgtgtgttgtaagagctcttagaatggaatttcagcctagtggaattcttgcttactacagagcttacgtggccttagccttagcatagttctaagtcccttttactccagatcagtgggtgctttgtataagtgaaacastggctagaacatgcacatcgcttagcatgactgtgtgactcaggacccccgagtctgatttccatttagacaatctcaagctgtgacaatgggaaaatggacaaacattttttgcarctttaatgatttggggattctggctgtccccttcaggttacccgtttcctaaaactggttccagaccttttggccattgtgcagcgtaagaaaaaggaaggggaagaagaacaagcaatcaacagacagacagcnttgtataccttaaagcttttatgcaagaattttggtgcagaaaatccagatscttttgtcccagtgctgancactgctgtgaaactgattgctccagagagaaaggaggagaagaatgtcytgggaagcgcgctgctgtgcatagcagaggtgacctccaccctggaggcgctggccatcccccagcttcccaggtatgcggccggagacttggaacaggagctgttaccgcctggcacacattgaaaaataacactttggtgactttttttttttttcctctgagtagacgttgcataaaattggaatttgttaaagaattgatcttgcagggtgtggtggctcacggctgtgatcccaccactttgggaggccaaggcagggagatcgtttgagcccaggagtttgaggctgcagtgagctatgactgcaccactgcactgtagcctgggcaacagagtgagaccctgtctcttaaagaaataataataaaaataattaatcttcaaacagaaagatgcagccttcccgtttatcttcagatgcactactttgcagtgttaatcgtcctccattcttccttccttttgtctagtatagtcaaaaagcagtgggtgaaggttcttggcagaggggcccacccagttaggcaaggccaaagctgccttctgctgccaaatttggaagttagaagctcctggctgtggtagttccttactgtacagccagtatgttccttaacctgttagagctttgctgtctataaaacagagacagtatctacctcataggatttctgtagggcagtgcttgcaaggagttttgcatagtgcctgacacatagtaagtgttcagttaatgaaagacattgttattttttaaattactgttgtgtccntactgttagcactgggagatttcttgtgcttagccacataaaatgtatagacactgctttttaggctatgangcagatagcgatgtaataggcacagtttgctggtttttttcataatgccctctactccattccctagcctctgtttctgcttcaagttcttctaaagctcttactttgtttctagcctgatgccatcgttgctgacaacaatgaagaacaccagcgagctggtctccagcgaggtctacctgctcagtgccttggctgctctgcagaaggttgtggagactctcccgcacttcatcagcccctatctggaaggcattctctcccaggtgagccacgatagccacgacatgctaygcagggtggctggggaaggtaaaagatcacaaatgtagtgattttgttttttctttaagggttagtttccgtttgacagaaaggagtcttatttctgaagagatgtgcttgcttttattaaatgtgtactttttctcttccatcatccttgccacttaatcttgaaattgatatgggggtcactttttagcgagatgcttctcttctttaattgtgcggaatgtattctggcttttttttcttctgtgagatctttggagttgggctggtagagccgccttttattacttgtggaaattgatgggccctgtttctactgtgagaggtwtaatcctaaggcatcttgcaaagcagaatttttgtattgcacgtcagcggtttcctgtcaacacgctaggggccagtggtatttatgattgaagatgctcaagantgttgagacctggctgttccattgtgttgatcatttgccatttacaaggttaggagccttcattaccatggggcaaatgattaaaccgcttcacttacaccacagccagggtttaaaagtagccttctcagagaaaggggcctgtgctctgaggagctttctcagttttttagcaacttgactcttgccgtggtcccttgcattcctgtcctctaagaaaatcatctgtctgggtgctgtgtgtgcgtctgcgtctaccatcggccttcgtccctgatcgcaagttgggcaagaggtgtctgcccagttttatccactgacgtttagggctgactttaaaaggaaytctgtgtgtagttaaaaagtgctaagcattttccaaacactagtacctcatcatgaagcctctctgtaagtgtgtgtttgtcagcgaagatctgcagtggccctgatcactttttttatattcctgtaggtgattcatctggagaaaatcactagtgaaatgggttctgcgtcacaggctaatatccgtctcacatctcttaaaaagacactggctaccacacttgcaccccgagtcctgttgcccgccatcaaaaaaacttacaagcagattgagaagaactggaaggttagatcttattgggtattaagactttggagaagggagaggtggtactgcaatgtgtaaactttgacttaaagaagaagatttagtttttaaaaatacacaccgctgaactctaggaatcatttgaaaatggcacatctytttcctgtgttattggtagaatcacatgggtccgtttatgagcatcttgcaagagcatattggggygatgaagaaggaagagctcacctcccatcagtctcagctaaccgcctttttcctggargccctggacttccgagcccagcactctgaggtaagctcaggttcactcctccaaatcctaaagctgttatccacctattgaagagtccgagaacaatctagccgtgtaacagtggtacttgccaaaataatttacagtcaggtatcagcactctaataaatgggctcttctgttttcagaacgatctggaggaagttggaaaaacggaaaattgtatcattgactgtctagtagccatggttgtcaaactttccgaggtcacattcaggcccctgttcttcaaggtgacgctttcttcctcttcctctcttttgtgctcagatttaagtgacaagatgtcgaagaaactaatactgtcttatcctttcagctgtttgattgggctaaaacagaagatgccccaaaggacaggttgttgacattttacaacttggcagattgcattgctgaaaagctgaaagggctttttactctgtttgccggccacttagtgaagccttttgctgacaccttgraccaggtgaacatctccaaaacaggtgggtggtcgcttcagttcagctgtcacccttgncctgtgtgccttatacaaggtaccagtaagacacaacctagtgcttggaagcaagattttagaggttcttaagtcctaagctaaggagggtgaattttttacttcattgttgtcagacagtgaagtgttgttttagcatsatgagcgaatgttataagtcacctcacttgggagaaagaataaagtaaatggccgttactgtcagttactggaagtaactttaaaacgcaaaaattaagattagtttattctctaatgctaatacgtgacccacttgacagttgagggaatttaacttgccagagtgagtgttagaatcttaactctaaaagaaggaatcattcttcgagagaccatccattgtgttctgccttcgtcctgattatgatttctagatcattttagactcttctgatttagttattttaatagtgatttcaatgtaaacattggagattaaatggttaagttcagtgttttttcatttttactcttcccacrtctacagatgaagcattttttgactctgaaaatgaccctgaaaagtgctgcttgctgttgcagtttattttgaactgtttatacaaaatcttcctttttgatacccagcattttataagtaaagagagagcagragccttgatgatgcctctggtggatcaggtaaccaaacagaatcatctttcgttgctgaggaagccatcactgttcgagcttggcaggttttagatctgctcaaatgacagcttgctaggatttttctttgtaaggttgttttttctggtctttttaatgaaatgttttatttgaaaattgttttttcaaagatataacttcattgtggaatttgagttttgttttgttgttttgagacagggtcttgctctgtcacccaggctggagtgcagtggtgcaatctcggctcgctgcaacctccacctcccggtttcaagcaattcttgtgcctcagcctcccgaatagctgggatcacaggcgcccgcctccacacctggctaatttttgtatttttagtagggatgaggttttgccatgttggccaggctggtctcgaactcctgacctcaagtgatccacccaccttggcctcccaaactgctgggattacaggcgtgagccaccatgcctggccctgagttattttttattttttattttttaaactgctcaaaagacagacatgatataagctgtcatggttaatgtattcatttgttttaactgggcctcactgagaacgygtcagagcatggctgtcctctggagcaaagagctcctctgagatgttctgctggagagaaaggggcgatgataaagggtatgagattccatttgagttctagaaggcaatacatttgccctagagagtattagaataatgcctggtttttgaacctgctaatatcatgaaagatagtaaaatatttgtatgttgganattttttcaaacagaagaaagaaatgagacttgttgttcaaagtctttgtcttactcttcctagctggaaaacaggcttgggggagaagagaaattccaggaacgggtgacaaagcacctgataccatgcatcgcacagttttcngtggccatggcggatgactctctttggaaaccactgaactaccagattctgctaaagacgagagactcctngcctaaggttaggaactgcgtgacaagtactgaaactgcatcttttcactgcatagcctaaacagcctgcaggtggtcacagatgtaggccccctagtaaactggcagggaagaacattgctatttgtcatccagtactagaggtcnggtcttttgtattaggcagaaatttgtgcctaagaaaattttgttttttacttanaggctatttgtaaagaatagcaatgccctatccccaccccaatggtgcgttgggcagaagtactaaaatactttctaaatacttttaaataacaaagatttgaagtaattccttcttttttaagtgcnattgaaatgtcattgtgctccagagagaaatgcattgaatttatccacactatagtcttttgagttagagcaatacattctgttgtttatagatactaggcttatgatcttgttgagtaagtggtggcagtggaaataaaacatgggtaggttgagtggaagtcaaaatttgacacccaagtgttacraatttcaaactgttttagcaatgagtcaccatttctcaaactaatgattgtattagaactttactggctataacagaccaaagcagaattttattaataggatttattagttcaaattctttattaggatatgctaacaatgagactattatgatgaacccccacattttaaaccataggtttttatacaagtagcagtatcaaatttattgtaatattttactttgcacaaatcaaggaaatcctgattgaatctaggtagttacaaatggttttttaataattcactttgtactgtccagatattctttaattaaaatatccaaaattagaagaccagtagggcttttgtttcaaaagctaacaatacccaactactgcttgctttccttattatagacaaggcatgtgaggaacacctagacgtttttaaagccccaaaactaggatattgtgacacagaatgttttttattcagtgctgagatgggagtttatcccaagcgaytgtcctggcccctcatacaaytatagtggtgaccagtcaggggctgtgggtgaggagacctgccagaggtggctggaggcactttattgccagcctggcgggctggcgagcgccaatgaagtaaaatctggtgacacacttgagtttgcatgnggcattttattttattggttttttttaaaggaagagattataaaaagacatttcacattaaagatttgcagtcctgggacacagtttggaaaacactatttataaggttgcacatattacaaacagctcccaaatggtgaaactggtattctaagatgaaagcttaatgaacataatgaagtgaataaacgcntgtgaactaatgtttaaaaagttagagcytgtctcaagtcagtacagctcttaagataataaatacagtaacactactttttatttctttgctcttttatycctttcaggttcgatttgctgctttgattactgtgttagcactggctgaaaaactaaaggagaattatattgtcttgctaccagaatccattccyttcttagcagagttgatggaaggtaattcccaaactattcccaaccattaaacaattaaggaataattcagtaaaattctgtgaaaatgtgcccaatgataatgcagatttkgatataacgtgactagcagttgatccagtcctcatacaggcagctccagtctcaaatacaggcaggctcgagctcctgttttgagttgggtggagggagcaagttgcgaagtgaccacctcctgatcatttgagagtccgtttacagtgtaatcttcacgatcttttcttttgtggtggtttgtgatcatacaagcagattacagtagtgtttttaattaacctcatacatttatatgattgaagttttggtccccagattgtatggaaatgcctagtggcattaaggatgcngtaggatgtccacttttagtagcaaccgatgttcattcactactccatgttaggtgctttacttggattatctcacttaaaaaccacaacattttatctctgttttacaaaggaagaaactagaggcttaaaagatttcagttatttgacaaagatcacaagctagtgrgtgtgacatggggagctgtgacagttctggaacatagagtcttaggcccaggaaataacagtaaatgttattattaagggaggggtggtggagcaagtagatcagtcctttactgattcattgcttatctaagctacaaaagtacattctcctttgtttcttagctcttggaggggggaggtgtgagctactaaaggggtggcatccctaggaagtttgagttttggggattcttattcagcttccagtgcaagcctgtgggcaaggaatgaaggcggaaggagcggtgtggagggaggcggtccgtggcgcctcctgctttgttaatgtgcttcatttcactcttttgattgaatgattgcyggaaagtgcaaggcattaagaattaaactaatgagaaccgaggcaggcrgactgactcagattttaattttgattttttttttttttttttagatgaatgtgaagaagtagaacatcagtgccaaaagactattcagcaactgsaaactgtcctgggagagccactccagagctatttctaagactttctgtggtgtttcatactctactcagagttcacactcatatttcatatttttatttttgggtgttgggtgccatgttacttttggtgccttaatacacctacttggattacttacaaatgttttatcacttckttacaaaatccccacctggcttgtgctgccacataagcctctcctgcctatcgtatagagctgcagaaagagtaaatgatacacggtatttttatacagactgctgtgtttgtttaaacatttattattctcttcctgattgatggtaataatattagacttgttaattttagcacccaaagctgacgcctcatttgcactgtaagccttaactcttctgtacagcagtatcttanatacatggtatccatgttgcagatttcactcaaagttgctctatttcaagaaaatgaagttatttagcaatcaacagaagtacttttgactgtaaagcctacttttcattttgggtaggcgaacttcagccttcgtttctttgttgtgcccataaagagaagtggttctkgaatgctttttttaacccaggagtgtgactgtcacctttatcctttgttcttttgggaaacgggagagatgaaggcaacacgctgcttctaaaacagctcanacctggctgctcacacagagggcccagaaacactgggtggcacgaggaagctcctccaggattcagaatgaacccagttccattggtggttaactaagaactacttgtctaagaaagtaagtatcagtagatttttttcaatgctttgaagtgccctaatctctagtactgggtcatggtgaagttggaaagtgagggttcaaataaaattagatctgccccctttttaaaggcatctaagaacatcccgtagaatgttcgcattgagwttaaaagcctttgaagctaatatagaagtttaatgcagaaatgtggcaagcaaaaggccaacttgcattttagagacagagcttgctagtatagaagtgcatatttctaagaaatgtctcagtaaaattcattaataaatactaatagctttttaaatttttttcctccacgtaaaatgaaaatgaacttaagacttacaaggaatgatgtgagtgggctatttttttcctaaatgcctcacagtctccaacagctcagttaagcactctgatggtctttatggagaaaaataactctgggggattctcgagtcttcttgccttctacagctttccctgtggcaccctccacccccaaccagtgtctttgagcttggtgagactctgcatacattaatatgaaaagctggaaaagaattaagggctagcratttctacactgagtacttttaaaaaaataagattgacaatggtattcttttcaatatatggatagaaataatatctaaaatctgttctgaaaatattcctaaatcctggcagagttctgccccagtctaatgtgataaaatgatcctcactgactgagcttttttccctccccactcccaaacctttgaaatttcctgtaacaagatctgacctgtaaagatcccatatacatggaacttctgccaactcccctcaaataatagaaaaatcacagaaatggaaccatttaacttgctgatacaggtttgattttaatcacgtaaagtggaagagtgctttgatctcagttgctaatgatgatggactaatctttagaagaacggaggccttgattggtgatttcatgggaacaaaacagatttctgcattacctctgcctgctttgtgggtcccttagttggcgtacactttctgatagtgcctgccttatgaatgcctgaagtctaatcctgaccttactttgttgcccataaatatctttcaaattgaatgcatcttgcctcttcctgaaactttctgtaggcgtctgtgtagactctgatttgccctaagttcaaatacacagaaatcagctgccttgggcttggcatcaagttaatttcagcaccatgtatttgttttgctttggttttttgccttaatttctgtgctcagatgtcatgccaattacttggtaaagcttgcagctaatagagccacatgtttattacgataaagaaaatgatgtcagtcaacatcagtcctcagtgatgggatacggtagagcactggttatgacagtgatcactggggaaggagttgtgtcttctgtaagttagtgtcttcgggtgatttaatatctgcataactaatcccagaggaccccttaggagttgatgtaatgcctgtagaaaaagcagtgcgcagcagtagcgcacagaagagtcgaagctcaagagaacagggaacatactggtttgtttcaccaagtatatatcctagctcttcacagttttaccaaaaaaaatctgtgctcaatacatgttagctactgtattatagtaggtactccataaatacttgttgaatggcattcttgaagagtcagccaaagtaggagagagggcagagtggctttaactggctataagtgttgctgcccccagtttccccattcagtgctagacaccaccatacttcatggcaaggactgagaacacccagcaggayctaatggtgcacaagctcattttaacaatataaacaatagaatgacagtgagatgcgtttcagcaaggccagtatcacagaagccattctgtattttggtttttgtagcagctgtgtaggtaggctaccagctccttacttccagtaagtggatgtctccattaatttccagcgtgtcaatactgctgagctctttaaatctgtgtttgtactccaggctgtgtacgccatttactgcaaccttgaattctctaacatcacartaaattatcatctgaaaggaaaggawacatgccattagtggttccccttagtttaaaattttgtgtttgttacatgctaacggtgtcagagtaaaccatttgattatacatagaaaagttccagcctgctgctgctgacttccttctgacttccaagaccctaatctaactaaagtgtccctggtggtggcactgtctgcctcatcccacccagggaagtgactcggacatgtttggagcctcacaccatccccagggcctgcggccctcctttcctcaacacagcccctctccctcggccgcatcctgccccttgctcctggaaagccagagtgctgcccctcctcgccgatgctggggactctcctaaagcaggaaaactcactcctaatatggttgctttagttcaccgagatgctgtttccagctgtagcctggaaccaagggacttggatcctgactgacttttctgcctcaaactctaggaccatgaacaaaccagacaattaatatgaaatttcagcagcttaaggcacttgctagggtttttacagctgcttggtgatcctgatcctgataagctcagcacatcttggcctcagtgtgtttgtccaaagccgtcaaagctgggtatcccgtaagttggaagtggtgcacatactacaaattcattgatccatcggcagtgttcgcccttcacagtcatctatgcccaaaactcaaacaatgaaaaaccaaaaaacctactagccttttacatcacctttacacctacacttcatacttctggtgccacgctgccagtgccaggctgggtttccacccactctgagaaggccactgggaggccctgcactgagctctccctgtgctcctcgcccccatgaaggcttcagaagaaagaggggcagctcagccttgctgctaacccggccccamcccgagaggccagaatgaagcacaaaacctgaatctgcaaagcagcaagttgagggtttccattcttttgataggagcagtggaaaggactgtcaaggaaaatcaggaaggggaggaaatttcagcccaagtcctgcactctgataacagctggccaagatgaagcttctgtggctacagaggattggggaaataggtgtaacctgagattctatccccacaagaatggtgggaatcccagttccaaccaggtagaagggaccccagatatatttaacaaaatctcaagaaaacacaaaacacacagcctgatgctatagctcagaaggaaaaccaagttggcagcagagggagtcaattagttacctgtactgtatcagagcaagtgcaaagccagtgaattacaagcaagtggcaaagaaatgacatgcttccgggtgagcagactactgcaaatgaaaagaaggcacatcctttgcctagaagaaaacagaacaacagaatccctcacaaccatctgatgctgccgaacagctggaacacggatttcatccagaggaagagcccacagatgaaattacaacactgaatgagattgtttttaaaaaactgtagatacaactaaagtgtatttgaaagagcaagaagatttaaaatgaaagtaatggcataatggaaagacctgagataatctcaatgcaagcatatttaaaaggcaagagatggaagcccccggaaaggacctatcagtatagaaaatcgtcagcagtgatcaacacaaggataattactgctcctgaattagaaaattaaatggaaaagacgattgttcaaaagcatataacattcatctattcattccttcagccagccatccctttcactgtctctgcaaaaaaatgcctggaatgtggttcacctaatcctaatggtatggtttgaattatgaagttggaggtattttcatcttagtatttttcagcattatttgaatgtatcattattatccttttttatattaatatagcagatccaaacttggggcccagataggtcaaaaacaagttacatcattggtttcctgtcacccaccacaaggctcaacttccttctagagcactcacctctgtttccctccagtgaaccccaagtcaccctttgcgccttgactcttgccaagctaacaaccctgtgctgcccttcccacctctaaggacttgttcaaatcatgccctaaatctagaaaagccaaccttcagccttccacatccttcccagctttctgaattccaaaccaatatccacaacttcagggaaccttccatgattagcccacatctgtctacactccacataccagggcactgcattagactggaacttagggataaatatgaatgtcacattgctatctattccgcctgatattcatgcttttagtaacgagttttgatgagtcctcaagaacccacatggtccagacaatgtgtcagtttaaaatgctgtagaatgataacctaaaccaatgaccctaagtgactgtgtgaggcagtggcacctgagctggtgattgaggctggccaaacacccggcatccgcatcacaaggagactattctctgctcagcatcccagaaacatatttcgggaaaggtatgtgttacaatattcacctatctggggactcaggactgcatgccttttagttccaagggactgatgtatttttccttgaatacatacaaacaagactaactccttaggagaaaggactgccacctgaaaccgtctaccctgatgggagatgatggccagtgcaagcaagcagttttagggtctccacgtcctcaagtctgcttatatgattaaatgtgtgactccagtcctgagacaagcttcctggttaaattcctatcaatatggggctacacaggaattttaatatgatgacaaatgtcaattccaatgtgcataatttgacactctactggctttgccatttatactgattgcccacgttataaaaaggggcaaattacaatctccaagtaaacaaaaaacatacacaacttccacatactgagttaggacttgatttaaatggaccacttatcccacccctgctcccaggattcttattgctgtcccattttcaaaaactgkaacctcacctcaaagtacatcccaggactaaatgggaaagaggtaatatttctctcttcttctccccaggactcctgaagaaaagaatttcttacaaatgctttaatattcaggcgtgggttcaagtgtagagcaatatcctttgattttcctgctagtaggtcaacattaaagcttttgagaaagraagaaaaaaaaaaaccttaattaaccaagtaggacagagtagtggcaatttcagcaatgttagtgaccagacttgaactatgattctaactctatgaaacacacgtatccacatggacatgggaatgcaggtgaagttgaaattttaaacccagtcagcattccactaattcgttacttgcaaaataaaaatacgaaaaaaaaaaccctttaaaatcagcgttgaggctgagatgtggttggacagaaatggaaggtttaacgctaaactgaatgactacttcaggctgcaggagcctgggatcctctcaagcaggtattctcttttcatcatctacccgtgttccttccttcttgaaagtatgccactttctaggaaatagctctaatttcaagctttcagaaggctggacgtctgtggaaaaagttgttaaagcagaaattttctaaatcacatgacaagaggggccctaaaaaatgttgcctgggctgggcgtggygactcacacctgtaatcccagcactgggagggcgaagtgggcggatcacttgaggtcaggagttccagaccagcctggccaacatggtgaacccctgtctctactaaaaatacaaaaattcaaaaagtagctgggcgtggtggtgcgcctgtaatcccagctactccagaggctgaggtaggagaatggcttgaacacccaggaagcggaggttgtggtgtgctgggattgtgacactgcactccagcctgggtgacacagtgaggctccatctcaaaaaaaaaaaagaaaagatgttgcctgatcttacggggctgctctggagttctacaaggcaaggataggcctcgtggacaaaaatgctactctcttgtctggccagaaaaagccgaggtcagaacacggccttagtcggctctgctgcccactggctgttcacaatctaaccacctcctgcttgaatcatctcactttggaaatgaagattctgacrctagcccttcttccagctcacaggaccgttcacgggtggaaggcggtaacaggcacggaagtatctgcactgtgactggtaccgaaggatactgaccttttggcatttgcattcacttctcctttaacgacgacagttcgtccagggcccatgggggtgttcaaccttgcagcgaatggcagsctctgaaaagaagscacagtcaggaccaagaggcctgcagaaagcgatctccagggaaaactcgtgtccaaagaacactacggaatgtttcagagccatgaccctgtaaatcccaggaggggagagacagtctgccttggtcccagctgggtcccctgcagcagcactgtccctggctcgaagcaaacacacatgattacattttagacgatgaaatgagtgacagggtgggacccgatgccctctgtatgagtgaaacacgccaggaaggccccctgtgcctggggtctgaggcagtactgtgttctgcctgaaggggaagcagccaagcagggaggtgctgaggaaatacacaggaatggctcagaggcaggcctggttgactctcgaatccgtccagggacggcacacaaatgcagagggggctgctttgggcctctattg

SEQ ID NO: 10705 - DNA, 16201 bp, Homo sapiens
ttgaacttctgaaaaactggctttacattttgctggaatggatcattgcagttttttcttggttctagggtgaactccttaagccttggttgtcattttgacttctaagatctggtccttttggggttttagttaaaggcacattattttcagatgtctgttaatggtagcagagcctaatcctaagtgaaatccgaaatccccagctgacaaaagaaagtaccaaataacttgcatgagaagtaggaggcagagcctggattcactccaagatggcctgactgctacaaagtggaaatgcgccattggtcaacacatcatcctgcacttatgactgcattagttattccagttgctttgtcaggttggacaatttttgcacattgacatcagtcccatgtaccaggctcagcaattgtctcagaattactttttttttttcattaggtttggtctctgattttagctaattataaatttctttgctttcagatatattatgggctatattatcaatgtttctaaattttgcagtatgtaaaagattagtggaaaataaattttggggagtagggaaggcacagaatcacaatagttaacctactatagccaccaacttttcatggccctttgcctgtcaactagtgatgagcactgaaactggttcccattggtgcatagcttatagccagctccattctgagctgatgactacataaaaaatatactatcccttcccatactatctgcctatctgaatgtgtaaaacatgcacagttgcaaaactaaaaaatagcaacaataataagataagacatataatgaatagtccacctctcattcctgctcctcaggcaacttgcagagtcagtgtctcctcacagagatgttgtatgcacattttagcatatgtgtatattttcttcctttctaaataacaaaatattatacatatattttgcaacttggcttttaaatttaattcaactgtatacaccagcacttatttagttgtctattgataagtgttgttcccatttatttcagttgcaaataattatttcacatgaatattcttgtacatggcttatttcacacatatataagtgtactaatagggccaggcatggtggctcatacctgtaatgccagcactttgggaggcggaggcaggtggatcacctgaggtcaggagttcgagaccagcctggccagcatgctgaaaccccatctctactaaaaataaaaataataaataaataaataaataaataaataatagccaggcatggtggcacatgactgcaatcccagctgctcagaaggctgagggaggagaatcgcttgaacccaggaggcggaggttgcagtgagccgagatcgcgccattgcattccaggctgggaggcaagagtgatactccttaaaaaaaaaccaaaagagtactaataggataagttcctagaagcagaattgctgagctagaggatatgaacatgaaaaattttaaattatatttttattataatctttgatactacagataaataaatgtaacccatatagaataatataatgtaacactataaaacataatagtagcataatgaacactcatggtttttacatttttataagagccttattgcttacatatgtagttctagatactatattcagttttgcttatgtttagttttctttggaacatttgttttagatattattactttacctttaataaagtgaatatacggtatgtctctcaagtaataaattgctttaacaaacattaagttctcttggttaaacttcagattctgaatatggcaagatgaaataatatcagggcttctaatgccctcttacttcctgttgaaaatctccttcaagtagcttatatcaaaatttagattgggcttcatttttgttaaaaagcagacatatcctgaatttcaagtagttcctctttttctctgtctcactatgtagttttgcttgcttttgagatttatggagagtatcatactttatgtagtcttactcatcttgcttttgttagatatagtgaactccaagattctcttcaaagaatcagtatgtcagcatattcatctctcttattctttgattctccatttgaaagttgagcttccgggttctcttcaccctcttgcctctagtttcagtaaacaactttcctgtcagttctaatcagtggttcatatctgttcccctggtcacctgctccatccggagtcaccctcggccacctgctttgatttgaatcatcctgagtcacctgttctgtaaccacccttcccaccaaactacccaccctgccgctctggctcatacccctgctctctttaaaatagccaatcggaattagcttagattgtgtggtccaaacctagccaataggggaacgacacagcagtaggggctacctgcctcaggaataagaactccttcccctcccttgtccaggtatgctcttgccattactccatccgcgagtcacacccttctatagaagtaaaaattccttgctgagaaaattgaatttatgtctgagtgctatttctttgcggcaccgtggaataagcatttgtttctaacacttttttcactcaataggttctagcacattcatctgtatcgttgtttgcaggtatgatccttctatttatgctgcttatgatattctacaatttggttacctatttccctaatactgataggcatttggttgtcttggtttggtatgtccatgttaaattttggtaggtattttcaaactgttcttctttgagtgtagacttttttcccaatcaccaataaatgagaattcacactagctttctgactgagtttggttggcatttttgaagcaatattctagatctcaaagcagtttagaaactctttcatggacgttattaaagagactagaaagagacatctgttccaagtaggcttcaagtaggcttcaatgggggcagtgacaggcccaagagcatcccgtcagccagggccacattgggacactcgtagataaccgccacaattgttttataacttggcaagatcttcataccatcatctttttacttttgttactggaaagggatcctgatccagcccccaagagagcgttattggatcttgcacaagaaagaattcagggtgaatccatagagtaaactgaaagcaagcgtattaagaaagtaaaggaaaaaaagaatggctactttataggcagagcagccctgagggctgctggttgactatttttatggttatttcttgattatatactaaacaaggggtggcttattcacaagttttccaggaaagaagtgggaaattcctggaactgagggttcctcctctttttagaccatatagagtaacttctggacattgccatggcatctgtaaactgccatggccctggtgggaatattttttagcatgttaatgttttatttagcatataatgagcagtgagaatgaccagaagtcactttcgttgccatcttggttttggtgggttttggctggcttctttactgcttccttttatttgcaaggtctttataacctgtactttgtgctgatctcctctctcatcctgtgacttagaatgcctaacttcctgggaatgcagcctagtagatgtcagccttattttatccagcccctattcaagatggagttgctctggttcaaacacctctgacactttagttggttttctgaatttgtcagaggggtaaatgatgtagtttggatgtttgtactctccagatctcatgttgaaatgtgacccccagtgttggaaatgggcccactgggagatgtttgggttgtggtggcagatccctcatgaatggcctggggctgtcatcattgtaataaatgagttctcactccattagctcacaagagagctggttgtttaaaagagcctggcatttttcccactgtctcttacctccctctcttgccatgtgacacgcctgctctccttcaccttccaccatgagtaaaagcttcttgaggcctcaccagaagcagatgctggtgccatacttcttgtatagttggaggaactatgaatcaattaaactttttttccttataaattacccagcctcaagtattcctttatagtatgcaaaagagactaaaacagcaaatgaaaagagatctgtctctgaaagaacttattgtgacatagagagagacagaaaaaagtcagattgacactgggtaagaagcaaggaggtcaggtcccaagatgaagtcctgcctgtggtcagcaaaggggcaccaaggtgtctgggacagtcctggccctggctttgggcagggagggaatttcccataggaagggaagagtaaagagagagagagaggtcagagtccaggtttgttgttcatatgttttcttgaaagggcactatttcccagaatccaggtcatctctgggtagggaatcccctgaattagttttttctgagagtatattagatttgccctcacagtaaccccatgctggaaatacccaactccagtagcacttttctccctgccttttcccactgaaataacataataatataggaagaatacaaggactatagaaatacagattagtgtttgaacccttgcttaccagctactactaatatgattgtggatgaggtagcttcttacttattaacggggatactaatagaggtggttccttacaatgattccatttatgattttttatttaatagtgataccaaagcaatacatactcagtagaaacctacttcaagttcccataaaatcatctgcttttcactttcagtacagtatttaataacttaaatgagatatttcacacttcagtagtaaatacactttttgttagataattttgtccaactgtatgctaatgtaagtgttctgagcatgtttaaggcaggttaggttaagctatgatgtttggtgggttaggtgtattaaatgcatttctgattttggatattttcagtgtacaatgggtttacagggatgtaaccccatcataagtgaaggagcacctgtacttacttcattaaaatgctgaaacagtaaataaggtaacatttaataatatgttgtgcagttcttgaaatttaagtactcaccaaatattacttttcctttttttgttatttacttacttttcattcatttattaattcatttgtgcatttagtaaacatttataaattatttcctgtgcctgacagcatgctggaacagtgctaaagatacaagttaattaagacacaatcacgacccccaagattcctactcttttctaaagattacagacaagcagacgatgctattgttgaagaaacatgctctgagaggcatttgaaggaagtgtagaggatagaagatggacacataacccaggatggggaggaaaagagttagggaaggctttttgacgaagatactgtttacaccgtgtgttcttataaattcatggtggtggggatagagttggaggaaaaggcatgctcagtggcgtggagatggcagagagattggggtgttcaaggatatgccgggaattcaaggaacgagaattcccatagacacagacacagctagacatagagatctgcagcttaggtttgggctgtgggtatagatccaggtggcttcaacagacaaagatctttcctgagaaaagggaaaagttttcaacacagaaagaccatcccatgtttggaatgaggtttgcaaatagattgcttgaggagagaagtatgtgatcagaaagcattctttgtctattaactcctgcccagcaaaagtgaaagaaaattcatgggagcatgcaagaacaaagagcacagcaaagctggacaaacacagcaatccaggcaggggatttccaactcaactctggtatataagctgcatgcaaagtcctttttctgtctctggtttctggccccttgtctgcagagatggctcccaatgcttcctgcctctgtgtaagttgggatttgataaaggggatggggaaaggaaaagcactttcaagagttggggagagatcttagaaacgggggctgggcagtactcagggctctggggggctgggcaggcatccttcaggagaagaggctggcattgacatttgcagaatgggaagagggattgtctgaagagaagctggttatctggcttctgtgttcttttttaaataaaacattggactagctactcttagggataaatggtagaagaaaaagtgggggtgagctttgtgttccacagggctggtgagatttgaaattatggtaacattttttaaggttcttaaacttaatcttccctctcctctcaaaggagagcttcacaaaactcattcatctgaagttgttaatgatctaacacattacattatataagaaaatatgcactatggagagaacctggaattaaggcaatgcttaacacagatcttccagtgaagaaatgtctgcaatatctagattgggaraatatttctgaatggagtatgagggaggtcttctcaggctttcaagtggccattaggggtgagttttcccatcttttaggattttccagctattgaagtaagacttagatatagtccctaccttctgtgagtgaggccctagtcttatcaaaggagatcacattctatattagtgttaccagggggtctttgctcccagagctctcaagatggtggtgggctgcttccaaaatggccgcaggccgcttccaagatggtggcaagcctcgtgttctctgacctggggttcttggcctcatggattccaaggaatggaatcttgggtcatgtggtggttgttacagctctattagaagccatgggtcacggaagagaacygtggacccagtgactagtgttcagctcgattaggaagaacctgggcacttagccgtgcagaacaatggtacgcctttagcccaatcaggagcggcaatgggcgcctcactggttcagaagcacagcggacaccctgccagatccgagggatggaagtcagccgcgggtctgcgacggtggcaaayggcagtggtggatggcaagcraaagctcacctcgagccgtaagaaacatagaccagaagagtgcagttgcaagatttagtagagtgaagacagagctcccatacaaagggaggggacccaaaragggtagcgttgctggctcgaatgcctgtgtttatatccygatcattgtccctcccgctgtgatctcaggcaatagatgattggctatatctttacctcctgtttttgcctaattagcattttagtgagctctctttactacctgattggtcaggtgtgagctaagttgcaagccccgtgtttaaaggtggatgcagtcacctccccagctaggcttagggattcttagtcggcctaggaaatccagctagtcctgtctctcattagatagaaataaaaacacaagaaatataaattaacaagaaacactgaacatagtgtcacggtagtatgtgagttattattataaagcagtgggatatttgaaaagaaactaacagttcagtgattatgtgtcctacccaggatttccttctgaagtattgacagagggtatcctatggctatgagtatcttcatgaggctgtcatattttggaaattctctttgagagttgtttttagagtctgatgtacatcttttgaagcctcgtatttacttgttgacatttgacaaactttatctggataggagaggcaggtaaataaggtggaaaatcactaattacattttgagatggataaaggtatgttttttacatccattgaaatgcacagaaaaacraaatgtaaagattgtcaactaaaaaaaatcacacaattcataaatttagaaggggagtttatttcttatgaaaggttatagtctgcaaggtagccattctgacaggctgggaagttttgcttctgattgaaaaccaaaagcaagcactttgcaggaggaaaggtgacacaggaatttatgctgaaggggtttgctaagtatacatatccaataggttatagcagaggcaatgaatattcatggagggggtcctaatgcatgcatattgaataagcttgcatgttacataccacccatggtcactctgaagtggagacttaacatttaattgcattacagttaggccttatacatgaaaaggtgaagcagggacacaaaggcattcaaatgcacagcttctgtaaactagccagaaccagtccatggtcagtggtctcttatcaggagaaaattactgaaatcagtcttttgtccaattaaaactgtagttatggcttgtggaacacggggtcagttagcctgtgttccccaacacagggtgagctgtaattgttttaatattgttcctgtcaaggccagtgcttgtttagctgctagagaaaaaagaaaaaactttgtggcagaacatagtttattctttaagtgtaagggatgcatgacttaacttttgcctgttatagccctcggtcttgtttataatttgctatcttattgccacaaagaatccattctctcagtcttataatctctaactttgctggtcagttgtgtctaaactgcaaaagggagaagatacaatgaggcatatccaacctcctgttccatcatgactgaatgttttatttatttatatttttgagacagagtctcactctgttgccctggctggagtgcagtagtgccatctccactcactgcaacctctgcctcctggattcaaatgattctcctgcctcagcctcctgagtagctgggattacagggacttgccaccackmctggctaatttttgtatttttagtagagacagagtttcaccaagttcaccaggctggtctcgaactcccagcatcaattgatcagcctgcctcagcttcccaaagttctgggattacaggtgtaagccaccacccttggcccaatgactaagtttttaaagtttctctagggtccccctgagcaaaagagcgtccgttcagttggttgggggctcaggattttattttccattctcaagatcgaaaaaaaggtgtgattataaaggaatgggacaaattatcttatttgtgttgtaacttggtaattccaaaaaagaagttccaagaaagagagggacactggctactgaataggagctagaggaccagatagatagtggaagagggggagccattgtggtggggagtagaagtgtaaaggaggmaggcatcctaggtaactgtcttgtggctttcacttcccaggtgcatgtccgttccgaggaatgggatttaatgacctttgatgccaacccatatgacagcgtgaaaaaaatcaaagaacatgtccggtctaagaccaaggttcctgtgcaggaccaggttctttygctgggctccaagatcttaaagccacggagaagcctctcatcttayggcaytgacaaagagaagaccatccaccttaccctgaaagtrgtgaagcccagtgatgaggagctgcccttgtttcttgtggagycaggtgatgaggsaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatsttattktattggagggtgaccaccctgggsatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaatagagcattcaaagccagcttggaatttaattctgtcttgataccttgttatttatgcaaaaactcctatctcctttcctttatgacaagagagtaagttttaggttgggatccatgttctactgatttctgtatttctgtctttgttaagtccagtgctttatttatatcactcaataatggttgaaccaaattgaatttctacttatagagcatagtgaaatgatattttataaaatgaattagttgctctgacatgatcacaatcaaattactaaacattttagaaactaaattaaactccttcccccctcttctcctttaaagctatttgtatgaaatgaagtctggcaccatgcccccttttattctctatgtctcacacccaactaaaatagttattatttctggggatgatggtgggcaaggaaaggtattttccacagggatctagcaattctgtttaactagtggggattcctaggggtagatggacattgggagcgaacaaactttctaaagctgggggactgtggaccaccctctctcctacctgccttagggtctagcaggtcttctccaggatgagggcgccagtctgggtgagggtgggtgaggagctggcttctgggttgacctcaatattctgctcaggttctgctgattgagcattttcctctcttctttttttcatgaggagatccctgttcctgtcttgagaacttgagtcccttcctccatcttcctccctccatttactcctctctctgactctctctcttgctctctctctcatgactcactactgatcacctgtgagtttttttcacgggctgagacgtgcccgccttcttccacactcatcctagttccttgtttctttaaaacttgctcaagaaccaactcctgcaggggggtttccagtcttaaccccactcagcaaaattcaccaccatttatgggctttcctcatcacatttatgggtgaaatgccccggggagggcactggtcatctggccaggtctgcactaagttggactgatttctgagaatagagtccatggtcgctttttctggatgtaccctctcctgcagggtagggactatgattttcttgtcaacttgagacttctgattgcagagaccaagaggtcttccatggtcttccatcagatagggaggaagctaaaggcgagcatcacgtccatcattttccctgcgcgtggagttgtgaggggtaggttttccttccctaaacctgagtatatagaggatttagggattttccctcaagaactaaacatttcctcacgggaggaaaacatatcccccattggactccttaggacaaatcttgcagattatcatacaaaaatgaacagcctgaagtctaaactgactcactaaggggtatttccatccttgggttctggcttaatactttctcccctccccaactactcactgcccagcctggcctctccccagactccgcagcagcctcctcgctgcccccttcactttcttattcctgagggtgtagatgagcgggttgagagcaggtgwgaccacggtgtagaagagcgatacgaacttgcyccgtgcctggttgtagcgctgcgcgggctgcaggtaggtgtagatggccgagccgtagaacaggcagacggctgtcaggtgggacccacacgtgcccaccgccctcctccggcctccgctgaaccgcatrcaacagacagctygggccacggcaccgtaggaggccaggatgacggcaaacggcagcagcaggatgaccacgcgggcggcgaacatctggttctcggtagtgtctccgtcgcctccgcrggccagcttgagcaacgccggcagctcacagatgaagtggyccagcaggcggggcgcgcacagcggccgctcagccaggagcgcggtttgcgcaaccgagttggtgaggccrcttagccaggaggcgctggccagcgtgcgacataggcgcggggagacgagccccgcatagcgcagcgggcggcacactgcggccgcgcggtccagagccatcaccgccaggaggacgcattcggcsgaacccagagccagcgatgcgcacagctgsgccgtgcagtggctgcgcggcagccagagcgctggtccgcgcaggttggccagcagcggcggcaccacgctagkagtgaagcccgcgtctaccaaggccaggtggcagaggaagtagtacatgggcgtgtgcaggcgcgggtcgcgcaccgccagcagcaccarcgccgagttgcccgtcaaggtcaggaggtagcacaggaggacaagggcgaagaggaccggctgcagggaaggccagtcggagaaacccagcaggagaaagcgctcctctgcgctgtagttggcctaaaggaggaaaactcccagaatgtttggaaggtcgaaataaaaaagggtgactaccccttataagcaaagggaaaaccttggagtgtggggctgggctgggagaaggaatggaatcatatacaaggtcagtttgtggattgtaatcccatttacagatgagattacttaaaaataaactccctaagaataagagcaacactccaagcttggcctggccaacactcggtaggcagaatgatcacctccgttgtttcaggtactctgtgtttatttatgcaacagttcatgtaaaatggagacgaggccagaagaatccttgagcagacagagccagttgggcctcctaagtgaccttaaccttgcttgatttgcaagcatgtctgaaactttatttgtggtatttcttgtaaatgcctatgttaaagaaacacagaacttaagctcaaccaatcagaagcagccaacaaaaacgtaattagtaactaggacttcctcatgggatagaccaaataaggcaactgtataactgtgtaactgtataactgtaaccaatgaaatattatctttgcttttatctatttgtcctaaaaagcctcctcctcatgttctctctggggagctccctagccacttctggcttggagctgcccaattcatggatcactgctcaaataaactcttaaatattttattgggccttagtttactttctaacacaacccattatacggctgattactgatttttaatttgttgtgaatagagactactcccaacgtccatgcccctcccactgaggggagatcagcacacgtatactagcctttaaatcaggaataagttgggtagaaaaaaagaacactttctggtagactagaatatcaggacatcttggttttacctacatagctccctttagccagttatatgatatggggaaatcttcatttccctctgtctcaattttttcatatgtaaatcaaggagtttgaactagatgtcatctaagtttcctgtcccaaatccttggctttactatcaaatattaatccaaaaataaaataaaaagagaaccccagggaacaaaaggaacctcattctccaagggtcttgttgaaccaagtgtcttaatggtacagaaacatatgggttatgtaatggatgaaagtttacgtgatggacagaaatctttctgctgcatgactcctgacataaattattatatggataacttatttttcacatcatattcactgctgtaaattacaaaatcacaataacctaatttttcatttttcagagggaaaaaacactgctccctaccaaaacatcctgtttgattttatgtttcactcattttatcctcactgggcagaataagcattaatgtcataattaagaaccagggctcagcagccagactgcctgggtttgagtcctggctctgccattttctagctggaaaaccttgggtatgttacttagcctctctctgcctcagtttcctcatatgaaaatagaaatatgttaagtgggctaaatatgaaaagctgttagaacaaggcctggcacatagcagttgttaactgtcatcctttaataaatgctaactatcgtcatatctgtttcccaaattaagaaacaggtttttaaggggttcttatgctaggcagtgatacaactgctatgaacatttacagctcttttcatttattaactctaatcttaactcacttgaatattaggcaatagccttattttatagagtatgttaggagagtaactgaagttaaattacttgcccaaggccacattatttgtaaatgcttaataggttttccacttatatttgactaacttcgaggtccttcctgtttgatcaaccaggatccactgtgctagagactgtggagtatgaaaggacatgcaaagtcttacctatatttatagatcattttataatttggggtcatatcagagatgaataaagtaggagaggtgacattcaggcttacagaccaatggtggctagagatgttgagttacaaaaggtcaaattctttaatgcggtgattacacggacacataactgttcagcctggcaagctctaaaccattcctcttcaaatatgccacaccatgaaaacaggcacacaataataaaactgcacagataacattcttgttacatgtatgcacaaattccccaaaacataggcatgtgtgcacctgtacacataaacccatcatctccctcacacatctagaagacaaatctgttgtgaaatatataatataatgtgtcatcaaacttcacttggtatttcagaatgtggctctcggcacaagaccattttgttgtagggcactgtaatacccaacttaccttcatgactaatctttggcactaatgtttacaccttgagtttccagatgataggttggtctcttgctcctgctctggattctctggatttgaaatggagttgggagtatttaataaaagatgcaattgcatagctgtgttgatttctggaatggrtgcctgrgatcagagccaggtatttcaggaagaagaygaggggtgggtgtcattgtgcttgtaaatagaggaataaaaagaacgggtaagaaagaacctacatttgtgaaatttcaggatctaggcagaggtggtgatgtctgttcctggagaaccttgtaatggggtacagaccagacaaggacctgggccttgtgctggtagcaaatcagcattagctggtggtggtagcaaatatccctcctggatctaaaggacacagttagagagaaggaggaagcatgctgatgagtgctctcactagagaaaaaacaggggactcaacgttccctgttatttagaagagaggatggagctctggggaatagatgtcccactcctatcattagtactttgcatgaaggtgtccggagaggagtccccaagagtggggaagaggaaattctggagggaaagtccctttagggtagtgtgcctctggcagtgtatgaaggccaaaggcagcgtaattccctctcattaacatttctactattcaattggaactggtttagaatttcattctctgatggagtgaccttaagctaattgtttaacttcagtgactctcaatgtcatcatctgtaaaacaaggaaaataaccctttctgtcaggaattttgtagatttgttgaagtcattattagttttgaatgtagctttgactgttatgtcatcagctttgctccaaagtccacctccccacttgtggctctcatcattctctttccctttgctcctccttcgtccttgaagatttttgtccctgatcccctctcactctctccagtactgtgatgattcttggtgaattcagtatcctcatagattatctttctatactttcctctcagtttcttcctcagtgagaggtccgcaaattcatcgtggcccctcacgccccttgtatcttcagttctctatcaagcttagactgtctcgtcaatcactattactcctttgcatacatcaatgttcctgcccttttcacttgttacactctttcagctaaattgctttcctatttaaatccaactatagtcctactctctccctatatttgttcagctgactgtggccgaaggaaagccaatagccacactgagaggtt

SEQ ID NO: 10706 - DNA, 48234 bp, Homo sapiens
  misc_feature (1)...(48234): n = A,T,C or G, or insertion/deletion polymorphism (see Tables 1-2)
gcccatgggaagcagggtgtctgcaccaatgctgctgaggatgtcagagcacaggagcagggccttgggagattatctgggagcatggttcaaatcttccttcctgaggtttctgggcccttggaaatcaaattccctcaggattggttgctggacaattccactaacacttacaatgggacaaggggaaccaggagacccctcaagtggatcactgggttccacacacattcctcctgccctcattgtgacagcagcccaacctcctcctggagattaggatctattacctgtgcctggagaggaggggactcctcacttgctggtctctgggcacatactgtccaaatctctctgggggcaatagtaatgtgttcttcagtaggctctcatttgtcctgatttaagagtaccttcctttagaatccaggaccttctaccctgcagagcacaggtttgggagatgagaagtgcaaaatcccacagcaggtgaatctaaggaatgagacatggagccatacccactttcactccttagtttctggacccacatgttcttcctactgagaacacggcactgtagagatgtctctgatttaataaatgcaccatgtcctgaaagacagcacccacccctcagagtgcttcctccaggctggcactgagttgtgcctgtagaagacctgtccagcattcttagtggctggcagaccctgggtggtgcagatggtgatagaaccagtggatcccatggccatgaaaatgctgcacctgcttccctgtcaagtgggttccaccaggaagacagtgtgctaagagcaatgccatgcctgtgaatcaggaatgtcaacagtccctggagagtggtgctgactgagggtctgagagcaggacaggaaaacccactcatggaatggtgcctaaccctgtaaagatgaacctctggcccttccagaatggaagtggctcaactaatcacttagcagcgagtgttgctttagtcacctaaagaaatatagccccactgaggcacatcattggcctcaaatgctaatgagttggacattcagaggtggcagcagctggatctgtcttggtaggtggtagtcagtgcttctggacccatatttagcctcattcctgccactgtgcttgctccattcatgaactcatcctgccaggcctgggctgcccgatggtgagggctggctaacttcaatttgtctgcttggttgtttagtgccacttcaggtttggatgttttctggaggtgtcaacataggattcatgctcaatccagatggaccatttctatctcatgatggatgctttggggtctgtccgatctatgactttctgagttacagaagccaattcatatgggcatttgaaatcacatggttgtttgatgtcccatggcaaggattctatcttatcaaggccagtaacataccaaaagttgcttctaacaggggcatatgtctctgctgtggatgacatggccttactccagaatcccaggccctccgtgtgactcccccactggtgcttgtttcagctccatcctgcatctttccccacgactgacacctctaggtgggtctgagggatggcgctgcctcatggcctgaatctgccagtgtcctttcctcagcaggcctaattgaagcaagtcccctcctatttctcctagagtgtaggtcaaagcaatagatgtgggatgtggtgttgtcagaattcaaagaggctcaccaggcagtgtgcttccttccttgtagtgaggatgcaagatgcaacactttgtcttttactgtggaggagaaactcctggatgtcctcaaccactggatgaataaaacttcaccacagtggccactcctgaatctctgtgtggtttatcttccatctgctggagagcacgtgttttgccaaggccttcagcatacttcccatctcctactcatccatcctagtcaacatgatgttgttgatgaaataagctgatttaccattctataggatgccaggttcttcagatctcttaagactatactatagagggcaggtcagttacaataaccctgaggccaattatcaataaatgtgttgtggatcccacatgaatcacttcatgtatagtttttctcattggaatggaaaggaatgcactcaccaaatccacagctgcacactctgtgcctgaggccttatcaatctgctctacccgtgatatccagccagcatggcagctgcaattatgactcctactttttcaagtctgaagtaatctcattcattctttaggccccatcaggcttccttggggacagattgctggattacgtgaagataacaggcaactccaacagcacccctcatccttcagctctctaatggtggtgctacacctaaaatacctacagtacctttcataagactcaccctgggactcaatatcattttttatttggccaagatgaagtcagttgcagaggtttccctttggctttcagaaaatgacagcccttattccagagacttgggacccaatgtgggggttactccagctgccagggcatcaatgccaattacacacttggagaatggggagataaacagggctgggtctgtggacccagtagtccctttgtgatgtgtccagatttattcccagcttctgtaagccccactgtggtagggacataatggtgctgtaggcctgtaggcatcaatattagctcacacccaatgtcaacactcccccaaattctgcctgtttccctttcctagtgtacagtcccctgagtaaatgactgtaggctcctttgcagaaagacagagggaattgttccagcatatacttgccatgaggttccagggtccttcctcctgggatagggactccttctctgtaactgggatctgaatctgaaacttggttgacatttaggaattgagaatgggatcatgactttgtattgagttaaacaccctcagccccctgctcatcaattcttgctttctcatcatagatgtcaagcagtgcccttgttggctgctgcctgttctgacaccaccgtctattaaccttccccacaactccctgcagatcaagctgcctcagctgctcctctgagattgtcaagttaaccgtgccctctggcttttgcaggccactgtcaccatttagttctctgccttttcaaggccacactttcctcaggaatatcaatgagcccaactataggacctccttcctgccatcacacccagcctgcagaggacaccaccccgacgcttcttagccatgcaagtccctctcaccagcacattcctgaggctctggtggaagttgtgccctatgggtcctctgtggagcatggccctagtgggcattctggttcacatgatgtctccatcccacacacccacttccctcagcctcattgtccatcctctacatgttccaggacaactaagtcatgtctaacttactgagagttggacatcattttttccagtctacatgggtccaccccagcagtgggtttgccccatgccctgaggtccttgataaacccataccctgagaaagtgctcccaagccaaaggtgttttttttaatttatccagcttgattctggccctttgatcaaacacccttaaattccaatcccagaactgctcctcaggctcctacggggacataacggctgttactgcaaagctcctgagtggaattcccactgcatcataggggtgaggtttctgcagcaacttccagtgtaggaagtgggaaccattactagagaagggcgagcctcctctgcatgcccagagagttctaaagggcacccataggataaccctgttccagtttgcagaatcttaggtttccgcaccaaggccttgactttcccacagcaggtctgcctctgatgagtgtccaaacatctctgtagtactgtgactttcaaaatgatgtcatcagctatcattccactctgcaaggggagaggggcaggtgcccctcctcggtctgtctccaccaggccctgtgagggtgggtggaggctctctccaagccctcgtttggccccaccccagcatgtctccaggttcctctcagccctggttccttttggccctgcagtcacaatgggcaacactgtgacgcaccctgtcctgtgtcacagtgtcatacactcaggctcacattgcccctaggccacttgccagccaagggacatggccacattttgtgtcttctgcacctcagccttgctttcaagtgcaggtgatgatggcacccacgcagaacaaatgttatttgctatcttcgtcgagtttagtcatccaattttccaaccctcactgggcaaggaagagtgtggtttccaccagaaggcaggatgtcagcagtcacaggggcaaccaacagggaaagccaccggaaaatagaccccacaggaagcacaggtgtccagtggagatgggaaccctgcagatttgaccgtctttaagcagattagagagattaccattactaacaacttagccataaaagtttattagctattttcaaaaagcataaaattatgtaatataatttttttttaatttccatcaatacaaaactaatctgggcactgcaacttctggtgggcaactgggataggcggcatcatcaggaaggcgagccctgccgtgccccatgtgccagtgccccagatggcggcagcctccccagaagcaccttgtatctcccctgcacagggccagggtcccagcttcccatacaccttctcctgctttttcttttctgtcctttcctttttcaataaaccacctgcaaaaaggaaaaaccattctgaggacaagaaacatgtcaatgggaaatacacagttgccagagggtaaaaggccctgttcattctcattgaaaagctcaggtatttctgttaaagtctctccttttactttaggatgctgactcctgcgtccatctcaacctgggcatcgtgccaccaccttcaagaagagaaaaactaagtagtgctttgcaaaggggcagcagcatttctcatttctgaccatgtcaggcacacggccatgcagatgagcaggtgggggacacaggtgagtctccagacctgctctcctcccacagtacattcttgagtctttttaaacagttgtgaaaatgccacagatgcaagcacctgtgggccactcccatggggacygttgcacaaggcagtgccactcattctcagaacctcctaccatgggctatgcttagtgacccgaggccaagccaaggaagacgccagccacagggtgccatcctcaggggcatgctgccagcaggggcaaagttatccctagcaacaagatacagaaagaaagaaaaaaggaaggaaatgtagccaatgggccggttcaggttcttgactttgccacacaaaagaatttgagagcaagtccaaagtaaaagtcagcaagagaatttattgcaaagtgaaagtacactctgacagctgatcagagcagctgctcaaaagagagacagtaccctcccctcacgggagtcttacatgattattcatgaataggtgggaaggggtattgttttaagcatgttctgtggtctcttgaacgtgcatgcactgtggttgtacatatcagcacacacatcttacgtctcattagcatcttaacttccctctcagagttgtgtttgctactattgtaatgagcataggtcagcccaaggacrctattcatgggtttctgggcttcctcagatgtggggatgcctcccttggctcttctacctctttgctgcaggatgttctaaccacaagcccaggatatggtttgcgcactgtcgaacagcttgttctctccatcaacctgacaagtctcttgtttcctttcaagtgaggctgtgaacaccctatctcactgacctcagaaggacagtacagcagtagccaccatgaccaaaaagatgattccagaagtgcaggacaactccctacccagaggctgtggctgtgcagtaacacaccaagaggggagtccagctggctctcagggtgctcactaccctcatctgggggcctggaggacgtcaattcctgagaacgccacgttctagtgagtagaatgaactragagatacacagcaaagctccacatacttttccttttctttgtgcccgcagtgttcttcatcagtgtgctctcgcttttcagctactactgttggctggctggaaaaaatagaacaatagtaaaaattagagaccagtctttggtgatgaagagaaatattggctacttccagtattttctagctttggttatggttgcagttttccagctcaccttgtggggatgaattcagaaaaaagttacaaattgaaatgaacatgccagaagtattggctcaaatcaacgttgtcctattaagccacttagtgaatcaaaagaccgcttgttggactgttaatctcggtggccagagaaaggagctgaagaaggtgttgccagatcaggaacaaataattacagcggcaatagaaaatggaagaccacttgttcataaccatttgaataagggcaaggtgtatggaaacacattatgaactgatattttcagttttgtttgcaagaaaatgattaataaggtgaaatarttgaagtatcacggaagatacattaaaaaaaaaaaaagcctttgtacagtttgctggagccacagatgtcctactccagagcagaacaatgcctgaatcttcagggtccatttstgccgcattcactagcaaccacaaatgtgacttaattttactttggaaataatgcttaccyattgtgagatgctgtaatatgaaccatcattacatgttaacatggcacatggaattttgagtgtctaagttacatttttagagttgtttcttagtagccatgtgagtttccactccaaaaacacaagctaaaaacttgttttgagtgaaggacatctagggcaaatggtggctgaaagtgaatgagatcccaattactctttcttgtactgtataaggaaaagaaaataagtgcttttcttgttgggtgtttgctaatttataattaccgttttatgcttttcaacatttttaataaagttttttattgttggctataaacgttttaaaaggattctcttcctctagaatcactctaagtaccaaaatctgtattattctggattcawcagagaaacagaaccaataaggkgtgtgtgtgtgtgtgtgtgtgtgtgtgtgtgtgtgtrtgtgtgtgttttattcgtgttatgaaactgactcatgcaattattacggtggcaagtgtgaaatctgtaggatacgccagcaggctgaaaatgcagacagaagttgatatggtagtcttaagacagaatttcttcttttctgggaaactgtagtttctgctcttaaagccttctactgattggatgaggtccatctacattattgagggtaatttccttttcataaagtcaactgattgtaaatgttaaccacatgtactaaatatcttcacagcaacatctagattaggttttgattaaatgactgggtactatgtcctagccaagtttattggcattgactctgggtcaaggcaccgtgtctccctcccatcgagttttccatcatctacacgagacctagatgactactttgatatctactgmaggccacagccttgtcaaagccagccccagctgaaatgcactcacctgcattcccacacaattttacatacaattcgggggaggttatgggayctatgaagaccaagggtctgtggtcctgtgacactttctctcagagggtgaagaaggagttccttggggcagcaactccccaggggtctcctgcctgcctctcctcccctctcagccccaatcctctttcctgctgttgatcatcatgcagtttttaaatccctactccctgccccaccaaggttgggctctaggacctgcctattgggaacctgcggytgggagaaagtatgaagtgacccacctgaatttagaggagggaagtgaggaatttggagacatctaaaaacattttgtccctgtggtttgacttcaaattattatctatttttattggagatttgtttgaaatyataaccggtatctcatgattattcagcatatgccatgccccctggtaaccctggttcttatttttttaaacttgtacaaatattttaagcaaacacaraagtagacagaagagtaaagtraccttcactgtacccttcactcagtaacacccactcttgatttatctacatcctcaaccatagcccaacaccaggttattttcaactaaatcctagacaatatattatttcacatgttagcaattttcttttgaaggtgccaatgttcagcttctttaaaaagagaaacagagaygggcaggagaaggattgaactgacaaaatatattttcaaatgcaattaaggcagaggacaatgcaggaacycttgagtcccgttttaactgaatgctcagcacctcttagattctcartaaaagaaagcagcagcccagagccaaggagcccagggaggcacatcatggtttgattttgtgrctgttttcagggcagtatctgtcatctctgaatggttacactggacatttctattcccacccttgcaatgggactccccagctcagagaaagggaaattatcacccattctcatttatacctttaatgccttcatccattcccttggtcctgactttccggttggaggagggggaggaaaagcagaggcacgaaattgaaatgtcttctctgccatctgctggggatatgcttgaataacaggaaaggcctacataaaagatatgcagcsaggaatagaggttccttttcctgtttccttcaggaaatttcccctagggcagacagagcaagagygatggacagaggaatgggagcaggacccagggggaggtctggtcatatgtgtgcctttctgcctccccgtctgtcattgtccttcctcaccaggcctgcagaccacctgcgatgacctggcctcttgccatccctagctgggccaaaattccatcacagggacacacaggatggcagaagcgcaaggcctcatacccgctggggcagcctcctggagatggcctcagaagggcttctrggarcttctttaaaacctgcactrcaggcaccaatttcyccagttatcccatccttaartgaaaaatcaaccacagagatgatttattgtaatagccttatttcagtacaagcagacgaaaagtgtttctcttcactggcccgttagttacaatggggaggggtcactgagtgagcagcgggtggtggcagtgacgaccacaccctctcactgcggcccaacacttttgagacaagttcccacctctccattagacgtgtcttctccacatgcagaaaatgtggtctcgtagcttcccttctcagtgctggattgctgrcatttcttttctttatcagagacatgaatatcttttttctttatggatttctaagacttcagggtttttcagggagaagttgcttaaggaggctcctgcgtggaycgagtccttcctgagggtttgctggatgcccccggacactgtgcrgctgtgtcctccggggtccctaaagctggcacrttctgctgtgtacccagaggtggggacagatgctgccagctccaccttacagctgcyacatgaaatttgaggtcagagaattctcttgtctttaagggcacccacatttgccttcttcgatgtttcaggaaatcataactgaatttagaaaggttcccttttcagtttactctctggaaggaaatatactgaaaattcagtttattttcaggtattgaatagaattgaaaagtcaaactgtcagtttgcttgcagtgcacacagagaaattgagtgttccaagccattgggacatttctagaaatccatccttttccagtaggacatgagtaaagtcagtgaggagcgaacctgcagtccacgggcacctccaggattgtggsaggagacgcacatgtctttctgatgtgtggagtcctgaggacagaggctgagaccctgcatttcccaaagtacttgttttctaagcaagtgtttctgctacttgaaataaacttgggggtgtggaagccaccttgcaaccaaccaaacacaggtgagaaaatgaatatgaagtgttctgggagaaagcagaaaascccattgccatcatgtttccttatttttacaattctcttaaacaacgtgcctaaggttataacccctcccgtttgtaacaacttctaaattgaaagggcattagtaagtgtggatacagaataaatgctgaaaatcagtgctttattcaaagtagcgatagagtctcccaggtrtcaatagagaggtgggccagggacttttcccagtgaccagaaacaagagcctcagggagatgaggatgtctcacagccagggacgggacagtgaagggcatcccaggacgggagtgcatcccaggggtctgttcctgtttagactccaatgctcagcacccagtgcggcacgtggcaagacctcagcaaatatgtcagttggctggatgaaggagggcaggtgtgagccaaaaaaagatttttgctggggcataaatgtaaaagtgttgatgaacctaccttgcaaggagatagaaaggtggatgggtggatgggtggatgggtagatggatggatggatggatggatagatggatggatggatggatggatattcattttctctatgtgtgtgtgtacgtgtgtatctatctctgtctgtctctctgctctttctctccatttgccattgttccttcacaatcatgatttcactaactttttttttttttctttgagacagagtctcactctgtcgcccaggctggagtgcaatgtcacaatctctgctcactgtagcctccacctcccgggttcaagcgattatcctgcctcagcctcctgagtagctgggattataggcacatgccaccacgcccggctaaattttgtatttttattttgattttttttgtagagatggggtttcaccatgttggccaggctggtctcaaactcctgaccttgtgattcgcccacctcagccttccaaagtgcatcagtaacatcttttacctggtcttacaggaccttgcctgtctattctattcgtggtcacaagacagaaaaagaaaaggagtgtgtggaaaacaagataaggaaacatgcttctgatctggggcagtggggagacaggggctgcgcctcactgcagagtccatcctgctgaacacagaggggcaaaagcgcccagacagccatacctgtgctgatcagaagggagggctgcgcctcgcgatccttctacctgtgtctttcaggctttgctgtctaggtccaagttactgctatgaaaagagatttgagaattcccagaggggcctttcagcctctttccatggctcttcctgccctttcgaaagcacagccagagacatcagaaatgaaattgtacataattcttttggactttgatgcaatctttggaaagaatttttgtaaatgccaagctacattttggcaaccccatcaagagtcaggtgtgcccagggcagtcaacccaggccctggactctcattctagttggattctatgacagctattttgccataagaattctagagccagatcttgctacaccacaattgcctcacgttgcaagacaaacaaatctaacctgagtcctgtggattccagaggtgctcaggaggaacctccgtctcagcgtggttgacctcaggttcagccccgtctgcccattcagcccgcagccccgtcccggagagcactcagaatccgagagcagcgcagcggcgcccccgtgtggccacagggccgaggacagagaccccgctcccctttctccctagccaggacctcccaggctctcctgttcccagcacctggacagggctctgcatacaagggggttcccgatctcaagtcaggctctgagtccatccagcttcccaaaatccatgttgacactgacgtttcctcccaccactgagtgactctggattttggctttagggaagagatacctccaggccaaaacagtgggatcatatctggggctcatccacccccaaaccattgctaccacatgacctagtccctcagcctccaaaatggggccttgccctcctgtcccctcccttgttcctgctgctgctcctgcaggtggaggctgctcatcccaggaatcagcctgtgagctccaagcctggagtccgggcctggggccttggtccagagagcagaagggagatgaaatggatcataagagaagggggagagtggaaggaaccaggggggagagaaaaacgagaagggccctgttagaagttgtgtgtgcatgtgtgtgtgtgtgtgtagatcaggagggggtttctagggacctggggaaaggagagctaagggcaggtgctaaggggcccagccctgttaattccaaggtccggaattaattccaggatactgcacttcctacagtaccactttatggccatatccaagtccagccctgagcagcctatggtcacagaaaatcgtgagaataatcagagaaaaatgacacgttacatacatgagaacaattatgagaatgaccagtccatgtgttcataatttgtcatcagaaactatggtggtcagaagacaatgaaatggcatttttttgagtgctgtaagaaaacaacctaactcagaattgcacatccagtaaaaatattttcagggaagaaaaatgaaaaggtgtctccagataaaataaaactaggataatttgttgcaaacataactctactgcaagaaaaatactgaaggagtttcccaggttgaaagaagtcataccagatggtaacttgagtcttcagataggagtgaccaacactggaaatgccaaatatatggtgggaagttaaagatgctctattttttcttagttttttttttattaatttttttttgagatggagtttcgttcttgttgcccaggctggagtgcaatggcacaatctccgctcactgcaacctctgcctcctgggttcaagcgattatcctgcctcagcctcccgagtagctgggattacaggcatgcaccaccacgcccagctaattttgtatttttagtagagacgtggtttctccacgttggttaggctggtctcgaactcccgacctgaggtgatccacacgtcttggcctcccaaagtgctgggattacaggcgtgagccaccgcgcccagctttttcttagttttttaaaaatacaaatgaacaacactatcaaccgtcttgatctgacatttacagtcactgtgttcaacagctccagaatatatattttgtaaagtgaatatggtacattcactaacacaggtcatatgttgagacataaaacaagtaacaacatatttcaaaggactgaaatcatacagaatatgtactctgaccaaaatagattttattggaaatcaataataagttgtctaggggcaaaaaagtattgaaaattttaaatcttccttctaaataacctacggatcaaagaagaaaacataagggaagttagataatattttcaactgaatgatgatgaaaacatacctttcaaaattattagatactatttccagtctttctgcaaaggacagtgatcaagagagtgtggtattggcaaaaggacagacacatagatcaacagaacagaatggagaggccagaaatggaaggacaaaaatagagtcacttgattttgaatacaagtacaaaggtcatccaatgaagaagggaatctcctttcaataatgatgctgaaacaattggcatccatctactttgggaggctggggcaggtggatcacttgaggtcaggagtttgagactggcttggccaacatggtgaaaccctgcctctactaaagttacaaaaattagctggtgtggtggctcatgcctgtaatcccagctactcgggaggctgaggtagaagaatcacttgaacctgggaggcagaggttgcagtgagcagagatcacgccattgcactccagcctgggccacagggtaagactcaatcacaaaaaaaaaaaaaaaaaaaaaaaaaaaaacttgacaatacttcacacctataaaaaagtaactcaaaatgtatcatagacttaaaaataatatgcacagccataaaacttctggaagaatataaaggagaaaatcttaaccttgagtttgagtttttagataaaacaccaaaaatacaatccatgaaagagaaaacaaatcaattagactttatcataattaatagtttttgctttacaaaaacactggtaagtgaatgaaaagaagacaaggcacagactggaagaaaatacttgtcaaaaaactggaagttatagatgtgacaaaggacttgtaaagataatatgtgaacaaaattaaaacacaataattggggaaaaaaatcttgattttagaagtgggtgaaagatctcaacagacaccaccaaagaagatatatgggtggtaaataatacttgaaaatatgcttaagatcatctgtcattagggaaatgccaacagggtgcagtggctcatgccttcaatgccaacactttggtaggctaaggcagaaggatcacttgagcccaggagctcaagaccagcctgggtaacatggcgagacaatgtctcaacaaacaaacaaacaaacaaacaaacattaaccaggtgtggtggcatgcgccagtgattccagccacttgggagagtgagacgggaggattgcttgaacctgggaggtggaggctgaagtgagctgtgatcgcaccactttactccagcctgggcaacagagtgagactctgtctcaaaaaacaaaacaaaacagaacaccaaaacaaagtactgctacactattagagtagctaaaattttttaaacttacaataaaaaatgctgaaaatatacagagcaacaagaattcccactcactgctaatgggaatggaaaacggtaaagccactttgaaagacagtttagaagtttcttataaagttaaggagagacttaccatcaatcatgctcttaggtatttacccaagttaattcaaggttgatatccacacaaaaacctgtacatgaatatttatagcagctttacatatgttcactaaaaactgtaaacaaccaagatatctttcagccatgcaagactaagcaaactgtggtataaccatatggatcataagaaatgagctattgtcaggccagatgaggtggcttacacctgtaatcccagcactttgggaggctgaggcaggtggatcacctgaggtcaggagtttgagaccagcctgggcaacatggcaaaactccgtctctagtaaaaatacaaaaagaaaaaattagctaggcgtggtggcgagcaactgtagtcccagctcctcgggaggctgaggcaggagaatcacttgaacctgggaggcagaggttggagtgagccaagactgcatcattgcactctagtctgggcaacagagcaaggatctgtctaaaaaaaaaaaaaaagctgttgccctggtgcagtggctcattttgggaggccaaggtggaaggatcgattgtggccagggttcaagaccagtctgggcaacataccgagatgctgtctatgtttatttaaaaaaaaaaacaaattggccaggcgcagtggctcacacctgtaatcccagcactctgggaggccgaggcatgtggatcacctgaggtcaggagttcgagacaagcctggccaacatgaagaaaccccgtctctactaaaaatacaaaattagccgggagtggtggcgcatgcctgtaatcccagctactcaggaagctgaagcagaagaatcatttgaacctgggaggcagaggttgcagcgagctaatatcgcgccattgcactccagcctgggcaacaagggcaaaactctgtctcaaaaaaaaaaaaaaaaaatatatatatatatatatgtaaataagctattaatccatacatcaattaatcttaaatgcgttttaccaggtgaaaaaaatgtcagacacaaaaggcttcattttatctgactcaattcatataccattctggaaaaagcagatctatggggacagaaaacaggttaatggttatcaaaggttggagggagaagggataaagaacattcaaagggaaatttttaggatgaaggaactgttgtagatggtactagggtagtggatatatgattctatacatttttcaaaatccaggctgggtgtggttgctcatgcctgtaatcccagcactttgggaggccgaggcgggtggatcacctgaggtcaggggttcaagaccagcctggccaacatggtgaaaccccgcctctaccaaaaatacaaaaattagccgggactgttgatggacgcctgtaatcccagctactcgggaggttgaggcaggagatggaggttgcagtgagcccagatagcaccattgcactccagcctgggccacaagagtgagacttcatctcaaaaaaaaaaaaaaaaaaaagtcattgttgtaaaaagggcacaggctttgctacagatttttctaccagtgaaaagatgtatacacttgcctggcctcatcattcagaccaattcataaaataacaaatgcatggaaaaaaaaacttaaaaacacaatcatcatgtgactgacttccaaattagattctccttcaaatcagagagtattgcttgttaatagtgtttataaattttaattcctgattgctgagacaatatgtacataaaatatttagccaaagagttcaaaatgaaattacccaaattacctatttgttattttatacatagtaattattttttaaaaatcatttggctgggtgcggtggttcatgcctgtaatcccagcattttgggaggccaaggcgggcggatcatgaggtcgggagttcgagaccagcctgaccaacatggtgaaacactgtttctactaaaacaacaaaaattagccgagcatggtgtygcgcgcctgtaatcccacctacttgggaggctgaggcaggagaatcgcttgaacccaggaggcagaggttgcggtgagccgagatcacaccattgcactccagcctgggcaacaagagcaaaactccatctcaaaaaaatttttttaaaaagcataaattaaaaaataaaataaaacttttaagatgttaagcccctgaagctccaactacaaagtagggtaaaaggctgcctaaagcagtgaagatcaaggagtgaccttggaggcagcagagggagactgtattagtccatttgcgttgttgtaaaggaatacctgggtttaagtaatttataaagaaaagagatttatttggctcacagttctgcaggctgtacaatcatggggccagctccactaggattctggtgaagtctcaggaagcttttacttgtggcagaaggcaaaggaagagcaggtgtgtcacatggagagagaaagagcaagagagctgctaggctcttttaaataatcagctctcgtgtgaacgaatagagtgaaagctcactcattaccatgggcagggtactaagccactcaagagagaaccggtcccatgacccaaacgcctcccactaggccccagctccaacactggggatctttcaacatgagatttggaggggacaaacacccaaaccttatcagagatgatcccagccacaggtctcagagaaccagcagagggcactcctccagggcccagcctgagtgtggaaatagctgtcagaatcacatcagaatgtttcagaactcatggggaaaagctgagacagaaaaaaagaagaaagtaagaagctggcagaaatcagctaggaaccttgagagacttggtatttcattgaaaggtaagataggagtgttttgactcccgtcgtccctaaggaagaccaccagtatctgaactgtcggagagctcctctgccctcacaaagccaaacactgatgtgcatggcgatttgggaacttctggagggcatcacaccagacaaccaacttgcgctgggtcacttgtccctcctccagactcgggcagtgttggcagggtgccatattaggagtgtagccatcaggggactgtgtccttcccagggaaccccaacctttgtatattcacatcacagaagctcctgcagccatgcccccagtgcccacttggattgtggcagccacacagggctggctggacccagtggagctgcagggttcccagtggtctagccatcagggattgctgctcctaaggaaagggagactgcagtacacaaaaaaagtaccagttgggacaaaggaggccagrccatgtactcatctgtgtccaagagctccttgtttgtgggctgagtgactgcaccacttccagcagagtcgtggacactgtgttcagctctgcgctgaaggagtgtagttccatcccagcagccaagcagccccagtgcttagaatcaggcatggaaaggggaaattctcctgcccttcccccatccaccactgcttcaaacacagcatggccactcccatgggaaattggcacgtgtgccagagaagagcctttctagggctatcaggggtgactgtgtttccactggcagtgtggccatttgggccaggcttgtgtgaaagacagggccctttcccctctctacagggagtgctagcattcctgcagtggagagcaggaaagctgaaaagctatgtgcaggccaggcgcggtggctcacgcctgtaatcccagcactttgggaggccgaggtgggcggatcatctgaggtcaggagttcragaccagcctgaccaacatggagaaaccctgtctctactaaaactacaaaaacaattagccaggcgtggtggcgcatgcctgtaatcccaggtactcragaggctgaggcaggagaattgcttgaacctgggaggtggaggttgcggtgagctgagatcacgccattgcactccagcctgggcaacaagagcaaaactccatctcaaaaaaaaaaagaaaaagaaaagctatgtgtttggggttgagggaggatgctctgcaccaaagacatttaaatggtgagctgaggagaagacatctttaatgagtctcaactacattgcagttggagatagagagtagtgtctggtcaatttgagtttcccygatgccaggactagggaatgacagggaaatggatggcattcctgcctggccaggtcatgaagctggggcagccctctcctcatctgtggagacctaggcacgtttcaccagaagtttcccatgccaycactcctgcctgaaagctgctgcctgtgctcaccattgtggggcaggcttggggatccagctctactcagctatgtccccctctctggtgctgagcagggagcccaggctgctgtacattccacttaccagcacatttcctgaggcaacagagaacttttctaggtatacaatgatgaagcatatactcacgtgcttctgccacataggcttttaggcataagcccacctactgttctggaggctgaaccacgcacctcaatacaaatcagttgacaaaagggcacatgagtggaaataaacttctcatctcttccaaaagaggaaatgagataaacttcttaaacctctgccatcctggccctgcaggaggctgtgagcctgttcacactcccagtacatcaccaccacaactggcatttgagaaagccaccatacaaaggctatctataaccaggggacaactacagcgtctttgccactgaaagcattcacaaccaaatgcaaaggaccttaaacaacatacattatagtcacatagtaaagggaaaaaaaaatcctgcccaaatgaaataaattcaaaaataagaagagaaagtttctacagatgagaaggaaccaaagaaatgattctggaactctctatgttttctattttttaagtaagtcctttgtttctctgttgaaaacagtagaatgttttgaaaacatactctgaaaaaagagtgttatgacatccccaaaacattacactaactttctagcaatagatcctaacaaaaataaaatctttgaaataccaaataaataattcaaaataatgattataaagaagctcaatgaaatccaagagaaagttgaaaacaacacaaagaaatgtaaaaaatcaattcagcatatgaataaaaaatttaccaagagataaatatttttaaaaaagtaaaccacctgggctgggcgcggtggctcatgcctgtaatcccagcattttgggaggctgaggcgggcagatcacgaggtcaggagatctagaccatcctggctaacacagtgaaacctcgtctctactcaaaatacaaaaaattagccgggcctggttgcaggcgcctgtagtcccagctactcaggaggctgaggcaggagaatggtctgaacccgggaggcagagcttgcagtgagccgagattgcgccactgcactccagcctgggcgacagagcgagactccttctcaaaagaaaaaaaaaaaaaaaattaaaccacctggaaataaaaaattcatcaaagtagttccaaatgcagctgaaagctttaacaatagactagaccaagcagaagaaagaatttcagagcttgaagacaggtctttcaaattaacccagtcagacaaaaagaaagaaaagagaattaaaatatgaacaaagccttcaggaagtatggggttatgtaaaacatctgtacccatgaatcataggtattcctaagggagaatgaagkgtaaaaagtgtggaaaatctacttgaggaaataattgaggaaaacttccctaaccctggctacagatttaaaatccagatagaagatacttagagaactcctggaaaatacattgcaagatggacttcaccaagacaaatagtcatcagacaatctaaactcaatgtaaaggaaaaaaaatcttaaaatgagcaagagaagagaaaaagtgtcctaaaaacctatataggaaattccatcagtctaacagtggatttttcaggccgggcacggtgggtcacgcctgtaatcccagtactttgggaggctaaggtgggtggatcacgaggtcaggagatcgatactgtcctgggtaacacagtgaaaccccgtctctactaaaaatacaaaaaattagccgggcgtggttgcaggcgcctgtagtcccagctactcccgaagctgaggcaggaaggagaatggcgagaacccgggaggtggagcttgcagtgagccgagatcgcgccactgcacgccagcctggacaacggagcgagactccgtctcaaaaaaaaaaaaaaaaaaaaaaaagcactgtgaaaatccctatcctgtttgttccgatctaattactgggacatgcagcccctagtcacataacccctgcttgctcaatcgatcacggccctctcaagcgcacccccttagagttgtgatcccttaaaagggacagaaattgctcactgggggagctcggctcctgacacaggagtcttgccgatgcccccggccgaataaacccattccttctttaactcggtgtctgaggagttttgtctgcggctcgtcctgctacaatatggcgccattgcactctagcctgggcaacaagagccagactccttctcaaaaaaaaaaaaaaaaaaaaaaaaaaaaaaaaaaaaaaaaaaaattgcggccgggcgcggtgactcacrcctgtaatcctagctctttgggaggctgaggtgggcggatcacgagatcaggagttagagaccagccyggccagtatggagaaactccacctctattaaaaatacaaaaattagctgggcatggtggcacgcacctgtagtcccagctgctcaggaggctgaggcaggagaatcgcttcaacctgggaggcggagcttgcagtgagccgagatcgtgccactgcactccagcctggctgacagagcgagattctgtctcaaaaaaaaaaaaagaaaagaaaagaaaaaaagaaaaacaagcaaagagtggtgatgaaatttgaaagaagggactaggccgggcgaggtggctcacgactaatcccagcgctttgggaggctgagrcaggcagatcacctgagatcaggaattcaagaccagcctggccaacgtggtgaaaacctgcctctattaaaaatacamaattagccgggtatggtggtgcgtgcctataaatcccagctacttgggaggctgaggcaggagaatcgcttgaacccaggaggcagaggttgcagtgagcccagatcgcgccattgcactccagcctgggcgacaagagtgaaattccctctcaaaaaaaacaaaaaagtaaaggaaaagaaaagaaaagaaatagcatatagtagcatataaattcccaaacattaaacaattgcctttgttcatataaacaataaaaagttaaaatttttgtgaggcgataacctcatatataatagaaacaaaaaggtttttaatgaaaaaattactaagaagtgtgcaaactttaaatgaaaacattaaaacacatctgaaatttaaaaattagatatgaacaaatcgggccgggtgcggtgtctcacgcctgtaatctcagcactttggcaggctgaggttggaggatcacctgagatcaggagtttgagaccagcctggccaagtggtgaaaccctgcttctactaaaaatacaaaaattagccgggtgtggtggtgtgagcctataatcccaactacctgggaggctgaggcaggagaatggcttgaacctgggargtggaggttgtggtgagccraggtcacaccwctgcactccagcctgggtgacagaatgagagtccatttcaaaaaaaaaaaaaaaaaaaaaatgaagaacttttttttttcttttccrtaagttcttggggtacaggtggtattcggttacacgagtaagttctttagtggtgatttgtgagatttcgatgcacttatcacccgagcagtatacactgcaccttgtagtcttctgtcccttgccccctcctattcttcctctcaagtccccaaagtccattgcatcattcatatgcctttgtgtcttcataactcagcttctacatatcagtgagaacatacaatgtttggtttcccattcctgagttatttcacttagaataacagtctccaatctcatccaggtcactgaaaatgctgttaattcattcctttttatggctgtgtagtacagaagaacattctcaaataggaagactatacagcacatttgcagagtaaattttcaaatgtaatacctcctaatcaaaatgccaacaactactttttttctcaagctagacaagtagattataaagttcacatgagaaaataaataagaataattagaaaatcccttgggggaaaaaaacaaattgagaattgggtgtctagttatgcctaatagttaaatattttacaaattccctgtcactagaacagtgtggcactggtgaatgaatagaccaaccaatggaacagcacaggaagtccagaaacagccaagtgcatagcaacctagtcctcatttaatgactttaattcattcctgggcattgtgccactaaataaaaagtattaaaccaggctgggtgcggtggctcacgcctgtaatcccaggaaattgggaggccaaggccggcggatcacctgaggttgggagtttgagaccagcctgaccaacatggagaaaccccctctctactgaaaatacaaattaggcaggcgtggtggtgcatgcctgtaatcccagctactcggaaggctgargcaggagaatcgcttgacttgaacccaggaggcagaggttgtggtgggccaagatcgggccattgcactccagcctgggcaacaagagcgaaactctgtcttaaaaaggccgggcgcggtggctcacgcctatcatcccagcactttgggaggccgaggcgggcggatcactaggtcaggagatcgagaccatcctggctaacgaggtgaaacctcgtctctactaaaaatacaaaaaaattagccgggcgtggtggcgggcacctgtagtcccagctactctggaggctgaggcagacgaatggcgtgaacccgggaggtggagcttgcagtgagccgagatcccgccactgcactccagcctgggcgacagagagagactctgcctcaaagtggagaaaatggtacagaggccgggcgcggtggctcacgcctgtaatcctagcactttgggaagccgaggagggcggatcacgaggtcaggagatcgagaccatcctggctaacaggtgaaactcagtctctactaaaaatacaaagaattagcccggcacggtggcgggcgcctgtagtcccagctactcgggaggctgaggcaggagaatggcgtgaacccgggaggcggagcttgcagtgagcagagacagcgcaactgcacttaaagggcgagactccgtctcaaaaaaaaaagaaagaaagaaagaaagaaagtgatacagaagtgaaagagatgtttacctattgagcaaaaggtgtgagggtgtgtgtgtgtgataaatgatactagaaaaaaagagagcaaatgaatgatattgtattctcttcatagttaaggtgttctgctgtttattttttgtggggggaggggggcgcggggcggacagagtctcactctgtcgcccaggctggagtgtaatggcgcgatctcggctcactgcaaacttctgcctccctggttcacgggattctcctgcctcagcctcctgagtagctgggattacaggcacgtgccaccacgcccggccaatttttgtatttttagtagagatggggtttcaccatttttgtcaggctggtgtttatatgatattaataaacaatgaaagataaagaaaagatctgaatcatttgcattttcaggaaaattgttacacatcagaaaatctgtcaggaaatatttgagactccatcacaatcattgccccttaaacacacccatcaagacgactrttcttcctcctttagagagtaaaatgaaccttcagtacattgagttttgtggaattcttacctatttactctgaagtttctatttactacttacatacctttgttttcattgctctattgatatatctacctgcaaagttttctgtgagtcctctattgttatagaatgcaccataattttttccattaggaaaattaaattttgtttactcttttttttttttctttgagacagagtttcactcttgttgcccaggctggagtgcaatggcatgatcttggctcactgcaacttccacctcccgggttcaagcaattctcctgcctcagcctcctgaataactgggattacaggcatgtgccatcacacctggctaattttctatttttagtagagacagggtttatccatgttggtgaggctggtctcaaactcccaacctcaggcaaaaaaaaaaaagttctcaatgtggtggtggtgttggaggtggggcttagtgggaggcgtttgggtcatcaggagcagatccttcatgaatagattaatgtcctcccacatgagcgagtaatttattactctgttggggctaggttagttaccaaaaagcaggttgttataaaagcaagtttggtttcctagactctctcttgcttccctgtctccccatgtgatgtttttgcacatgccactcacttttccccttctccaaaatgttttgacctaacatttggccttcaccagaagtttgccagatccagcactatcctgttgaacttcccagcctgcaaaatcatgagctaaataaacatcttctctttataaactacccagtttcaagttattctgttatagtartactcaacatactaagacagtcattgaaaacaaagtcaacctggaggagccttaaggagacatgattaggactaaatacaatgtgatatcctcgatgaaatcctgtgacagaaaaaggaagttaaaagaactaatgaaacctggctgggcatggtggctcacacctgtaatcctagcactttgggaggccaaggcgggtggatcactttaggtcaggagtaagagaccagcctgaccaacatggtgaaatcctgtctctactaaaaatacagaaatcagccaggcacggtggcatgtgtctgtagtcacagctattcaggaggctgaggcatgaaaatcatttgaactcgggaggtggaggttgcagtgagtggacatcatgccattgcactccggcctgggtgacagagcaagactttgtttcaaaacagaaagagctaatgaaatcgaaataaagtttagtgatactatattaatattgtctcactggttgtgaaaaatgtataatagtgatataagatgttaacaatggggctgggggcagtggcacacacctgtaatgccagcactttgggaagctgagcgggtagatcacctgaggtcaggagttcgagaccagcctggccaatgtggtggaaccctgtctttactaaaactacaaaaactagctgggcatggtggcgcgcacctgtaatcctagctactcaggaggctgaggcaggagaatggcttgaaacccggaggcagaggttgcagtgagccgaaatygtgccactgcacttcagcctgggcgacagagtgagactccctcaaaaaaaaaaaaaatatgttaacaatggggagctgagtgtgacatatgtgagaactatgtattatcttttcaacttttgtgtaatctaaaagtattctaaaattaataagtttattaaaaamaaacaacaacaacaaccctcagaagaggaaaggaatagggagttaaagaaaaaacagtatactttttagttttcccagggtttcctatcaaggggctgggaagagggagaaaagattggaacctcagagacagtgcggggctccagagttctcttgtcctctgactactggggctgctcagaaattgtcttcatccccctattgatgtcaggttccagggtcagccacctctgcccaactcagaccacagacatcccagccttttctgattgctcaatttgtgtctgagacaccagagaggtgccacccccaagtggccatagacctgaggacagacgacctgagcccccttttcttctcgctgtggacctcccctgcgtctccttgggctcccagaagtcagacagggttcttcatgcaagggcaagtgttttagtctttttgggctgctattaaaaattatatattatagactgggaaacactgccctagccaagtgatggaggttaacataatcatttgataaatcaactgggtaatatacactcttggtatgttgtattgagagtattgcatttcatctctgtgctcttcttcccccaaacctatagccctgtcaaccacactcaaattaagggacattttacaatatgcctcactagtactcctcaagaaataccaaattatcaaaaacgaggtctgagaaattgtcacagaccagaggaggctaaggagatataaaggggactaaatgtaatgtatcctggatgggatcctggaacataaaagtgatgttagggaaaagaataaaatccaaataaaataggagttagtaacaatgtatcaatattgtttcataacctgtcacaaatgtataataaaataagacattaataataggggaaactgaatgtggaacataggagaactatgtactatctttgcaacttttctgtaaatccaaaaatattgtagatttgatttgatttgatttgatttttgagacggagttttgctcttgttgcccaggctggagtgcaatggcgcgatcttggctcaccgcaacctccacctcccaggctcaagagattctcctgcctcagcctcctgagtagctgggattacaggaatgcaccaccatgcccggctaattttgtatttttagtagagagaggatttctccatattggtcaggctggtctcaaaccccccacctcaggtaatccatctgcctcggcctcccaaagtgctgggattacaagtgtgagccaccgtgcctggccaatattttagattttaaaaggatatttttataactagtgctcaggaaagaaaaagaaagtggaagtaaaaattatctacttttcgggcggcttaccttcactccctcattgacagccagcctccacaccagccatatctgtccagtttagactgcagcccagtcctctcccaggctgctcaatcagaatccaagagagcagaacatcggcacttgtgtgtggtcagcgggctgagaacagaagaccggactcttttggcctcctcctcaggttgagacctccccattgtcacctttggctttcagcaactggacaggacaacgtacccaagggggcgccccagtcccgtgttaggctcggaatctgaagtgtttcccaaatccacgctgacatagatgtttcctctccacctagtgaccgtggattctgacctcgggacagagcgaggtttccaggccaaaacaagtggttcccaggttacaagtggaccccacaaacatactgtcacttctgctgctgcttccagggataaatgtggcttatcctggggaccaacccctactctccatccctaggatgggggagaggaagggaaattctcagggcattggcctagggagttggagaagctgctggtgaagtgaaaacaggagcagaatagggacattagagataaaggggcatagaaaggaatcagctctgatgacacctgtgtaggataaatgggttctgcttggggagaggctcacaggtttctaactgggatggtgtttttaacatggatgataattatagctgtgtcagttttacaagcgatcagaaaactacacttaaattttaggcaatttttgtgcttacagagatagtataatgcgcttacacacgaagaaagggaagaagacaaggggagaagaagtgattataggaattaggttcctgtttccttgctagctgtcaaccaagggttgctctcagcttctggaagttacctgcattcttttgctcatggccacctccatcttgaaacacagccatggtacactgaatacttcttttgctttgaatcttcccaacttctctttgatctttgttttttctgccccttaaggagttcatgtggttagatcaggcccaaccagataacctgttttatggtcaattgtcttgggacttcaattacaacagcataatccctacatagtggtgcagatggtccctgatttacgatggctcaacttacagtttttcaactttatgatgatgtgaaagcaacacacattcagtataaactgtactttgaattttgatattttcctgggttagagagtatgatactctgtgacggtgctggacagcagtagtgagctgcagctcccatcagccacacaattatgatggtaacaactgatactgtactctatactgtactgtatgcaaccagttacatgagatagtcaacactttatcatacaaggggatttgtgttaagtgattttgcccaactgtaggcaaatgtgttctgagcacatttaaggtaggctaggctgagctaatatattcagtaggttaggtgcattaaatacattttccacttgaaaatatttttcagttacaatggttttattgaaacataaccccattttaaattgaagagcatctgtactttgattagtatttgactgaataaccaggggaagcaatcttgagggggaaagcatctttagaattctgcctatcacagtaccttgggggactactgcaaatgaatgtatcccattagaacttctctacacctctaatcaccttttgtcttaaagtggctgaggtgagataaagggatctaaagggattgggagcatggagggagaaacaagttctgttccattaaagtcacgcatttactttcagtttctttctgcatggcaagctttcagtgttctcagcccacccaatactttatattgggcagaaacatcctgatggctgatgccatcagttttggccttggatctagcacccacagccataggctctggctgagtccatggggtttgcaccttcaggctgacttgagcttgacttgcacaggggtaaccttgaatgaggaggattccatccattaccaagttaacatttttaaagttctcatcaggtttcaacataagggctaggggaatttttcagaggaacagggctgactgcaagcatttatttacatttctttaggtcagtttgtttttcatcaatggatcgccttcgtcagtacggtaacaccaacccagagtactaagaggctgaatatgcacttgatttcccatagtactttgtctcagggaaatcttacctagaggaccaaatcttcctgatggcagtcagggctcactgcgatgaaaatatgagaccttttactgttgcctacaaatggatctaaggttgggctcgcagactgcagaaggtgctgatctgtaaggcagcacagttgttgccattctttcttaacaagcattgacatgctacctccttataccctcaasgtctcaactcccagatgatccagctaaagtgtaatgatttgtttggctctgccaatagctattgttaatttccctcctttcacattcactgtgcgtctctgtaattttctgcggaaaaattgcagatactaggatgaaataacttttgtcagacccagataaaatagggccaggccaggcacggtggcttaygcttgtartcccagcactttgggaggccgaggcgagcggatcacctgaggtcaggagttcgagaccagcctggcctacatagtgaaacccccatctctactaaaagtacaaaaattagtcggacgtgctggcatgtggytgtaatcccagctactggggaggctgaggcaygagaattgcttgaacctgggaggtggaggttgcagtgagccaagatcacaccattgcacgctagcctaggtgaagaagcragactctgtctcaaaaaaaaaaaaaaaaaaaaaaaaggccaggaaggcatgaaggagaggaacgtcatgcttacatgtttgaagtaagaattgttaagttgggcgtggtagctcatgcctgtaatcccagcactttgggaggccgaggtgggtggatcacctgaggtcgggagttcgagaacagcctgaccaacatggagaaaccccatctctactaaaaatacaaaattwgccaagcatggtggtgcatgcctgtaatcccagctactagggaggctgaggcaggagaatcgcttgaacccgggaggcggaggttgcggtgagccgagatcatgccattgcactctagcctgggcaacaagagcraaactctgtatcgaaaaaaaaaaaaaargaaaagaaaagaattgtttcaaaggactttttaaaaactccacaagaaatcttttctagggagtggggagggatagcattaggagatatatctaatgttaaatgatgagttatgggtgcagcacaccaacatggcacatgtatacatatgtaactaaccggcatgttgtgcatatgtaccctaaaacttacagtataattwaaaaaaaaaaagaaaaaagaaagaaatcttttctagccgggcgcggtggctcacgcctgtaatcccagcactttgggaggctgaggcaggcagatcatgaggtcaggagtttgagaccagcctgaccaacatggtgaaaccctgtgtgtactaaaaaaaaaaaaaaaaaaaaaaaaattaaccgggtatggtggcacgcacctgtaatcccagctactcaggagttggaggttgcagtgagctgagatggcgccactgcactccagccggggcaacagagcgagactctgtctcaaaaaaataaaaataaaaaaataaaagaaatcttttcttcatccttcatgaatgtcctgtcacaaggtttatcagcaggcattctttttttttgttctgtttagaaatagggcctcactccattgccaaggctggaatgcagtggtgcaatcatagctcactgtaacctcaaactcctgrgctcaagcaatcctcccacctcaacctcctaagcacctaggactaaaggcatgtaccacmacacctggccaagttgttttcattttttctagagaaagggtcttgctatgttgcccaggttggtcttgaactcctggcctccagcaatcctccctcctcagcttcccaaagtgttagcattccaggagtgagccacgggggccyagcctagacattctttagtactatagtaattcagataagatgctcttgaaagaacacttgcccagtaacggcaatgtctcccaagtagctgggattacaggtgtgcgtcaccaccaccggctaacttttgtatttttaatagggacaaggtttcgccatattggccacgctgaggtcgaacttctgacctcaggtgatccgccccctcagcctcccaaagtgctgggattacaggtgtgagccaccgctctcrgccgcgtgttttaatcataatactttggtctttttttttttttttcgtaaatactttcctcttttttttttttttttttttttttgagatggagtttcactctttttgcccaggctggagtgcagtggcgtgatctgggctcactgcaacctccacctcccggattcaagcgattctcctgcctcagcctcctgagtagctggggttacaggcgcccgccaccacgcctggctaatttttgtacttttagtagagacgaggtttcgccatgttggccagggtggtcttgaactcctgacttcaggtaattcaccagcctcgacctcccaaagtgccggaattacaggtgtgagcaatcgcgcccaggcttttttttcttcttcttttagagtcaattaagactgggaaagcgaaaatcctagcgctacttgggaccagcagctatcagttggtcggaggctcgaagtggtggtgcatggccgggctgtctgtgattcttaggatgggaagcttgaccttggcgggctcaccctctcatctgggtcaaggggcacattctcggtggcctgatgactgggagggagcggaagagggcggggccggggtggggccgcggcgccgggactgcgggtgctcggccggagcgctccagccgctggtccccgggagaccctgtgcccctaaatcgcggtccactgcgcgcgtcaggtgagtagagcggcggcggggagtcgcgctagcggtagtagaggctgatgttggatgttgtccccactcctctgactcttccgcaggccaggggagcactgcgcccctaatcttggaggggcttccaacctctggggtcctccggggaaacgtgggttagtctggggtgtatccaggtgccctgtccactgtgggcactctggggattccgggccgaggaagggctcctggcacgtgttgaaaaagtcggcatcccagaaggaagattctgggcrgatgggcatcggggaaggtagtcccaaccaatgggaccgtttctgagcacataagcgyattcagtgggtgctaacaagcgcctgctttgccaggcgacagtgagcaaaaccggctttgttcccggccaccggaagcttcgaggctggggttccggatctgggcgcscaatgacaaactaagcgcggrggacagggccaggagcgcccaccagggcggcgatctggtgggtaggtgcagggcaatggctggaaagggtccccgaagccctgagcagagaccaaagggccgtgcgactgcaggaaggccattttgcttggctgacaggcggaaaactcacgtggctggagtagcagggttggtgacracaagggtgaatcccactaagcattgcaactgtttgcggtgtgaggggtgagggggattctyatcattctcasaattgcygtggataaagggttttgggttggagagagactgggtgcactcaaaggactgaaagatggcgacgacacattccctcagaggatttacattctggaagggtggggacaggcccgggtacagataagcccgcaggcggcctccagctcttacagtcgaaagtctgatgagttatgcccagtctccttcctcctcccgccggcatgaggtttggggccctgtggatgaaggaagttcatgggaggcaaacgtgcctgggcaagcaacagccgcagagattcagtccccacgggggttagaatccacacttagggcctctgcctaccgcctccagcaaatgccatcttgaggactagcggcagcagtaggtcttctctgccagagaactggaaggccaggttcttgagggcactgttactaaggcgtttttttttttgtttgtttgtttgtttgtttttgagacggagtttcactctcrtttccctggctggwgtgcaatggcgcgatctccgctcaccgcaacctctgcctcccgggttcaagcgattctcctgcctcagcctccctagtagctrcgattacaggcatgcgccaccacgccgggataattttgtatttttagtagagacgaggtccatgttggtcaggctggtctcaaactcctgacctcaggtgatccgcccgcctcggcctccccaagtgttgggattacaggctgagccaccgtgcccagccttattaaggctgttttgaagtgcagttggctggaaagtggaagaataatccaagatctgcatgcctcataaaaggagtgcgaatggttttgaaagacaggaaaggaaagggagagagaggaaagaaakagagaggaagaaaggaaggaaatcaaattcatatcccaggaatgcacctttcatgacaacattttggagatccaattaactctattcctcgagggcgtttttccttgntggtattttcagttctattaacacttctcaaaaagtgaaaggaaaaaatagtcaacagggttttttggtctttattcttttctttctatctctagtaagggagatgtgggtgagtggctgtcagcaggaaaaggtgagagttcagctatgtttgcatctgagcaggaaatttccaaggatgagcagggaactccagtgctgggctcattgtgagccctgaataagtgattgctcttgggttgttagcagtattcttcacaaagatctgtrtatacagtggttccccttatccacaggtgatatgttccaagagctctagtggatactttgtttttgttgttgtttgaggcagaatctcgctctgtcacccaggctggagtacagtggcacagtcttggctcactgcaaccttcacctcacgggttcaagtaattctgcctcagcatcctgagcagctgggactacagcgtgccaccacgcccagctaatttttgtattttcagtagagacggggtttcaccatgttggccaggctggtctcaaattcctgccctgaagtgatccaccgcgccccaccccagtggatactttgaaaccatgaatagtaccaaaccctgtatacactatggttttctttttctatacatacataataatgataaagtttaatttacaaattaggcatggtaagagattgacaacaataactagtaataagatagaacaattacagcaatatattgtaataaaagttgtatgaatgtggtatctctctcaaaataatttatattgtaaatcttagcaacctcagcatatgattattttttctttccttaagacaagaatttttacctttttattttatggcttctctttgcatatctgaatttccagcgtctctactcttgtgcttttgggtcattattaagtaaaataaggcattcttgrgcacaggcaactgctatactacagtagtcaacctgrtaactgagatggctagctactaaggaactaatgggcaggtattgtctgcagtgtggatatgctagtcaaagggatgattcacatcctgggcaggccagagagaaaaggtacaagatttcatcacactactcagaatgtcaagcaatttaaaacttaggaattgtttatctctggakttttttttgagacggagtctcgctctatgtcccaggctggagtgcagtggcrcagtcttggctcatggcaacgtccacctccagggttcaagtgattctcctgyctcagcctcctgagttgctgggattacagatgtgtgccactatgcccagctattttctttttgtatttttagtagagacagggtttcaccatgttgaccaggctgatctcgaacycctgacctcagatgatctgcctacctcagcctcccaaaatgctgggattacaggtgtgagccactgtgcctgtcctccggaatttttcatttaatatttttgaaccatggttgaccatgggtaactgaagcattgraaagcaaaaccatgataaagkggaactactacatgtattgaaaatccagatcacagaattgtgtgtgtgtgtgtgtgtgtgtgtgtgtataattttggtcatggaagagatcttagagagtgtctcctttattctcacatttctgatgaaaccaagtcagaaagaataaagagactcactcgaggtgatctgtgacagatcctagcctggttaccccagctacatgatttccaatggtactgagtctaacattaacattaggtttaaacattaacttttgtagatcaagaatgtccacttgtccttggaaaattatttagcatctctgcattaggtccttaagacagggccagtaattgttacctcattgctgagagcatccagtggcacactgtaggggtttagtaactgctggcattccctgaccaaataaggaagctgtttcttaccctccctcttgctgatatgttttgtttttctctgacctcaggtttctagaagcagggtagaacagasggcagacacctagcccaggctggtgttgttactaaacaatggcagctggtgagccaagggtgaccagggccctgaactckgtggcccagctttgagggaagcaaaattgttctcaattgtggaagaggagaatttggacagcagaacraaaaaggaagacagcctcttggagcagatacatttgtcacaggaagccacatcaaaccctggggcctttgctgggcctctccatctgcccagttactgggaggtagatagccccaggaaggaatccagtcaggcctgggcaccaggccaggagtggataaagctagaaagagacaccacagaagagaagatgtttgaacagctgaagccaatcgaacctgtacagaagacgctcccatgggtgggcgaggtagctgccaccctgcaggaagccatgaagagagattgctggagggaggcacgggtgaagaaggtgaggagactaagctagagagaggtggggtccaggtcctggactccaggagctctttcatacatactcctgcctgcaggtcaaatgaaatctcagattgttccagactgaacgacatccagaaaaaggagctgcaagacctttctccatctcccgcaccatcctggcatccttcatggagtacttcctgaaatttgttagagtggcagcattttttccttcgctttgctttcctgtttatattctgcatatctgcatatcctctttcctctcccccacatcttatctttctccctttctcttcatctttcctttcctttttttttttttcttttttttttttttgagacggagtctcgctctgtcacccaggctggagtgcggtggcgcgatcttggctcactgctacctctgcctcccgggctcaagcaattctcctgcctcagcctcctgagtagctgggattacaggcatgcgccaccatgcccagctaatttttgtgtttttagcagagaccaggtttcaccatattggtcaggctggtctcgaactcccgacctcgtgatctgcctgcctcagcctcccaaagtgctgggattacaggcgtgagccaccgcgtccggcctcctttcctttctatacttcacagttgctggccttgtgtctgtcttttaatatttctctcttccttccatggttttatctttctcttaggttttaattctctgaatcttgagactggatgttaatcttgtacacacacacacacacacacayayayatatttatataaacttcttgagtctctcctgttcttccagaagccagtcacctttgaggatgtggcagtgaatttcacccaggaagagtgggactgtctagatgccagccagagggtcctttaccaggatgttatgtcggaaacctttaagaatctaacatctgtgggtaagaggctgggcttccctcagcaagccccctgtcctaagggccctggaacatctggtttccctggacaggtagatcagcttacaattagtttcactgacccctggttctatgctttccaggtgtgaaagatctgagtcactaagctcagtggtaaagagaagaaatgatagcctgcatgaaggcaaagataacacttgtaacatgatgacagtgttcycaaaatatgcaaatttttccattcatcaaacaaatatttactaagtcactcctgagaaccaggtactttgctagcagctggccttttaatgtctcctttccrcatctacatgtcccaggttatggttcttaaacaaaggctacaggaggtagcctgttgtccccatcagatgtgaaggggccatacctgggaccaactcaackctttctcattcccacacatcagccagaatctttctgcataagccagagctaatcaccaagcttgagcaagaagaggaacagtggagagagtttgtccatctcccaaacacagaaggcctttcaggtragaattgccaagcagggaggaaggggaaaagggcccaggataacccctgaaaggatggagagctgatgaagaggatgaatgctctatagatgctctcctagtgtacctctgtccagcctggtcagacttggagttgaaagagagcttaatatcataggctcaagtcccttgacttcaagttttcaagttgaagatccaagtctctctctctctctctcttttttttttttttttttttgagacacagtctcgctctgttgccaggctggagtgcagtggcacaatcttggcttactgcaacctccacttcccgggttcaagcgattctcctgcctcagcctctcgagtagctgggactacaggcatgtgccaccgtgtccagataatttttgtatttttagtagagacagggtttcaccatgttggccaggatggtcttgatgtcttgacctcaggttatccatccacctcggcctcccaaagtgctgggattacaggcatgagccaccgtgcctggctggctgaagatctaagtctttcaggagaagtagatgtcttcagtttctagagattgagagatgacatgaaagttgcttatgtccatgatagtgctctgattaaaatgttctttccaagagaaaagagaagcaaaggagataggtttcatgctgggttggagtaagggaggcttgtccctggtagtaaatagttgagagagatatcaagccaggctgatacactttttggttttccaggacagtcctggtttatacttctcatcccagcttgattattaataacacctcttttcaccctcaagtggcccagtgttcatgatgcattattatgtgggtgtctgtggattgtctatgggagtttgagcaatattgagaatgagataagatagatttcaagaagtgttgttgtaagttaaaatttacatttctgacagtgttgaaagattccagttaactttttatttgcttctaatttgaaaagccaattttttctttttttcttcttatttctagcctatgaggcccaagggtaaggatgaatgtgttgggtgggagagcaagggcagagacaagaagtgtgttaggctgaatggagtgctgtgttggagttcttcttcttcctcttcttcttcttcttcgtcttcgtcttcttcttcttcttcttttcttttcttcttcttcttcttccttcttcttcttcttctccttctcttctccttctccttcttctccttctccttcttcttcttctttttctttctttctttttttttttttgagacagagtttcactctagttgcccaggcaggagtgcagtggcaccatcttggctcactgcaacctccgcctcccgggttcgagtgattgtcctgcctcagtctccctagtagctgagattacaggcagatgccatgacgcccagctaatttttgtatttgtagtagagacagggtttcaccatgttggtcaggctggtttcgaactcctaacctcaggtgatccgctggcctcggcctcccaaagtgctgggattacaggtgtgagccaccatgccaagcctctgttggagttcttacagtgaattttgtgttattcttcctcattcactgtagaaggcaagaagaaagagcttcgagaacaacatcccagtctgagagatgaggggactagtgatgacaaggtcttccttgcatgcagaggggccggccagtgccccctatctgccccagctgggactatggacaggacccgggtgcttcaagcatcccaggctgggccaccctttttttgctacacctgtggcaaatgtttcagcaggygctcctacctctatagccaccagtttgttcacartcccaagctgactaacagctgcagtcagtgtgggaagttgtttcggagccccaagtccctcagctatcacagacgcatgcatcttggggagaggcccttctgttgcacgctctgtgacaagacctactgtgatgcttctggactaagtcgtcaccgccgcgtccatctgggttaccggccccattcatgytctgtgtgtgggaagagcttccgggaccagtctgagctcaaacgccaccagaagatacaccaaaaccaggagccagtggatggaaaccaggagtgtactttgaggattccaggcacccaggctgaattccagacacccatcgccagaagccagrggtccatmcaggggcttttggatgtgaaccatgcaccagtggccaggtcccaggaacccatatttagaactgagggtcctatggcccagaaccaggcatctgtacttaagaaccaagcacctgtgaccaggacccaggcacccatcacyggaaccctctgtcaggwtgccagatccaactctcatccagtgaagccctcaagactcaatgtcttctgttgcccccattgttctttgacttttagcaagaaatcctatctctccagacaccagaaggcccacctcacagagccgcccaactactgcttccattgcagcaagtctttcagctcattttccaggctggtcagacaccagcagacccactggaagcagaagagctacctttgccctatctgtgacctctcctttggggagaaagagggccttatggatcactggaggggctataaaggcaaggacctgtgccagagcagccaccataaatgccgggtgatcctgggccagtggcttggcttctctcatgatgtccccactatggctggggaggaatggaagcatggaggtgatcaatctccccccaggatccatacccccaggagaagaggcctaagagagaaggcctgcaaaggagacaaaacaaaggaggcagtgagcatcttgaaacataaataaatggcctttctgactgagctctttctttgtgtttagttttcctgaggactgacctctggggtaatgaggctggagtagagggagacaggtgcgtggataaggaaggaaatacataaaagacaaggggttagaagtgtgcttatgaaaacttgtattattattttttatttatttatttatttatttatttatttatttatttatttatttttgagacagagtcttactctgtcactccggctagagtgcagtggcgcgatctcagctcactgcaacctctgcctcctgggttcaagcgattctcctgcctcagcctccggagtagctggtattataggtgcccaccactatgctcagttaattgtttgtatttttagtagagatggggtttcaccatgttggccaggctggtcttgaactcctgacctcgtgattcgcccgcctcggcctcccaaagtgctgggattacaggcgtgagccaccgcacccggccaaaactcgtatctttattaattagcacctagcttgtttgtttgtgtctgaccatcaagtagtagttgttgaataaacagtggatactctgatagatatgaagataggagaaaaggatgagaggaaggaaagattctgagacctgtggaagatgtgtaagtagaaggaaaacattctaaagcaggcatgttgcccagctttcgtttttgcttccccaggtccctagtaggctgccaagacaaggaggagctctggctagtattctgtaggtttctccccatctccaggtttgggttggggctactcatatcctcactcttcagctcactcagctctctcttcaatgttttgcactcttcctcttccttcccttcacatgcctttcagttttgcgcaatcagggctggagtcttggaagaaacaaccaccatttgcaaagttaccatactgtaattttcagtgaggagattcctggcctccagttcatggcagagaccatcctgtgttgctctccagtacaggtgtcctctgatggagagaggggcacctgcctgtccttagccagagagggcttccaggtggaagactggagagagaaatggaaagaagggtaataaaaatgggaaaatgaagagaaaaggtagatgacagaagaagggaaatcaattctacttggaattcagagtgttcctgaaagtgcaaattggaatgtccccatagcaaagatgccagtgagtgtgcaacttgatggatgagatgtccccaaggacaaatccctgggcaaccaggctctcctccacccctgccaagatgtgacatcactcagaagggatttcctagaagaaggagaaaataacttgaaaaacgtatgtcagtagtttgtatcataaaaccattgaactagggagaagaaaagcccttggggtcatcttgtctccattcctgcctcaatggttgatctgagaggtgaggcactgggcagttgctgtggaatgggcaatgagaccagctagggttggattcctgcttaggggcagtgaaggaggaatggatcaggtggcagataggagtgcctccagcttctctgccacctgtaaatgtgtctctaacagctggcttctttgccctctacctcccaggaggagtcttccctccacccaggctctccagctcctcctttcctctgggaatgtgatccctcaatagcccgcctcttcctcttgttgcttctgtctccctttcctggctttttattctctgcttataacagagagaagagaacttacgtagctcttcaaggaattgccctgaaaacaaaaagaaacaaatatgtgattagtggaagatgaatagcaccttccccacatcctccctatggacatttggagtgacccacactgccctttccactgggggatcccacagatccagtaagtggttctcttcacagtttctcagaagagcctggggttgggcatggggacagaggaataaggaaatcccagctcccctaatcttgagtcctggttctattctcttttggcttcccattcagagctgacttggtcccccactatttggtggtcttgcctgctgcccagccactgcacctgctagtcttcgatgtagccagttgtagcagatgatcaaggcaaccaagggtccaagaaccggcacaattacaaacagggttatcttccagcagggcaccctcagaaagtggggatctgaattgttcaccagaacaaacagggttaacatgtgttccccctcatgccccacccacctgtcttttttggttccttaacctggggtcctagaacaccaaaggactctggggacaaaattcagaaagtccatgaacttggatgagaaaagtactgcctccttattttcaataactggatttaacattttctttcattaaaaatgtaacaactgccaggtgtggtggctcatgcctgtaatcccaacactctgggagtccgagacgggtggatcatgaggccaagagttcaagaccagccaggccaacatggtgaaaccccatctctactaaaaatgtaaaaattagctgggcgtggtggcacatgcctgtaatgccagctactcaggaggctgaggcaggagaatcgcttgaacctgggaggcggaggttgcagtgagccaagatcctgcccctgcactccagcctgggccacagagcaagactcttgttgatcccaccaacacccattcccccaagtcttggaaaaaacaaaacaaaccaaaacattttacaactaaccacaatatgagcagtacctgtgacttaattaccaatggaagccacagatgttttcattcccattagagttattgcagaaatcttgaaatactgtttatgtttattagtatgttgaaattaaaggttattgggctgggcctggtggctcatgcctgtaatcccagcactttggaaggccaaggcaggcagatcacctgaggtcaggggttcaagaccagcctggccaacatggtgaaaccccgtctctactaaaaatacaaaaattagctgggcatggtggcatgcgcctgtagttccagcaacttgggaggctgaggcaggagaatcgcttgaacccaggaggtggaggttgcagtgagccgagattgtgccattgcactccatctcaaaaaaacttcatctcaaaaaaaaagaaagaaagaaagaaagaaagaaattacaggttattagacttgctgctacattacttaatgtattactttggctaaagaaatatttatggccgggcacggtggctcatgcccgtaatcccagcactttgggaggccaaggcaggtggatcacctgaggtcaggagttcgaggccagcctggccaacctggtgaaacctagtctctactaaaaatacaaaaattagctgggtgtggtggcgggcacctgtaatcccagctactcaggaggctgagaatcgcttgaacccgggaggcagaggtttcagtgagcctagatcgcgccattgcactccagcctgggtgacaagagcaaaactctgcctcaaaaaaaaaaaaaaagaaacatttatgttactatatcacaaatgtgattatcggttgataactgtattttagtacaatgattgtttttgcaatcctatgtgttctattttatgtgtatatttaaaaacattctgcaaaggggtcctttagacttcactggagtgccagagagattcatggtacaaaaaggagttaagacctttcatagtcaagtcctccaaaacaaagatactattcctcctctttgggtgtgtaaagatgtgtgtgtgtgtggtccacacactggtctaatttcctaaatcgtacgatagaactctgtgtgccaggtgacaagagtagagtcacctacagcctcgggaggaggagctgtgaaggaagtttgctcagagaaggtaccatctgtgccctaatgacaccttctagtgtctgcaacatttatctaacaaatatttgggtgctcttctgttgccattatctttaggcattgggcaatctgcagtgaacaaaaaggctagaaaccatgtccttgaggggtcaattcctagtggggcttggtggcttttctattcctctatgaggtcttctctgattagtcatgttctgtactcatggaaacatcctgagtttgtaaagcagaaatataagtacaggtgatacagttgtgtcttgtttctgtttgtttcacctccccaaccagacatcaggtttacgtgtaaacgatctatttacctctgttttgccattcctgaaaagagagatcatgtgcataaggagttaaacagaataagataacgtttttgtaaagtagttagaatagtgcctggcacataaaaacagtacatgagtatttttattatgattttaccaatcctaaatgcaaatgacttcttatttaaagaaagaaaagagaagagaggaagggactcaaccaggagccaggggtccttgttcccccaggtgactggaactagagtgaaataccaagttgacctgggagggcctagacatgccggaacttaccaaaagtccggtggagattctctgaaagagaaacaaatggaaatggatttagtagggcactcaaaaaggatcttttatcctgagtctttgttatttaattacttaaaacttgttctaggcacgacacacccactgtagagaaagggaaactgaggggaaaacagggtattgagagggagagacggtccaagaacgggaccatttccgttatgccaaaaaaccaaaaggcaagaattgggagaaacgatgactggaactcacctatctctgctcgaagttttcctaaaatagaaaaaggcaacattttagttcctgcatgttctggctctcggtggggaccctcccacacccagcgcctgggccccttgtgcaggctatttctctgcagcctggaaacaacctcaggagagtaggaagagcactggatttaaagccaatggttgcggctctttctctagctatagtctagatacaatagcgaataaagaatgtgagcaatgctccaagccagcacaagcatccaatacatcccagctgctcttcgccccttttcttggattctcagttcacagagctgctccagcccactgcgttgccactttgtttatctaaagccacttcccatctgaatgaggagggaggagctgaacatttagtgagtagctagctactttgtgactggatttgtagtaggcactttgcatgactttaatcctccctacaatttaggacgaaggatgttttctctatttgacagacaaggcaactgaagcttggagaatctaagaattttgctatagagttcagtacctgagatggaattcaaacccaggctgcctgactctaacattcagattctttctgctcagccatgagggctgaaggcctttttttgtgtggaagaagtaaacaagcaggcatctgggatgaattcaaggtgagagaaaggactttgttgttgatcgcaccaacacccattcccccagaacattccccataccctccttgctactttctcctctcctcttagtaacaaatgggaggtggggcatggggaggagtgaagactcttcctgctctggcattggggagacacttggtaggaggagaaggctcagaatgaaagctctaggcaaaaaagaggagcttcatcagcagctgaacctgagtcctcagtgttgaatggagaaagaggaaacaattttcgaacgcctactgtgtggtagagactttcacttcagtatctttattcaaaactcctaatagcctagacctgtctgacttcgaagctcacactctcccaagttgcatggagctgctaggtatgatacagaggcctcagctctaccacttataagttatatcggtttgagtaagtcactgaactactcctggcctcagttgtatcctctgtaaaatggggttactatatggcatagttag

SEQ ID NO: 10707 - DNA, 17088 bp, Homo sapiens
gttgacacctccagaaaacatccaaacctgaagtggcactaaacaaccaagcagacaaattgaagttagccagccctcaccatcgggcagcccaggcctggcaggatgagttcatgaatggagcaagcacagtggcaggaatgaggctaaatatgggtccagaagcactgactaccacctaccaagacagatccagctgctgccacctctgaatgtccaactcattagcatttgaggccaatgatgtgcctcagtggggctatatttctttaggtgactaaagcaacactcgctgctaagtgattagttgagccacttccattctggaagggccagaggttcatctttacagggttaggcaccattccatgagtgggttttcctgtcctgctctcagaccctcagtcagcaccactctccagggactgttgacattcctgattcacaggcatggcattgctcttagcacactgtcttcctggtggaacccacttgacagggaagcaggtgcagcattttcatggccatgggatccactggttctatcaccatctgcaccacccagggtctgccagccactaagaatgctggacaggtcttctacaggcacaactcagtgccagcctggaggaagcactctgaggggtgggtgctgtctttcaggacatggtgcatttattaaatcagagacatctctacagtgccgtgttctcagtaggaagaacatgtgggtccagaaactaaggagtgaaagtgggtatggctccatgtctcattccttagattcacctgctgtgggattttgcacttctcatctcccaaacctgtgctctgcagggtagaaggtcctggattctaaaggaaggtactcttaaatcaggacaaatgagagcctactgaagaacacattactattgcccccagagagatttggacagtatgtgcccagagaccagcaagtgaggagtcccctcctctccaggcacaggtaatagatcctaatctccaggaggaggttgggctgctgtcacaatgagggcaggaggaatgtgtgtggaacccagtgatccacttgaggggtctcctggttccccttgtcccattgtaagtgttagtggaattgtccagcaaccaatcctgagggaatttgatttccaagggcccagaaacctcaggaaggaagatttgaaccatgctcccagataatctcccaaggccctgctcctgtgctctgacatcctcagcagcattggtgcagacaccctgcttcccatgggctgttcccaaccagtgatgggtgacaagagggacactaagggaggcctatgtctggaagacaagggccaactgtggctagaggactcctctatggccttgctcaactctccttagattgcctgtggtctaggatgtgtccaacaaacctcctctcctgtccctcacttgggggtcacgcttgcatctcagtctgctgtctctcccagggtttcctggatcttttcccatattttctggcaggtgagtcctctaataaaatactgcaactttaatctcatgtcatctgcttcttggagaacatggaccaacaaaatcatttccatttacacaccagtgacctcttacttttccagtttgtaaaatcctttttattatccaacttcttccacctgctccagttttgctggtatttgtgttgttttctttgagtaaattgatgttcactgttttaagtcactaagtcttggggtagtttgttacacagcaacagatagctaataaacctctcttatgtttcgattattccatagtggttatctacatctgatttatttccttctatttttataatattatccatacataatgtttcccgtttctctccacctattctcttcttgatttttcttttccttcccaccattttttcctacttctcatgaaatattcctaacatataaaataaccctatgtggttatgatataaggaagcattttctgaatctgtatgttaaaagtttaatgccacagtgtatgggatacaagtaaagaacaggaagttattaacagagtctgagtaaaaagtgcctggtgtaattctgcggccaagacagtgactttgaactcttacaggctgatgcaaaaataattgcagtttttgccattacaataattcttaccaagaactattcacattggaccaaagccaattgtaatgatccatgtgatggagagagccagaatgctatgaaagtggccttgaccagaaataggtcatttgatccttggctcattgacatctccatagattttcggtgtacaatgttcggtctgatgtgcaaggtaattccatcttgcaaaggattcgatgttacattctaccacacacacacctgaattaaacttttacagaattggaaatgcacattactgatcaaaataaattaaacaggaaaaaattatataggaataaccagtgatagaatagcaaataggaatggaaaacacaataggattgcttaaaaaatactgtagaagtacagaatagcagtgctatttagaatcatagtgatgtccaaatcatgtctaccacgtctcattaaaaaccagagcgaaagatgtcaagtttattatggaatgcccacccagtagccagtttttggaaaatcttgttcctaagttggagctaagcattttgggctactgtatccaaccaaagttactgacatcatgctaagctagatgtgttggctgaggtatgagattcacattttttctaccttaaaagcaatctgatttggcaaatatttttaaagatgatatttgaatgagaaaattggcatttgggacattcttaaactaaatttgagacatcttaggcaaaacaaatacttatttttaaggcactattgttatggcactgaagtcttggaactatttgatctagttactgtaagttctcagctgtgttgcaactcattaaagagaatattgttattaaaggtatttgcaagaaaaacttagagatactatagtatctcctttctctgtctcaaacttttttcccctcaatacccaaggctctgtgatgtctcaaattttaatcattactttaaaaagagaagtttaaagcattaaagaattataatcagatgaaagcagctttggatttataaaattctgaaacaataattgcttaattttgcttttaacatatatgcaaattctttgatactctccactttgcagaggtgcaggttcattccctccctgtgagtgtggcctggacttaatgattcacttctatctgatggagtgactgttggtgtagaacaaaaaacttaccgtagcttctacctttgctctctctgtctctgggatcatgaactctgggggaagccagctgctgtgtcataagcagacctgtggaaaggtccatgtggctaggaccgaggcctcccgggaccagacaacaaggaactgaggccttttccaatagccatgtgagtgagccatttttcatgcaaatccccagcccagttgagccctcagatgatgcagccctggctgacaactggactgcaaccttgtgagaggccctgagccagaaacactcagggaaacctctcctggattcctgagcattggaaactgtgggagatgataaatatttgttgctttgagctgttacattttcagtaatttgtaatgtaacagtaaaaaaaaatacagcttcacaagagaggatgaatagttgcactttaattttcatttgctctaaatttattagtgttattgttatcatcattattattgagacagggtcttgctctgtcactcaggctgcagtgctgtggcaggaggacagctcactgcagcctcgacctcctaggctcatgtgatcttcccacctcagctgtctgagtagctgggagtacagacatgcaccaccatgcctggctaaaatttttgtatttttggtagagacaagggttttgccatgctgcctaggctgatctcgaactcatgaaatcaagctctctgcctgactccayctccaaaagtgctgggattacaggcatgagccaccaccacacccaacctaaattaattataaaatattaaacatgtcatttggttttaagaggtaagaggaatttccatggctaaataggatgtattttattatcattcacaattattgctttatttgaacttcaatttccacctgtgtcccaattaaactcaaaagaaagacccaagccttgctaggctgattctatcatcccccccatgatagacgtgtaaccttggtcattcacctgaccccagttattcaaccaacaataatgtaagtcctgccttgaagggatttttgcatatataattaaggtcctaaatcaattgactttaagacagggattatccctggtcgggctgtcctcatctggcgagcccctgaaaggactgggttcttcctgatcagagagattcacagtgtgagagggattcagtgtgagggggttcctccaatgtggattctaaaaatgaaggggctgtgtggcaaagaatgctggtgggcaccaggaattgagagcagcctctctctaccttgacagtaggcaaggaacaggaaccttagtcctacaactggcagaaactgaattatgtcgcctctgtataagcctgaaggaggccctcaaaatgaaaacacagttttgggaaaccctaaacagagaaccctccaatcatgctcagatttctgactaaggaactgtaaataaataaataagtgttgtttggtcaagcgtggtagctcatgcctgtaatcctaaggtttgtgggaatgacacaggaggattacttgcagccaggagtgagactagcctgggcaatttgaggagaccttcctctctacaaaaaggaattttttttttttttaatttacctgagcacggtggtacttgcctgtagtcccaggtactccagacactgaggcagggggacctctagaggccaggagtttgaggttgcagggaaccatgatcatgcaactgcacttcaccgtggataacagagggagaccatgtctctaaaaataaataaataaatacaataaatgggtgttgtttaaagccagtgtttgtggtaatttgttatgcagtcatacaaaagtcatacacagactcaacagacacatggaatgaatttataaattgataagcacactacatgagtaaaataaaatatttcctttttccagtatttttcattttataatattccatgatgcgattaaatttttatacaatcatatttcattcaactagacaacaaaaattaatttagtgcctatgctgaaccaggtatgccctcatatgctcaagtgcctgacattctagaagcttcacaagaccgaagtggagccactggagtgttttaggtgaagaaacgacacactttgactcacagtagcaggaccactgtggagagaacactcaggtggcaggtaatggaacagtgctagagccactattcaggagtgacagagtggtggggactaagggaagaggagggcctgagggatgagagggacggagggaagggctggagaagcaggaggtgaggagaaggagcagagggacagaatttgaaagcagcagaattcttagctttaaacacattgttttataaatttttaatacatccatctacagagcctagcagggtgttccttgcatttggcctttaacaccttatgtgggactgcctaaaaattaattgctttttctgctttttttcaggtttaaaaaaatactaagtgttccaataaaacatgcacaccacttagatgcggatacttcctaaaaacaggaagtgcatgagcactggtgaggggcattgtgactgcgttgaacacttgcaactttgaggtgaatgaatgtattggctcctggttgcaatatacaatcacacgttgtgctactttgtattgtcaggagatgtcctggactcccacagaaactcagggctatggaatgaaggtaattttagaatacaacaagagtcacagatacatagtctgggaaagcaaaacttaggagctctgagagttgtacaactgtaatgcatttagacacatttatatatcaaggggccaaagtaacagtttttacacataagattcctgattggtcgggcgcggtggctcatgcctgtaatcgcagcactttgggaggccgaggcgggaggatcacgaggtcaggagatcgagaccatcctggctaacacggtgaaacccgtctctacaaaaaaattagccgggcgtggtggcgggcatctgtagtctcagctactcgggaggctgaagcagaagaatggcgtgaacccgggacgcagagcttgcagtgagccgagatcgcgccactgcactccagcctgggcggcagagagagactccgtctcaaaaaaaaaaaaaaaaaaaaaaaaaaggttcctgataattcaggggttaccaagattctactactcactgcagctaataaaaaaaaaaaaagaaagaaagaaactggtctctgtcctatttcatatgctcaggtacaacttttccagagaagaagaggaggggggcggggaggagcaggaggaggaggaaagaaggaggagaaggagaaggagaaggagaaggagaggaagaggaagaggaagaggaagaagaagaagaagaagaagaagaagaagaagaagaagaagaagaagaagaagaagaagaagaagaagaagaagaagaagaagaagaagaagaagaaaaggaagaagaagaaactgtctctacaccttcattctcaggacaagttcattgtctggcaccaagctccttggggtgaattttcttccaaaagagtccggggagtccaggtatggaatgggaggcagaaagttcaatcaagggactgggatttcggaatgaataatgaagggagatggactgggtccatgccgaaggtttctccctggtttctcagcccccgggcgaagactcagggagacattgagacacaccctgcacaggagggggagggggagggggagggcaaagtcccagggccccaggagtggctctcaagggctcaggccccgaggcggtgtctggggttggraggctcagtattgagaattccccatctccccagagtttctctttctctcccaacccgtgtcaggtccttcwtcctggwtactcataacgcggccccatttctcactcccattgggcgtcgsgtttctagagaagccaatcagtgtcgccgcagttcccaggttctaaagtcccacgcaccccgcgggactcatatttttcccagacgcggaggttggggtcatggcgccccgaagcctcctcctgctgctctcaggggycctggccctgaccgatacttgggcrggtgagtgcggggtccagagagaaacggcctctgtggggaggagtgaggggcccgcccggtgggggcgcaggactcagggagccgcsyccggaggagggtctggcgggtctcagcccctcctcgcccccaggctcccactcmttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctggtgagtgamcccggccgggggcgcaggtcacgaccacccsccatccgccacggaccgcccgggtccctcagagtctccggatccgaaatctaccccgaggcagcgggacccgcccagaccctccacccgggagagtcccaggcgcctttacccaggttcattttcagtttaggccaaaatccccgcgggttgggcggggagggggcggggctagctgggcggggctgactgcggggaccggctagggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcaggtaccaggggccatgggcgccttccctatctcctgtagatctcttgggatggcctcgcacaaggttgggaggaaagtggrcccaatgctaggatatcgccctccctctagtcctgagtaggaagaatcttcctggctttcgagatccggtaccagagagtgactgtgagagtccgccctgctctctgggacaattaagggatgaaatttctgagggaatggagggaagacagtccctggaataccgatccgcggtcccctttgagccctccaacagccttgggccccgtgacttttctctcaagttttgttctctgcctcacactcaatgtgtttgrggctctgattccagtccctcggcctccacttaggtcagggccagaagtccctgctcccccstcagagactckaactttccaaggaataggagattttcccaggtgtctgtgtccaggctggtgtctgggttctgtgctcccttccccaccccaggtgtcctgtccaktctcaggttggtcacatgggtgctgctggggtttcccatgaggagtgcaaagtgcctgaattttctgactcttctcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgcctyctggagaggaacagagatacacatgccatgtgcagcacgaggggctgccccagcccctcatcctgagatggggtaaggagggagatgggtaaagaggggaaygaggggtcatgtcttttctcagggaaagcaggagcccttctggagctcttcagcagggtcagggctgagrccyggagatcagggcccctcaycttcccttcctttcccagagcagtctccccagcccaccatccccatcgtgggcatcgttgctggccttgttgtccttggagctgtggtcactggagctgtggtcgctgctgtgatgtggaggaagaagagctcaggtaggaaggggtgaggagtggagtctgagttttcttgtcccactgggggttgcaagccccaagtagaagtgtgccctgcctcattactgggaagcaccatccacactcatgggtctacccagcctgggccctgtgtgccagcacctactcatttgtaaagctcctgtgaaaatgaaggacagattcttcacttcgatgattatggtggtgatgggacctgatcccagcagtcacaaatcacaggggaaggtccctgctgatgacagacctcaggagggcagttggtccaggacccacatctgctttcttcatatttcttgatcctgccctggatctacagttacacttttctggaaacttctctgggatcaaagactaggggtttgctctaggaccttatggccctgcctcctttctggcctctcacaggacattttcttcccatagatagaaacagagggagctactctcaggctgcaggtaagatgaaggaggctgatccctgagattgttgggatattgtggtcaggagcctatgagggagctcacccaccccacagttcctctagccacatctgtgggctctgaccaggtcctrtttttgttctaccccaatcactgacagtgcycagggctctggggtgtctctcacagctaataaaggtgacactccagggcaggggccctgatgtgagtggggtgttgggggggaacagaggggactcagctgtgctattgggtttctttgacttggatgtcttgagcatgaaatgggctatttagagtgttacctctcactgtgactgatacgaatttgttcatgaatattttctctatagtgtgagacagcttccttgtgtgggactgagaagcaagatatcaatgtagcagaattgcacttgtgcctcacgaacatacataaattttaaaaataaagaataaaaatatatctttttatagatacaggtagatatgtttttatagcatgcacgtaaatgtgkgtgtgtgtgtgtgtgtgtgaagagaaagagtgaatagagagattaagattcttttaatggtgaaaagatatacatatatttggaattagccagcttgactcagtttaggtgatcccaattttggtggcaacaaccaaagcatcgtagtcaggagccagtcgaacatatgccttcctctctccatcagactgaatcagagtgttgactttggccacatcaatgtcacaaacttcttcacagcctgtttgatctggtgcttgttggctttaacatccacagtgaacacaagtaggctgttgttttctatcttcttcacagcctactcagtggtcagcggaawcttgatgataacatggtggtcaagcttatttctcctgggggtgctcttccaaggatatttgggctgcctccggagtcacagtgtcttgggccgccrgaaggtgggtgacatgtggatcttgttttttttgtggctgtggacatctttcaacactgccttcttggccttgcaaagccttygctttggcttcggctttaggaggggcaggagcttccttcttcgttcttggcaccatcttatgaaaagggtccagattaagatttttgactgagtcattctaaagtaagttgcaagacccatgatactagaccactaaatacttcatcacacacctcctaagaataagaaccaacattatcacaccaaagaaaataaataattccataatattatttaaagtccttttatgttcaaatatctccacttctttcagtacatttttgtacctattttttatagcttgttttcttaaaatgtccactcgttgcctttggttatgtttctttaattacctacaatctataacaatcaacccatcttttttcttttagaatggcattacctgtttcagagatgaggccaaatacctgtggaatcttctccacactgaatttatcatattatttcccctgatgcctttaacttttttcctctaactgctatgcctcctaaggacctatgtagctctgggttaaacatttggcagcaatgtttacaggaggagctgtgaccgcacattcatcacatcaggaggcacacaaagcctagggttaccaggactctttctgaccccatacagccaaatttatcctgacttcccagagatgcagaaccatgggctgggtgtttagtgggtatgagtgtgatattctggcaataggaggttctgccactctccccattcctcacgagctttagttccccataccctgaggttctgagctccagaccttcaaccatcaggccaggcccctccagacctagactcccttcctgtcttctccagccccactctgctttgtatctacttcyggatcactttccctctacaggcccagctcctgagtgtctctacctctcaaacaagtattctcatccaggagcaattttcccaccagaggacattagctatgtctggaaaaatgttttgttgccatgactggagtgaggaggaggtgctaccagcatcttgtggggaatgaccagggatgctgaacatcctgcagtgcacaagtcagcccaatcacccacataacagataattatccagccccaataccaagattgccaagggtaaggaggcctgccaggactttctctcccttgagtacaagcttccttgaactgagggacaccctgaaggaaaagtgtggtcccaccccagtcatctctcccttccctggagctccatctgtatgcctgtagtgcttaggcctgtaacctggggtccaggaacccaccttcccatgagactgcatgcagaagtgatgatatgtgcacacatgacttcattacagggcattggatgttgatattcatcaggtcagctggggcccaagacactactcttctgccaacaggccgcaatcctctgcattagagagagggtaaagattgagggaggccctaacttcaaaccttctatcactgctagtgaagtgccaaaaagaagtgcaaggtcatctgcccttgtaggaaccacacaggaaggcagagtgtccaccaatgtcaaattccatcaaagaaataatattttgacaaaaaatgcaagtcacctttctaagtcccagacagcagctcaaaataaaaagcattaaacccctcaaatcttagaccaggtgaaattattgaagctgcagtaaggtcttgtgggacctgcagttagagagaagggacaactcaatttgggactgcagcagaaacccctacatcatggggttcctggaagggaccctctcccttcagcgacgcaytgtgaggccatttctaggtaaaaaggtagaatttccttggattcctgaggtttattttacacttactgcttattctttgactttatagaagccaacttcagtttgaacatcttgcaattaattttttttggctctaagtggagaatttgaacttgtttctgaagaaaaccaggggctccttatgtgagcaagcaaccctccctgtggcccccttatgcaataaacataagccattgtgagccagcaaaatttaaagcaaggaaagcagtaaaccctccatttcagcatgtttcagcctgtctagtgatgttctagtcttgcctcactcttaacattttaaaatttataattttatttgattttgatttaataagaattcatatgtattcatttcttttgggtttgtcaccaaaagcctcctccaatcacctgtggagtaaagacaagtaaataaatgcatggtgttcccatttatcagtgctcactgcatcttacaagtgtatcagccccacttcagctgatagtaccaggaaaccttaatacccacatacaaaataatgatgttggacaaaattcatagcatcaccttacaccatattcaaaaattaactcaattaactcagaatggttcaaggaactcaacttaggagttcaacctataaatcttttagaagaaaacattgaagaaaatcttaggaacattggatgtggcaatggcttcttggctggtgagcaaaagcacaaccaataaaagaaaaacaataaattagactatcaaaatttaaaaaccttttttatatatcaagggacactattaagagagttaaaagaaaatgcacagaatgggaggaaatatttgccarttatatacctgataaagaattaatatccagaatacataaagaactatgacttaacaacagaaaaacaaacaatctcattcaaaaatgagtgaacaacatgaatagacaattctccaaagaagatatacaaatgggcaataggcacatgaaaatatgctgaacttcactagtccaagtgttggcgaagatgtggagaagtcacaacacttgtacactgctggtgagagtgtacagtggtacagcgaccatgaaaaacagtatgatgcttcctcaagaaagtaaaaacacaatttccataggagccaacaattccacttttgggcatatacccaaaagaattgaaagcaggaactcacacagataattgtacactcatgctcgtagcagcactattcccaatggccaaaaggtggaagcaaccgagtgtccatcggaggatgattagataaacgacccatggtgcacatagcatggaatattattcagccttaaaagtgaatgaaattcaggttggatgaaccttgagaacactataagtgaaatgagccagaaacaaaaagacaaatataatatttcacttatgtgatgcagctaaaataggcaaattcatagaaacagagagtaaaatagaatttaccagaaattgagggtagggagaatgggcagctttggtttaatgggtccagtttctgttgggatgatgaaaatgttctggaaatgcatattggtggtggttacacaacattgtaaatgtgctttaggccaccgaattgtacactgaaaaagtggttagaaggtaaattacatggtatgtatgttttaccacaatattaacaagtatatcaacactaaatccaatcacttttcactcctctcctgccaccacccgagagccaccctctcaagaattgtaaaccagaagggctttccagctgggctgcctgctgcctctcatgcccactgtccattactcacacaaaggcagagtgagcctctcaaacgaaaattaggacatatcctatgaacacctcagcccttttctttcctaggcacaatgaaacctcagtctctcaccgtttcctacaagcccctcatcataggacccctgtggcctcatcccgccattctcagcccagctcactcatctccactcacaccagccttttgtcactgctccatcctgtctctgctacctgcccctgctgtgactcccacatgcacctgctccccgggggtccacatggctcactcctcacaccattcgagtctctgttcaaatgtcccatggtcaagttctcagaaacgtcatgcccagttaccttttctgaaatctattccctgccattcccgccactcccaccaatcttctagcctaggtgtattttttatcagtggcaattatcactgatactgtgacagattctatttgtttattgtctgttggtgtatcagggttaccaagacagaaagacccaatagagtagatggatagatagatagatagatagatagatagatagatagacaagaggggatttattagtggaaatggctcacatagttatggaggctgataagatccatgagaggccacctgcaagctggagaaccaaggaagacagtagcctggctcagtccaaggccaaaggcctgaggggccagaggaggaggtgggaggataaagggttgactggtgcaacactcaagagtccaaagaccatacaacctggagttctgatgtccaagggcaggaaaagtgtcccagattgagagagagagagagagaaaatttgactcctttctgcttttttgttctatctgggcccctaggtgattggattgtggctgcccacagcgagagaggattttccccgctcagtcactcacatgccaatcccttccagaaacaccctcgcaggcacacccagaaataatgttataccagctatctaggcatcccttaacccagtcaatatgacacctaaaattaaccattacagtcagtatcactgaaatgtatgttctttgataaagggatctggtctgtttccttaccattgtttctcaccatcataatcagtaaatagctctcagtaagtatttgttaaatgaataaatatgtcagtacaatcacagtatgacagtataataaggctttaaaatgtttaaagcagtctctggtttaatatttatcacttgagtagtctatgaatttatttatttttggagacaaattctcactctgtagcccggtctggagggcagtggcatgatcacagctcacttcagcctcaaccttccaggctcgaacaatcttcccacctcaaacactggggtacctaggactacaggctcatgccaccatgcccagctaatttttttttgtattttttgtagagacaggattttgccatgttgcccaggctggtcttgaacttctgggctcagacaatccaccctccttggccttccaatgtgttgagattacaggcttgaggcaccgcacctggcctgagtagtctatgaatttttaaaatcccaaccacaggagaatctttatgtacaaacatgcttgtcaaaatattacctacaaaaagataagatgaaagcagatggatctaaaagaactcagttacatcacctccttatctgagatgggatgcagcttgtaaaagtgtgtcaactttttaaatttaaaaatttttttagatggagtctcattctgtcacccaggctggagtacagtggcagtgatctcggctcactgcaacatctgcctcctgggttcaagcaattctcctggctcagcatcctgagtagctgggactacaggcacatgcctagactcctggctaattttttgtattttttagtacagatggggtttcaccatgttggccagtctggtctcgaattcctgacctcaagtgatccacccacctcggcctcccaaagtgctgggattataggcgtgagccaccatgccggccaaaaaagcatgtaaactttatacagagtttacaacatggaaaactacttgtataataatacattcaaaaagcaacattcaagataacccatgacatatgaatgcaaccttgtacaataaagatacctataaaaatatatacatagagaacaacaaaatgggccaggcgccttggctcattcctgtaatcccagcactttgagaagctgaggcaggtggatcacttgaggtcgggagttcgagaccagactggccaatatggcaaaaccctgtctctactaaaaatacaaaaaatttgctgggcctggtggcgcatgcgtgtaatctcagctactcaggaggctgaggcatggaaatcacttgaacccgagaggcggaggttgcagtgagctgaggtcgcaccactgcactccagcctcagtgacaaagtgaaattgtgtttca

SEQ ID NO: 10708 - DNA, 27562 bp, Homo sapiens
tttgttctctacatttttccatatcgtttctaatttttctacactgtatgtgttacttaaagaaataaaccagtaggccaggcgcggtggctcacgcctgtaatcccagcactttgggaggccgaggcgggcggatcacgaggtcaggagatcgagaccatcctggctaatacggtgaaaccccgtctctactaaaaaaatacaaaaaattagccaggcatggtgacgcacccctgtaatcccagctactcaggaggctgaggcaggagaatggcgtgaacccgggaggcggagcttgcagtgagccgagatcgtgtcactgcactccagactgggcgacagagcaagactctgtctcaaaaaaaaaaaaaaaaagaaaaagaaataaaccagtatggccgggcgcggtggctcatgcctgcaatcccagcactttgggaggacgaggcgggtggatcacgaggtcaggaaatcgagcccatcctgaccaatatggtgaaacctcgtctctactaaaatacaaaaaattagccgggcgtggtggcgggtgcctgtagtcccagctacaaaggagggtgaggcaggagaatcccttgaacccgggaggtggaggttgcagtgagccaagatcgtgccattgcactccagcctgggcaacaagagcgaaactccgtctcaaaaaaaaaaaagaaagaaaagaaaaagaaataaagcagtatgaaagagcagcccctggctgcattcaccacagcacccatgctcacacatgctacaggcgctcacttgctgggagctgcctcacattgattcggatcagtgttctcatttctccgacctacctaggaagcatctggctaaattgatgtaaattagacattttatagtctatcggtcattgagcctcagtggaatatctagaccaatttaaacacacaaatattatgggaaatagggccacaaaagtagaaaagaaaacgtgaattcctctttatatttatgccactagagggagttccagaagaaaatcactgcatgtaagggctaatgactgtatttactgagtggttactgtgtaccattcacagttcacagggactcattcatgtcattctcatgataaccctgatgaagtggatgatattattccctcactcactaaggagaaagccagggtacagtgaagtatacaactttgtgcagggcaatttatcaatatttattgaaattaccaaaaaacatgctctctgaacaaactattctaccagtgtagaaagcagagtaaacttcatgggtgagtgaccagggcagtcacacaagggccccatgcttagaagggatactgtgtttgggttctaaagctctgtggttcctgtcttgaaattcttaataattttatctttcaatttgtgtcttataatgaagtccgatgagaaagcagaacatgggctagagacttttggagcctggctcaagcgaggtcctgctccccatgcctcccagcctccccaggactggttttcagctgccggctccaccaccttctgtgcaggctcgctcccagcaggggcctgggaacagtggaaaggaggggagcggtcaggcatacacacctcccttgccaaatggaaggcatggccctaggcacttgtgaagatctgcacttccccctaggtactcctgtgcctggagtgtgacattaaattaaaaaaaaaaaggccgggcgcggtggctcacgcctgtaatcccaccattatgggaggccaaggcaggcggatcacgaggtcaggcgatcgagaccatcctggctaacacggtgaaaccccgtctccactaaaaatacaaaaaaattatctgggcatggtggcgagcgcctgtagtcccagctacttgggaggctgagacaggagaatggcttgaacccgggaggcggaggttgcagtgaaccgagattgcgccactgcactccagcctgggcgacagagcgagactccgtctcaaaaaaaaaaaaaaaaaagaaaagaaaaaaaccccacataataggttgacagtggaaccacagaaaaaaggaaaaggttgggttttttttctgctttttattttctattttattattttttaatagatttatttaactagagatggggtctcactatgttgtaaaggctggactcgagaccctgggcccgagcgatcctccaacctggtcctcccaaagtgatgggattacaggcgtgagccactgcacctggtcttttcctgctattaaacaaggagctccatagtttcattttgcccctcaaaatatgtagctggccttagtagactgatattcattgccaaattatatgtaagagcaaaaaggttgaaaatgatggcctgacattgatcaatttgtgcctttaggtaacatataactgtaatataactgcaatacaactagaatataactcataaaggcaagaatcttgtctgccttgctgaaagttttataatcagggcctaatataaagtatgacacatagcacttgcttttaaatatgtattgatttaaattaattgagtacatttttgcttcatcctagtaaaaataggtatttaaaaaactgaaacagtctaaatgtcttgggatgctacttaaataactatattatattcatccaataaaatattgtaagctgtttaaaaataacaaggatgttctttaggtactgataaggaaagagcttcaagataaattgttaccatttatgtaaaacaggtgggagaagggagagggagggatgtgtgagcgctacttgcagtactcacaggcagtgactttcgtggagcgccctctagtggtatatatatacaaacggaaggatttagagaaaatacagatcggctttagctggctgagatttattttcaaagcatgttactttataagaatcaatttttatttaaaaaatttttttgagatagggtctcactctgtcgcacaggttggagtgcagcagcacgatcagtgctcactgcagcctctctctcttgggctcaacaggtgcatgtcaccacgtccagctaacaatcaattttcaaaagtacaaaaaagccatattatgtattaatgtggaattatgaattaagtagacaacaagaatcaaaacagggtgtctattatcacttctgataacataaataatgtaaagatacatattttacagattatctgtaaaagcttatacagtactgttgctgggtatttatgtaggaaagctaccatttattgaatgcttactatttcacatatggacagcatagagcatgttaaaaaattaccacacacatttactgtattcaatgtgtcactctgaatatattactgtgtacatggtctgtcattggacatggtgagagatgcagattaagctgaaattactgaggacagcaacactggaagaaaattgagctgggtgtagtggctcagcctgtaattccaacatttcagaaggctgaggcaggaggatcacttgagtccaggagtttgagaccaagggaaagaaaagaaaagaagctttcatttagccaggcatgctggcacatacctgtagtttcagctactcaggaggttgaggcataaggttcacttaaacttgagaggtaaaggctgcagtgagccctgatcacgccactgctctccagcctgtgacagagagagaccctgtctcaaaaacgagaaagaaagaaaaaaagaggcaactcaagaactcaggaatacttgcaggatctcataacatatgctatacaaaatcaattaaaataatatttaaatgctgaaagaaatgagcagctcccagggtgatacagggtggtttcacttcttggacacatctacactgagctctattcctggcaatacctgatgttcccataccccagatttctttattttattttgagacggagttttgctcttcttgcccaggctggagtgcaatggcgggatcttggctcaccgcaatctccgcctcctgggttcaagggattaccctgcctcagcctcccgagtagctgggattacaggcgcacgccaccatgcccagctaatttttgtatttttagtagaggcagggtttctccatgttggtcaggctggtcttgaactcccaacctcaggtaatctgcccgcttcggcctcccaaagtgctgggattacaggcgtgagcgggcccagcccctataccccagatttctgcaagtggcaacaccactggcttcattttgctggtggcccctctggccttcccttgtatatatcacctttgcccaaagaccatgtcagccaagggactgctctcacagctccaggaatcctcccctttcaggaaatttgaggcagttgagggcatgaaagtaaataagctgagctcatcagaggccttgtattgtggtggttaaaagagccagttctaggactagaaagcctggcttgaaatcccagctctgccactccctagtggtgtgactttagcaagttcctttacctcttttgtacctcccttttctcacctgtaagatatgggtgataatagtttaatatttgttttgttgttgtgaggattaaaggtgttaatgcaagtaaaccacttagaaccacagcacatagaatatctcagtaaggtggttagttttttttattgttgttttcagagatgctgtgatttctccaaagtggctgtgatggctcggcaggctcctgaccctctctgctcccacatgcctccaccctcatcctgatctcccatccagcttttgacagcttgcttggtgctggacaattgcacacatcttaccacccccaaatcctgcccagaagcatcttgtgcataactctcctacctgaatatgcaacagggagaaagagcgtcccaggacattttaggtttttgaagaaaaaaaaacccctttggtaaaaagccagagatccacagcggccactttttccatgggattgacccctgcaatcttgactttcaaccacacagcaccagagtagccaaacattgcttgtgtccaaacgctggctgccttgaagggtgaaagaataagcagttcccaaactcagctgaccttaatgtccttctagctccttacgcccatctcggacaaaagcagaaatgtatgtctcagttgtgtttctaccccttgctgcccaatataaatttttgtgttgcccaatataattttttgtgacgatggaaatgttctgtatttgtgttgtctgatgagataaccactaactgtagtgctattgagcatttgaaacatggctagtgtaatcaatgaaccaaatttttaattttatttaattgtaattaattttaagtggccacatgcagggagtgactgctgcattggacagcacggctctaaattgagccttttttccttatttggtgaggcatacttgccttaagattgggaagtctatttttggaacctgctaccaatgctggtctcacacttgcaattctcagctgagccaagaggtgagagaaaggtcattttccattccagatctcactctcccctgtgacactgaggaaactggcaagtgatgtgaaggctggagagcgtgtcctgtatgctggctctgtcccttctgcctgtgttgactgacatagttagttgctgcccttgctggtctcccttcctccaaccttgcctctctgagcacacctgacattcatctcatgacttccctaaaaacattctttgggaacaagaaactaacaaatcccaagtgacctatcacatatacaaacatacagggcagagtttggattcgcggtagaagaaagggaggttagacattaagaagaatggtctggtgatgacagttgtgagataatagaaacaggaaaaagaaatctaagttttctttctttttttaagaaccaataataatttctctcttttgactagtcagtagggctggggtggattggaggaagcttacatattccatgaacaagcctcttcctaaggtcctgtaagtgatcctgccccactgattagcccctagaagacccttcaaaggttggatctccaggagggagtgggggaggaaagccctgtaccaggcagcctctgctccattgctctgggggggtggggaaggcaaaccctggtcatcccctcagtctgtagcccttttgtgtgagtgcctggcaagggtgacgtggggctgtttctgcgggcacagctgcagcaattaccggagtggaggcagggcccaggcagcactgccctccaagatcttccctygggcttttcagcagtaaggggacatgcaccccaagggcctccacttggcctgaccttgctgcgggggctctctgtccccaggaacagtagagatggcaagcttatcragaccctctctgcccagctgcctctgctccttcctcctcctcctcctcctccaagtgtcttccagctatgcaggtaagacatgttttttttcctgccctggggagaccctgaaaacagaaaggctrgtttcctggggcttagctccttcaaacatcctcaagttgctatattatctttctaaaacatagacctrctgacatgcctcccttcctcagaaaccttccgtgggtggttcttacagccttcaagatggagtccagactcttttttttttttgagacagagtctccctctgttgctcaggctggagtgcagtggcatgatctcggctcactgcaacctcagcctccctggttcaagcgattctcctgacttggcctcccaagtagcggagactacaggcgcctgccaccacacccagctaaattttttcttttcttttttttttttttttttttgtattttagtacagacggggtttcacatgttggccaggatggtctcgatctcttgacctgctgatccgcccgcctcrgcttcccaaagtactgggattatgggcgtgagccactgcactaggcctaatttttttatttttagtagagatggggtttcaccatgttggccaggctggtctggaacccctgacctcaagtggtctgccctcctcagcctcccaaagtgctgagattacaggcatgagccattgcgtctgacccagactccttaatgtgactaactcaaggctttccttgaactacttcttacttgtctttccagctttgtcttttcacctctcaaattgagataaaataataacaacctcttggagttctcatcaggattacatgaaatgagatatgtaacatgcttagcagtgcctgtccatagtaaatctcaataaatgtttgtggaattataatatcttgtcatgtttgagactttgctctgcataatcaggcaccagtaggtttttataaaggaacccggctgtcacgtgcagaggagaaataaacagaaagtttcccatcctcagggagccacctgactgacagaggcacagtgcatccactctccaggtctaggggagaaagcagccttatttcttagtagctcagaatctgacttgagaaacacatccacatagaaaaaaacaaggaactttttcgggtcagggtccgggagccacagtgaggtggaagatacaggggaaggaagagggaaatagagccatccccagggtggaagatctcagaagagaatttgggaaacaaggtatgaacaaggactgaatagtgagaagtgatggagagacagttaaagtagatggagtgacaaaagcaaaacctctaagggtagaataggcagcaatttggccaagtcctaacagggaggcccataggaggattcaacctcaagatgctgtgccacattccaagagggaacctaaaggctgggctgaagagtcagagatggctacagctggcaaaaagatgggcagatgctgagaggagatgattgctaaaatgttctgtccaggacattcacagtatctctataaccagagtcttttttgtcgttgttgttctcaagaaggaaacttgaggccgggtgtggtggtttatgcccataatcccagcgctttggggccaaggcaggcggatcacctgaggtcaggagttcgagaccagcctggccaacagtgtgaaacctcatctttactaaaaatacaaaaattagctggatgcggcggtaggtgcctgtaatgccagctactcgggaggctgaggcaggagaatcacttgaacctgggaggcggaggttgcagggaggcggaggttgcagtgagccaagattgcaccactgcactccagcctgggcgacagagagtaagactgtctcaaaaaataaatgaataaataaaaaggaagaagaagaagaagaacaattgcaatcctccctggctctagaatgtcatttaaaagtcgagtgtcttcttccttccctgttttgaagcagcccttctcatgacaggcttgcttgccaaggttccctctgaccttaaatctcttccttttggtgtcttggacagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaargatgctattggtgagggaaaggtgactctcaggatccggaatgtaaggttctcagatgaaggaggtttcacctgcttcttccgagatcattcttaccaagaggaggcagcaatggaattgaaagtagaaggtgagtagtgccatataatattaggtattwactgttgggtggccaagaacaattattctctcaactgagatgagatccctcaacccaaacatctcagtcctgggaatgatttccataaaaatgtacacatcaataaacagaaactcatgcttagggatgtctgttgcatcattattcagagtagcaaggaaattgggatcaaaatcaatgcctttgagtaggtaagtgacagaatgaacaatggtagccatactgtgaatattatgcaggcattaaaaagattattttagcactaggccagatggtttggaggccttctataaggtattattgagtgataagagcaagctgctgtaggatacaaaaacaaaaacaaaaccctagggcatggtggtttgcctcgcagctactcaggaggctgagacgggaggctggcttgagcccaggggtttgcagttacagtgagctatgattgcaccactgcactccaacccgggtgacagagcaaagaccttcacccccactccctacccgtctctaaaaaaaacaaaaacaaaaacaaaaaaacccttgggcccagcgccgtggctcacrcctgtaatcccagcactgtgggaggccgaggtgggcagatcacaaggtcaggagatygagaccatcctggctaaaacggtgaaaccccgtctctactaaaaatacaaaaaaaaaaaaaaaattagccaggcatggtagcaggcgcctgtagtcccagctactcgggaggctgaggcaggagaatggcgtgaacccggaagcggaggttgcagtgagccaaaatccttccactgcactccagcatgggggacacagcgagactccgtctcaaaaaaaaaaaaaaaaccctgtatttgtgagcgcacrcacacacacacacacacacacacctgtgcttggtcctagtgaataagcaagtaaatcaaatgtctaaatataattatagaaaggagatgtcacyttttggctgtacctccactatttcattctgcagaattgcagaatttcttttttttttcctttctttcttttctttttttttttgacacagagtctcgctctgtcacccaggctggagtgcaatggcgccctccgcctcctgggttcaagtgattctcctgcctcagcctcccgagtagctgggattacaggtgcccaccaccacacccagctaatttttgtatttttagtagagacagggtttcaccaggttgtcaaggttggtctcaaactcctgacctcaggtgatccactcgcctcagcctcccaaagtgctgggattacaggcatgagccatggtgcccggcctcagaatttcattttcaacatgttttgcatgatgggtgattttggagaatattttttgctctatcgcaggatgattaagatgtggacaaggtgaagccgatggagggggagctttgaaagttacttgctatttaattgaggaactaaactgctttgagagcctgggggtcagatcctctgccttttcctcctccccacctgcagtgcaaacatcagacaattgatcactattgtatcttggaggtgggagtgaccattgcagtgctgggaccagaagatggcattgtatgtggaacaacaaagcactatttctagagactgcctgcagggatatggaaatagctttatgtgtctcagaatgttcttcatacagctgtttttattggggaaattctacttgccgaaaagtttgatagtgagaccctctccagtttgcagatttttctccttcctgctcaacaacttcctagctcagtaactgcctctcccaacaaactccctcagtttcaccacaccaaaaaaggaagacaagccggttgcggtggctcacacctataaycccaaaactttgggaggccgaggcgggtggatcacctgaggtcgggagttcgagactagcctgaccaacatggagaaaccctgtctctactaaaaacacaaaattagcctggcgtggtggcgcattcctgtaatcccagctgggaggctgaggcaggagaatcgcttgaaccccggaggcggaggttgcagtgagccaagatcgtgccattacactccagtctgggcaagaaaagtggaactccatctcaaaaaaaaaaaaaaaaaaaaaacaaggaagacaaaaagaaaagcagctaaagactttgcctcaggggagaaagttctcttttgggttgctatccacattccaacctcctgttcccacctcttcgtctgcatgcctaagaaactgttttacaagtaaataagggacgctttgtctaggctttggagccaggaagttgagacaaatttaggaatgagatgaagtaatggtattattgcaagtctcaggtgtaactacctctgctctttctctgaagagtttctaatttctcttgtttacttatttttttcttgtcatttttgtgattttattactagttgtctctaatcctttctttaaattcttcattatgaaacataaaaacaaatgccaggcgcggcagctcacgcctgtaatcccagcactttgggaggccgaagcgggcagatcacccgaggtcaggagttcgagaccagcctgatcaacatggagaaaccccgtctctactaaaaaatacaaaattagctaggcgtggtggcacatgccagtaatcccagctacttgagagactgaggcaggagaatcgcttgaaccgggaggcagaggttgcggtgagccaagatcgcgccattgcactccagcctgggcaacaagagcaaaactctgtctcaaaaaaaaaaaaccacatacaaaccagagataatattataatgagcctccaagtgcctaccaccttgctgcagcacttgtcaatccagggaccacccacctcaccggctccccactcattaccaccctcccctactcaattactgaggtaaatcctaggcagcatgatcatttcttttttttctttttatttattttgagacaggatctgtctctgtcacccaggctggagtgtagtggcatatctctgctcactgcagcctctgcctcccgggcagaagccatcctcccacctcagcctacatagtagctgggaccacaggcacacaccaccacacactgctaatgttttgtattttttgtagagactgggttttaccatgttgatcaggctggtctcaaactcctaggctcaagcaatcctcccacctcggcctcccaaagtgctagaattacaggcgcgagccactgcacccagcgaagaacactttttaaaaaataaataggccgggcgcggtggctcacacctgtaatcccagtactttgggagcccaaggagggcgaatcatgaggtcaagagattgagaccatcctagctaacatggtgaaaccccatttctactacaaatacaaaaacaaaattagcctggcgtggtggcaggcgcctgtagtcccagctacttgggagctgaggcaggagaatggagtgaacccgggaggcggagcttgcagtgagctgagatcatgccactgcactccagcctggggcaacagagtgagactcaaaaaaaaaaaaaaaaaagccccccctccccacacacaataatataaataaataaataaccacaatactattatcacatcttacaaactcaacaaaaatttcttaatatcatcaaatacccagtttgtgttcaaattttcctgattgtttcataaatatactcttacagttggtttcttttagcgagattcaaatgagacccacctgttgacctttgcccttagggtttcccagggtctgaattttgttgacgacattcccatgttgctatgtaatacggtcctccatgccctgtgtttttctgtaaactgatagatgtggaggtgcaatgacatttgtgtttgatttactttggcaaatatagttcatcagtgatactctatacttcttgttgctttacatccggaggctgataatgtctgcttttctctcttttctaattatttgtgaaaggaaaaatgtggggggttgggagaaaaaaacccttaagtacatactcgctaaatcacattgctacaggtaacttccattaagaacttgaaagtaaaggtagctgcattttcccctagggaacacaatgatagacaggagccttagtctacagcttgaaggattgtaattatacctaagcaaccctcctggaccagtttaatgttattagctgtgatgtatccctacctttgatgtcattatccttactyagctcccttaaagcagagatcaagatgaaaagggcttcagctgcagcatggcacatggagattagagtggggcttttggatgctgaggagcagacctagaatgggaaatagatgggagccacagaagtgaaggtccccctccctcattgctcaacctactccacatctccaggtctgcacatctgttcagttactgaatcctgtgtaagctaccttctttttcttttttcttttatttatttatttwttttttttttgagatggagttttgctcttgttacccaggctggagtgcaatggtgcaatctcggctcactgcaccctccaactcccaggttcatgcaattctcctccctcagccttccaagtagctgggattacaggctgcaccaccatgtctggctaatttttgtattatcagtagagagagggtttcaccatgttggccaagccggtctcgaactcctgacctcaagtgatccacccaccttggcctcccaaaatgctgggattacaggtgtgagccaccatgcccgctgtaaactaccttcttaaaagctctagaagagggctyttaaccttttgttgtgtgtcatgcaccttccgcaagctgatgaagttgatagacccatctcagaattttttttttttttttgagacagtgtctcactctgtcacccaggattggttgcagtggcacgatcatggctcattgcagcctccacctcccaggctcaagtgatcctcctgactcagcctcttgaatagctgagaccacaggcttgtgtcaccatgcccaggtaatttttaattttttttcgtagaggcagggtctcacattatgttgcccagtctggcctcgagaactcctgggctcaagcaatcttcctgccttggcctcccaaagtggtgggattacaggggagagccaccacacctagccagaagaatgttttaaatacaccaaataaaacatttataccaaaatacagttatcaaaatattaaattaacaagagttagggtgaccctattaattagtgtaatttcaaaatagtaatgaacataagtgatagtttgagatttctgtgacttttctaatgtgacgtgaaaatatttgtgatttttctttttcttttttttttttgagatggagtttcgctcttgttgcccaggctggagtgcaatggcaagatctcggctcacctcaacctccgcctcctgggttcaagcgattctcctgcctcagcctcttgagtagctgggattacaggamtgtgccaccacgtccagctaattttgtatttttagtagaaacagggtttctccatgttggtcaggctggtcttgaactcccaacctcaggcgatccgcccgcctcggcctcccaaagtgctgggattacaggtgtgagccaccgcacctggccaatatttgtgatttttattgacgacaaagtcaaaggttctcttcatattattgtggtgtatcgcctacaagcataattaaaataaacactaaatttcagtttaaagtttactgaaaataaatatgtattttttattccctatttaagctttgaatcccctgacttcctataccattaccactgtcctagttcaggttcatgttgttttttactttaattgttatcacagtctcttaacatttctccctatgttctccagtcctgtaggtgctaaatctgacgtggtcacttctcagcttggaatccttcagtgcaccaccacagccttgaactacatatttgaaatacatatttattttcagtaaactttaaactgaaatttagtgtttattttaattatgcttgtaggcgatacaccacaataatatgaagagaacctttgactttgtcgtcaataaaaagtcccttgagggacttcagatgtaagtcccttagctgctcgttaaaactcccccagcctgacccaatacacaatcttgactttaaaccacttgtcattctaaatcactagcatttcctggaaaaaaaagccatttttccttyagggctaagctcagggaccaattctgtgtcaccttctttgaatcctgatgatattcacttctttatttgacctgatttattgggccccagacaccatgctgagtgttggggattcagctctggacaatgtcaaatgtcagtcctgcctttcagatcctttctactgggtgagccctggagtgctggttctcctcgcggtgctgcctgtgctcctcctgcagatcactsttggcctcrtcttcctctgcctgcagtacagactgagaggtacagggcagagggtgggtggatcaggatcctttctttaaatgagctggcttcttggagctacaccacttaacatgtatttgtgagtgacttctgggttcagaagttcttctcactattgagtgataaagaaaaaaaataactccatgatgaaagagttttacatcttacggaatgctttcatatgaataatcggacctagcatttccctatgagctaactatgccatatagtaaccccattttacagaggatacaactgaggccaggagtagttcagtgacttactcaaaccgatataacttataagtggtagagctgaggcctctgtatcatacctagcagctccatgcaacttgggagagtgtgagcttcgaagtcagacaggtctaggctattaggagttttgaataaagatactgaagtgaaagtctctaccacacagtaggcgttcgaaaattgtttcctctttctccattcaacactgaggactcaggttcagctgctgatgaagctcctcttttttgcctagagctttcattctgagccttctcctcctaccaagtgtctccccaatgccagagcaggaagagtcttcactcctccccatgccccacctcccatttgttactaagaggagaggagaaagtagcaaggagggtatggggaatgttctgggggaatgggtgttggtgcgatcaacaacaaagtcctttctctcaccttgaattcatcccagatgcctgcttgtttacttcttccacacaaaaaaaggccttcagccctcatggctgagcagaaagaatctgaatgttagagtcaggcagcctgggtttgaattccatctcaggtactgaactctatagcaaaattcttagattctccaagcttcagttgccttgtctgtcaaatagagaaaacatccttcgtcctaaattgtagggaggattaaagtcatgcaaagtgcctactacaaatccagtcacaaagtagctagctactcactaaatgttcagctcctccctcctcattcagatgggaagtggctttagataaacaaagtggcaacgcagtgggctggagcagctctgtgaactgagaatccaagaaaaggggcgaagagcagctgggatgtattggatgcttgtgctggcttggagcattgctcacattctttattcgctattgtatctagactatagctagagaaagagccgcaaccattggctttaaatccagtgctcttcctactctcctgaggttgtttccaggctgcagagaaatagcctgcacaaggggcccaggcgctgggtgtgggagggtccccaccgagagccagaacatgcaggaactaaaatgttgcctttttctattttaggaaaacttcgagcagagataggtgagttccagtcatcgtttctcccaattcttgccttttggttttttggcataacggaaatggtcccrttcttggaycgtctctccctctcaataccctgttttcccctcagtttccctttctctacagtgggtgtgtcgtgcctagaacaagttttaagtaattaaataacaaagactcaggataaaagatcctttttgagtgccctactaaatccatttccatttgtttctctttcagagaatctccaccggacttttggtaagttccggcatgtctaggccctcccaggtcaacttggtatttcactctagttccagtcacctgggggaacaaggacccctggctcctggttgagtcccttcctctcttctcttttctttctttaaataagaagtcatttgcatttaggattggtaaaatcataataaaaatactcatgtactgtttttatgtgccaggcactattctaactactttacaaaaacgttatcttattctgtttaactccttatgcacatgatctctcttttcaggaatggcaaaacagaggtaaatagatcgtttacacgtaaacctgatgtctggttggggaggtgaaacaaacagaaacaagacacaactgtatcacctgtacttatatttctgctttacaaactcaggatgtttccatgagtacagaacatgactaatcagagaagacctcatagaggaatagaaaagccaccaagccccactaggaattgacccctcaaggacatggtttctagcctttttgttcactgcagattgcccaatgcctaaagataatggcaacagaagagcacccaaatatttgttagataaatgttgcagacactagaaggtgtcattagggcacagatggtaccttctctgagcaaacttccttcacagctcctcctcccgaggctgtaggtgactctactcttgtcacctggcacacagagktctatcgtacgatttaggaaattagaccagtgtgtggaccacacacacacacatctttacacacccaaagaggaggaatagtatctttgttttggaggacttgactatgaaaggtcttaactcctttttgtaccatgaatctctctggcactccagtgaagtctaaaggacccctttgcagaatgtttttaaatatacacataaaatagaacacataggattgcaaaaacaatcattgtactaaaatacagttatcaaccgataatcacatttgtgatatagtaacataaatgtttctttttttttttttttgaggcagagttttgctcttgtcacccaggctggagtgcaatggcgcgatctaggctcactgaaacctctgcctcccgggttcaagcgattctcagcctccygagtagctgggattacaggtgcccgccaccacacccagctaatttttgtatttttagtagagactaggtttcaccaggttggccaggctggcctcgaactcctgacctcaggtgatccacctgccttggcctcccaaagtgctgggattacgggcatgagccaccgtgcccggccataaatatttctttagccaaagtaatacattaagtaatgtagcagcaagtctaataacctgtaatttctttctttctttctttctttctttttttttgagatgaagtttttttgagatggagtgcaatggcacaatctcggctcactgcaacctccacctcctgggttcaagcgattctcctgcctcagcctcccaagttgctggaactacaggcgcatgccaccatgcccagctaatttttgtatttttagtagagacggggtttcaccatgttggccaggctggtcttgaacccctgacctcaggtgatctgcctgccttggccttccaaagtgctgggattacaggcatgagccaccaggcccagcccaataacctttaatttcaacatactaataaacataaacagtatttcaagatttctgcaataactctaatgggaatgaaaacatctgtggcttccattggtaattaagtcacaggtactgctcatattgtggttagttgtaaaatgttttggtttgttttgttttttccaagacttgggggaatgggtgttggtgggatcaacaagagtcttgctctgtggcccaggctggagtgcaggggcaggatcttggctcactgcaacctccgcctcccaggttcaagcgattctcctgcctcagcctcctgagtagctggcattacaggcatgtgccaccacgcccasctaatttttacatttttagtagagatggggtttcaccatgttggcctggctggtcttgaactcttggcctcatgatccacccgtctcggactcccagagtgttgggattacaggcatgagccaccacacctggcagttgttacatttttaatgaaagaaaatgttaaatccagttattgaaaataaggaggcagtacttttctcatccaagttcatggactttctgaattttgtccccagagtcctttggtgttctaggaccccaggttaaggaaccaaaaaagacaggtgggtggggcatgagggggaacacatgttaaccctgtttgttctggtgaacaattcagatccccactttctgagggtgccctgctggaagataaccctgtttgtaattgtgccggttcttggacccttggttgccttgatcatctgctacaactggctacatcgaagactagcaggtgcagtggctgggcagcaggcaagaccaccaaatagtgggggaccaagtcagctctgaatgggaagccaaaagagaatagaaccaggactcaagattaggggagctgggatttccttattcctctgtccccatgcccaaccccaggctcttctgagaaactgtgaagagaaccacttactggatctgtgggatcccccagtggaaagggcagtgtgggtcactccaaatgtccatagggaggatgtrggraaggtgctrttcatcttccactaatcacatatttgtttctttttgttttcagggcaattccttgaagagctacgtaagttctcttctctctgttataagcagagaataaaaagccaggaaagggagacagaagcaacaagaggaagaggcgggctattgagggatcacattcccagaggaaaggaggagctggagagcctgggtggagggaagactcctcctgggaggtagagggcaaagaagccagctgttagagacacatttacaggtggcagagaagctggaggcactcctatctgccacctgatccattcctccttcactgcccctaagcaggaatccaaccctagctggtctcattgcccattccacagcaactgcccagtgcctcacctctcagatcaaccattgaggcaggaatggagacaagatgaccccaagggcttttcttctccctagttcaatggttttatgatacaaactactgacatacgtttttcaagttattttctccttcttctaggaamtcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgygccactgcactctagccrgagtgacagagtaagactctgtctcaaaaataaataaataaataaataaataaataaataaataaataaataaaaaataataatacaagttttcataagcacacttctaaccccttgtcttttatgtatttccttccttatccacgcacctgtctccctctactccagcctcattaccccagaggtcagtcctcaggaaaactaaacacaaagaaagagctcagtcagaaaggccatttatttatgtttcaagatgctcactgcctcctttgttttgtctcctttgcaggccttctctcttaggcctcttctcctgggggtatggatcctggggggagattgatcacctccatgcttccattcctccccagccatagtggggacatcatgagagaagccaagccactggcccaggatcacccggcatttatggtggctgctctggcacaggtccttgcctttatagcccctccagtgatccataaggccctctttctccccaaaggagaggtcacagatagggcaaaggtagctcttctgcttccagtgggtctgctggtgtctgaccagcctggaaaatgagctgaaagacttgctgcaatggaagcagtagttgggcggctctgtgaggtgggccttctggtgtctggagagataggatttcttgctaaaagtcaaagaacaatgggggcaacagaagacattgagtcttgagggcttcactggatgagagttggatctggcawcctgacagagggttccagtgatgggtgcctgggtcctggtcacaggtgcttggttcttaagtacagatgcctggttctgggccataggaccctcagttctaaatatgggttcctgggacctggccactggtgcatggttcacatccaaaagcccctggatggacctctggcttctggcgatgggtgtctggaattcagcctgggtgcctggaatcctcaaagtacactcctggtttccatccactggctcctggttttggtgtatcttctggtggcgtttgagctcagactggtcccggaagctcttcccacacacagarcatgaatggggccggtaacccagatggacgcggcggtgacgacttagtccagaagcatcacagtaggtcttgtcacagagcgtgcaacagaagggcctctccccaagatgcatgcgtctgtgatagctgagggacttggggctccgaaacaacttcccacactgactgcagctgttagtcagcttgggattgtgaacaaactggtggctatagaggtaggagcrcctgctgaaacatttgccacaggtgtagcaaaaaaagggtggcccagcctgggatgcttgaagcacccgggtcctgtccatagtcccagctggggcagatagggggcactggccggcccctctgcatgcaaggaagaccttgtcatcactagtcccctcatctctcagactgggatgttgttctcgaagctctttcttcttgccttctacagtgaatgaggaagaataacacaaaattcactgtaagaactccaacagaggcttggcatggtggctcacacctgtaatcccagcactttgggaggccgaggccagcggatcacctgaggttaggagttcgaaaccagcctgaccaacatggtgaaaccctgtctctactacaaatacaaaaattagctgggcgtcatggcatctgcctgtaatctcagctactagggagactgaggcaggacaatcactcgaacccgggaggcggaggttgcagtgagccaagatggtgccactgcactcctgcctgggcaactagagtgaaactctgtctcaaaaaaaaaaaaagaaagaaagaaaaagaagaagaagaaggagaaggagaagaaggagaaggagaagagaaggagaagaagaagaagaaggaagaagaagaagaagaaaagaaaagaagaagaagaagaagacgaagacgaagaagaagaagaagaggaagaagaagaactccaacacagcactccattcagcctaacacacttcttgtctctgcccttgctctcccacccaacacattcatccttacccttgggcctcataggctagaaataagaagaaaaaaagaaaaaattggcttttcaaattagaagcaaataaaaagttaactggaatctttcaacactgtcagaaatgtaaattttaacttacaacaacacttcttgaaatctatcttatctcattctcaatattgctcaaactcccatagacaatccacagacacccacataataatgcatcatgaacactgggccacttgagggtgaaaagaggtgttattaataatcaagctgggatgagaagtataaaccaggactgtcctggaaaaccaaaaagtgtatcagcctggcttgatatctctctcaactatttactaccagggacaagcctcccttactccaacccagcatgaaacctatctcctttgcttctcttttctcttggaaagaacattttaatcagagcactatcatggacataagcaactttcatgtcatctctcaatctctagaaactgaagacatctacttctcctgaaagacttagatcttcagccagccaggcacggtggctcatgcctgtaatcccagcactttgggaggccgaggtggatggataacctgaggtcaagacatcaagaccatcctggccaacatggtgaaaccctgtctctactaaaaatacaaaaattatctggacacggtggcacatgcctgtagtcccagctactcgagaggctgaggcaggagaatcgcttgaacccgggaagtggaggttgcagtaagccaagattgtgccactgcactccagcctggcaacagagcgagactgtgtctcaaaaaaaaaaaaaaaaaaaagagagagagagagagagacttggatcttcaacttgaaaacttgaagtcaagggacttgagcctatgatattaagctctctttcaactccaagtctgaccaggctggacagaggtacactaggagagcatctatagagcattcatcctcttcatcagctctccatcctttcaggggttatcctgggcccttttccccttcctccctgcttggcaattcttacctgaaaggccttctgtgtttgggagatggacaaactctctccactgttcctcttcttgctcaagcttggtgattagctctggcttatgcagaaagattctggctgatgtgtgggaatgagaaagagttgagttggtcccaggtatggccccttcacatctgatggggacaacaggctacctcctgtagcctttgtttaagaaccataacctgggacatgtagatgcggaaaggagacattaaaaggccagctgctagcaaagtacctggttctcaggagtgacttagtaaatatttgtttgatgaatggaaaaatttgcatattttgagaacactgtcatcatgttacaagtgttatctttgccttcatgcaggctatcatttcttctctttaccactgagcttagtgactcagatctttcacacctggaaagcatagaaccaggggtcagtgaaactaattgtaagctgatctacctgtccagggaaaccagatgttccagggcccttaggacagggggcttgctgagggaagcccagcctcttacccacagatgttagattcttaaaggtttccgacataacatcctggtaaaggaccctctggctggcatctagacagtcccactcttcctgggtgaaattcactgccacatcctcaaaggtgactggcttctggaagaacaggagagactcaagaagtttatataaatatatatgtgtgtgtgtgtgtgtgtgtgtacaagattaacatccagtctcaagattcagagaattaaaacctaagagaaagataaaaccatggaaggaagagagaaatattaaaagacagacacaaggccagcaactgtgaagtatagaaaggaaaggaggccggacgcggtggctcacgcctgtaatcccagcactttgggaggctgaggcaggcagatcacgaggtcgggagttcgagaccagcctgaccaatatggtgaaacctggtctctgctaaaaacacaaaaattagctgggcatggtggcgcatgcctgtaatcccagctactcaggaggctgaggcaggagaattgcttgagcccgggaggcagaggtagcagtgagccaagatcgcgccaccgcactccagcctgggtgacagagcgagactccgtctcaaaaaaaaaaaaaagaaaaaaaaaaaaaggaaaggaaagatgaagagaaagggagaaagataagatgtgggggagaggaaagaggatatgcagatatgcagaatataaacaggaaagcaaagcgaaggaaaaaatgctgccactctaacaaatttcaggaagtactccatgaaggatgccaggatggtgcgggagatggagaaaggtcttgcagctcctttttctggatgtcgttcagtctggaacaatctgagatttcatttgacctgcaggcaggagtatgtatgaaagagctcctggagtccaggacctggaccccacctctctctagcttagtctcctcaccttcttcacccgtgcctccctccagcaatctctcttcatggcttcctgcagggtggcagctacctcgcccacccatgggagcgtcttctgtacaggttcgattggcttcagctgttcaaacatcttctcttctgtggtgtctctttctagctttatccactcctggcctggtgcccaggcctgactggattccttcctggggctatctacctcccagtaactgggcagatggagaggcccagcaaaggccccagggtttgatgtggcttcctgtgacaaatgtatctgctccaagaggctgtcttcctttttygttctgctgtccaaattctcctcttccacaattgagaacaattttgcttccctcaaagctgggccaccgagttcagggccctggtcacccttggctcaccagctgccattgtttagtaacaacaccagcctgggctaggtgtctgccgtctgttctaccctgcttctagaaacctgaggtcagagaaaaacaaaacatatcagcaagagggagggtaagaaacagcttccttatttggtcagggaatgccagcagttactaaacccctacagtgtgccactggatgctctcagcaatgaggtaacaattactggccctgtcttaaggacctaatgcagagatgctaaataattttccaaggacaagtggacattcttgatctacaaaagttaatgtttaaacctaatgttaatgttagactcagtaccattggaaatcatgtagctggggtaaccaggctaggatctgtcacagatcacctcgagtgagtctctttattctttctgacttggtttcatcagaaatgtgagaataaaggagacactctctaagatctcttccatgaccaaaattatacacacacacacacacacacacacacacaattctgtgatctggattttcaatacatgtagtagttcccctttatcatggttttgctttccaatgcttcagttacccatggtcaaccatggttcaaaaatattaaatgaaaaattccggaggacaggcacagtggctcacacctgtaatcccagcattttgggaggctgaggtaggcagatcatctgaggtcaggagttcgagatcagcctggtcaacatggtgaaaccctgtctctactaaaaatacaaaaagaaaatagctgggcatagtggcacacatctgtaatcccagcaactcaggaggctgaggcaggagaatcacttgaaccctggaggtggacgttgccatgagccaagactgcgccactgcactccagcctgggacatagagcgagactccgtctcaaaaaaaaatccagagataaacaattcctaagttttaaattgcttgacattctgagtagtgtgatgaaatcttgtaccttttctctctggcctgcccaggatgtgaatcatccctttgactagcatatccacactgcagacaatacctgcccattagttcct

SEQ ID NO: 10709 - DNA, 17656 bp, Homo sapiens
tcaagtgatccacccgcctcagcttcccaaagtgctaggattacacatgtgagcaaccatgcccagccctaatttcttccataaaatagagatgggggtctcgctttgttgcccaggctggtctcaaactcctgggctcaaatgatccttccaccttggcctcccaaagtgctaggattacaggtatgagccactgtgcccagcctgctcattgctcttatgggaaagtagcaagttctgaagtggccaaagccttgtgccctgggycctgggctctgcagcacactcagtgcccctcatctctgtgccccagccttctggcctcctgtccccgccttcacctgttgtcccaccaagtgtcttccagctaccactggacttcacacgcctcttcactggccaactcctattcagcacaaacggtagcttgttgtttttttagtctcgctctgctgcccaggctggagtgtgatgtcagctcactgtaacctctgtctcccaggttcaagcaattctcctgcctcagcctcccaagaagctgggggattacaggcgcccacgactatacccggctaatttttgtatttttttgtagagttcttcatgttggccaggttggtctttaactcctggcctcaagtgatccgcccacctcggcctcccaaagtgctgggattacaggcatgagccactgtgcctggcctagcttcttgtttctaagtttctttcataaatctcctttgtccattttctgattggattgctggtctttcccttaccaatttctaggcacacattttatattagggatattacccttttcttgtgatctgagctataaatatagcttttttttttctttttggctattcctaatgttcatgttataaagtcaatggatcaattttttcctttatggcttctagattttggattttgactcacaggtagaaaggccttgcccactacaaggttataaaggaattctcccttgttttctcccagttccttttttattttattttttgagacagagtcttgctctgtcgcccaggctggagtgcaatggcacagtctcggctcactgcaacctccactgcccaggttcaagtgattctcctgcctcggcctcccaagtagctgggattacaggtgcgcaccaccatgcctggtgaatttttgtatttttagtagagacagggtttcgccatgttggccaggctggtcttgaactcctgaccttgtgatctgcctgcttcggcctcccaaaatgctgggattacaggcgtgagccactgcgcccagggctatggtttctttccttgacatgtcaactggttacagtggccttccctgaaccccagactaagttagtgctttctagtccttctccttcaaggcattcctcctgattgcaattaattatgattaaattaaatgtggatgtgtatatcccccacgaggctgtcagttccatccacgaaggcaggactcaggctaatttggtcactgagtcttagagatggcagagtaagtactgagtttgaggactgaataatctctctctcccagtccaccatagcccccttatacccaccttcctcactgccctccacaatacccctgatgaattggtacctggagtaaagtagggaggcaaactatttcctactagaaagggaagcagggcttcaagtggtgggaggccacctgagtcttgggggaaaagtgcaacctgaattaagataaaagtacccaaattctccatctttctagcccatgtgtgtttattttcaccaaaggtctcatcactctactactcactactcatggagggtcttttctgcaatacctgttctttgcttggaagctactgcccagctctccgttatgaatttgaatcctttctacccctgcattcacctgctcttggtgcagcctctgaacctcttccagctcccgctgsctcccctcttccaarttcttccggacaacctcagccccagccaaagcagcacgcaggccctcagcctcagctcggccggccttctccgcccrtgccagagcctctagctccatggcctgggcctctagcctcatcttctgctgcagcgaggtctcccgcaggagccrgacctcctcctccagccrcygcagctcttgcagctgccgaacgatcacctcagcctgctggctcagggcctgtgacccctccagcccccaggaccttcaaagacaggttagtgcaggtgagacttgtctccagtgctggaaggatagttgagggcataaacatagccaggagaaggaaaagaggacccctctgcttccgtgtggggaggtgaagggggtgctgaagctggggtatggggatgtctgcattgacatcatcatcattcatcaaagccctattgagcatgttgagtccagtgcctggactcacaggacctaaagtctggctgagatcgtggaacatgatctccctagagagagctacatacaggaggattcaacatcaaatgtgtatatcattaggccacacattctttttgttttttggtggtttttttgtcttatttatttttttatttttaggccacacattttaagtggaaaggttggaagaacacacagggacttctcaattctaatttaagggcaagaagtttgagggaggaatgggcatagagaggtcgtaagcttccagtatcaatatggtgaggccaggtgctagttaaaaggcatttattggctgggcgcggtggctcatgcctgtaatcccagcactttgggaggccgaggcgggcggatcacgaggtcaggagatcgagatcatcctggttaacacggtgaaaccccatctctactaaaaatataaaaaactagctgggcgtggtggcaggtgcctgtagtcccagctgcttgggaggctgaggcaggagaatggcgtcaacctgggaggcggagcttgcagtgagccaagatctccccagtgcactccagcctgggcgacagagtgagactccatctcaaaaaaaaaaaaaaaaaaaaaggcatttattgagtgttaggtatactttatgaggagtctgagagaacagtacataaataacacagtgccagcctttagagaaatcgtctaccaatgtcacgtgaagtttaatccagcttggaacatggctcctgaggcagctctctgagacccaggactataagagattgttgttgttgtcgtttttagagacagggtatcactgtgtcacccaggcctcaatgcagtggctggatcataggtcactgcagtcttcaacttctgagctcaaggggtcctaccaccttagcctcctgagtagctaggactacaaatgcatgccaccacagccagctaattattttctgtggagacggagtctcgctttgttgcccacgctggtcatgaactcctgggctcaagtgatcctcctgcctcagctcccaaagtgctaggattataggtgtgagccgccatatctggctcgctctttctttctttctttagtagcagcgatctgtaggctagggaaattaagtgacttgccaaatgtcctctagctggtagccaaactagaaatagagtctctgtctcctgacacccagtctagtattccttcttcatcatgctgcttcttctaatgtaatcctattctggagcaaaatggcagaatgatatcccagtacatctgggaaaagacacatgaaacaagaataagaatgtttacagataatacgacagcatggccagctcccacagcatgtcctctgtaaaggctttcttccatcagaatgaacccacactgccacagtgctgggtctctacctctagtttgcacttcttcatcttgcctcataccatgctttaccatcagctggtggtcaatctatctcccctcttaggattttagattccttattaattacaaatttaagtcaggatttgtcttattcactattgttatcctcatccctagcacttagcacactgctttattatttatgcactgtaggaactaattgcttacataaaaatgagtacgttctggaaactagggccgaaatagggtaaggagtttattccagtgaggaagggtcactagcaagcaagcctgagaaaacggcgtggatggatccctacctgcctctccgccctggctcctgcctgtcactggaaacatcccgttcccacatggtcacttgaggtctctgggtgtctagccgcctctctgagacatcttgatggcctgggggttggaccaggggaatgtctgagagccaggtgggagccattcttggcagagttgaaaggggccgagcttgaaagtgggaggggggaatcagcccagtggaacctgaagaattacaaaaacaaagatggtcagtttcccaggcagagacaaccaccactccccttgtctggtcccactgacctgaaggtggaaacatctccacattatttgaaggctctagattctgtctycagccatctatgttcccctggacaagaggagaaacaaagacactccaattcaattttcaggccaccttccaaagagaaagcccctacaataacaaagtcataatccttgaattatagccaggtccacccgatgcttagctcttttcctacttccccaaagtaggagataccccaaattcacttgcttgtctcaacctggttcctcatggaacccaagcaactaactatcaagtggagagaatttactgaaagagacagactgagaggggctctgaggctttactcatactttcaggattctgggcagtgcctttaccctcctccttaagtttctatggtccctgctgctcctggccagaggtgagaaaggaggtacacagtgcaggggtcttgagcgccatctccagagttctctccatggctcagcaaggcctgagggaagcccatccagacaccagcaggccatgactcttgggtccttccctgttaaagtgctggcccaaggcctggccccagctgaatgtggccacatgcagggctagaccctccccaagaccttgggaatccaggccgcctagatccccaggcagaaaagccagcgtcctgacatcttattcaaatctttcctgcggctgttctctcagcttctctctactatccccttagcttccatgcctgctgcccgcctcctctttctcgagtcctaacacatagtgggcacttgaagatcttcctcccaccctcccaccctcattaatctattttttacccgaatctgggatccctactcccgtccctttttacaacctaatctacctttttctgaaggaattattctggtcctgaccctcacccccatctctcaatagcctgccctcgccccctgtacgctagccggctctactctcccaccactgctcccctagataccmgaggcttcacccagttagcccrtgagctctaaggctgttctgatctcttcatctgtcccttcacctggcccctgtacccccttcccctttggaccccttgaaccctcccaggacccccgctcagccccttcccgcccccaaccgactcttcccgaacgtcccttaccaaccgcgagagccccctactgcgctttggccacaccccctacgcctcgctcccggccccgcctctgcccctgaccgcgcctgcgcaaggcgggcgccctaaagtcctatttcactctgttgggaggagggggaaaggtgtacgcaggcgcagtggcgtctaaatttgggcccactaaatgcgtcggagcatctccgcgcccaggcggctcctcctcactgcggcaacccgggaaaacttgtgaactaatcagaaaaagtggaaggcgggagatcttggggcgctgtccaatggcgcggaagagaacaaatgagctggccaatcgggaacggcacgggggcgggctcgctcggcgcgaagttcgggcccgggaattccgaaggaggggtaggcgctgcccgcgcgcagaggccgcgcccctcctggccccggcttcttggctgtcaaacagatgcagcaacgtcggctcctgccgaggagcccaaggggtcccgggatccgccgcacaggctggcactgcttgaagaggaggctactcggagactgcgccgcgcgggtagatccgaaacggggctggggcggagtgggaaaaggccgggtatgccttgcatgatcgcggggagctccttcctgtttttatcccacctagagaagccgggaagtaggggtttaggtccaatttgttggagtacttaaggactcgtttgcactttcttttgggggatgacagtggattcattgccctcggaggttcaaccagttatgagtgagggattggccagaagatcggggcgcaggcaagcaggagtgctctattaggataagcaagtttgacaggaagaagctgctcttctccgaattacacagaggtgatgtgttcgtattgcacgtagacgtgtgtataacaggacctccttccccgcgccccgccaccccgacacacacaggagctgcctaaagtatccttgccttgcagattggaggctccccaaatattttgtgatctgaggatccagctcaagtgaggtgccataggacgtgttcctgagtttgcattgcacggagaccttcctggaatttttcatttgcaagtcggcttaaccaattttgcattgagtcctaggctgcttgcactctgaatttgggctattcaggtagtgtgctcaaagttgaaaccgcatacagcacaactcaagtttgcatcagactgggaagcgaacttaagccagcggtgcgtggcccaggagtgggaaaggaaatggatgcctgaagtggaagaggtggtgcagagggggcaccgcccatgctgccctgcttccaactgctgcgcatagggggcggcaggggcggtgatctctacaccttccacccccccgccrgggctggctgcacctatcgcttgggccacagggccgacctgtgtgatgtggccctgcggccccagcaggagcctggcctcatctctgggatccacgccgaactgcatgccgagccccggggtgatgactggagggtcagcctggaagaccacagcagccaaggtgagcattaagcagggcagctttgcccctgggtggttgaagcgccaggctggaatgagtaaggtctccacaagaccytgctgcctgcctcccatactcccatcagattggatggatrgtcgtggtccagaccttcatcttcccaccagaagtgtgcacagtcagaagctctctgccagactgaccctttttggtcccgtttagctcatacaggacctgggatatcatcagaaagatatcacagtggggatgttctgaggccactagaggccaagtttagacttgattcagtttccagctttgctgaggcactctgttcctgggttagggcagttctatgttgaataatgtttttaataatctgggcatgtctttctccgtgacttgaggcagttagcctcagaaagcctagattcacatttgagttttgccactgcctcttggtaaagtcagctgtaggagtgttatggttattagactatagtagccaacattcatctagtgcttactgttatgagccaggccctattttaagtgtattgaatgtaggtggtactaatattatcctcatttacagtaaaggaaaatgaggcacaaagaggttaaggaacttgtccagggctgggcatggtggtttacacctataatccagcactttgggaggctaaggcagggtggatcacttgagctcaggagttcgagaccagcctgggcaacatggtgaaaacctgtctctaccaaaaaattaattaattttttwaaaaaagcctgggcrcggtggctcacgcctgtaatcccagcactttgggaggccgagatgggcagatcacgaggtcaggagttcgagaccatcctgaccaacatgttgaaaccccatctgtgctgaaaaaaaaatacaaaaattagccaggtgtggtggcgtgcacctgtaaccccagctactcaggaggctgaagcagcagaatcacttgaacccgggaggcggaggttgcagtgagctgagatcgcaccactgcactccagcttgggcgacagagcgagactccatctcaaacaaacaaacaaacmaaaagcttgcccagggtcacataactggtaagtggtagagctaggatctgaacgagctggagctgggggagagtgagcatgtttgaaaactggaccttagggcggggcacggtggctcacgcctgtaatcccagcactttgggaggctgaggcgggcagatcaggaggtcaggagtatgagaccagcctggccaacatggtaaaaccctgtctctgctaaaaataaaaaaattagccagacgtggtggcacatgcctgtaatcccagctactcaggaggctgaggcaggagaattgcttgaacctgggaggcggagtgcagtgagctgagattgcactactgcactccagcttgggcaatagagcaaaactccatctcaaaaaaaaaaaaaagaaagaaaaaaaaagaagaaagaaagaaaattggaccttaggacagtgagggcagggatcctttgtaggaaagcacaagaaacacagacttgttcctagctgacaaggagtgtactgcctggtacctgtcacctgctgaggggcttaggatgtgagggagaatctgactacagtttcatattcttccccagaaatcatacagatttctccactcctgactctggtcatttctgtttttgtcctccatatttgcctggtgccccaccatcaacaggtactttggtcaataatgtccgactcccaagaggtcacaggctggaattgagtgatggagacctcctgacctttggccctgaagggyccccaggaaccagcccctcggagttctacttcatgttccaacaagtacgagtcaagcctcaggactttgctgccattaccatcccacggtctaggggagaagcccgggttggggctggtttccggcctatgctgccctcccagggggctccacagcggcctctcagcaccttctcccctgcccccaaggccacactgatcctaaactccataggcagcctcagcaagctccggccccagcccctcaccttctcccctagttggggtggaccaaagagcctgcctgttcccgccccacctggggaartggggaccacgccttctgctccaccvcaacgcaatcggaggaaatctgttcaccgagtgttggcggaactggatgatgagagtgagcctcctgagaacccgccaccggtccttatggagcccaggaagaaactccgtgtagacaaagccccactgactcccactgggtaagtggagtcctcacttggccctctcagtgttttactgcttttcgattccttgtatccctaggctgtgaggaggtccccctgcctggggggatgggcacgggaggtggaatagatggaatggcaagacctgggttagctctgataggaaaagaaaaatatgtgcaggagaacatgagaggtggggtggggcagtgcttataaaacaaccggagtgagcatgtcctgctttttacattcatatggctttaaccccattcttctagtgcctaaggatggggaactttcaggctcayactagaggtttttaggcccaccctatgtgtttttaaggacagagtccaggctcaccttagttctcagaccactgtgcctctgtggcctcaccctatgaccagccatagggtggcaaggtctaggccttctcctacaggtttccggtgacccttgtgtctgtgtcacttccttcagaaatcgacgtggccgtcctcggaagtacccagtgagcgctcccatggctccccctgcagttgggggcggggagccctgtgcagctccttgttgctgcctgccccaggaagagacagtggcctgggttcagtgtgatggctgtgacgtctggttccatgtggcctgtgttggctgcagcatccaggctgccagggaggccgacttccgatgcccagggtgccgggctggcattcagacctaaggtccacygccaaggcaccatcggacacacctgcccatgagtagacacagcagcgagcaaataggtctgataaataccccscttcccttccctccccargagggaatgactacagggaagaaggatggattgatgtggactcattcagggcctggagcagaccctggtggccaagacagaagagatggtttcctgccaaagatattgccacctccaggaaattgccagtgagctggaagttcccactattacaagccataaggccrtgttgccatggacaccagaatatctgtagtcagagcacctatcagttgcaaaagccatgcctgcaaccgatggaaaatgtaagagggagttcttaaggttcttggtggcatcacccaaggcattctgggaaaacctagggcctggccccaaaacttccctactctgtggctagtcctgctgccaacaaaatcgtagcgacctggcttttcacagctttgcttttatttccaagtcaaggacaagccgcttcattcactcctgggcatttactcttcttgtgggtctgtgatattccttgctttccagggagaatgtgcttggcaaggtctggagaactaattcagaatcttaggggaaggggagagatggaaatacaaacctgcttactggaaaggtgcaaatatatgggttgagctggaggtaggaatacaggtaattaaggtttctagtttaagggaaaacagatctattgccatttaaataaggtaactgggatttggttaagttcacaaagatagcagaagatttatttacaggcttcacctgtactgtcagggcaagagaaagcctggtaaaccagctacagcagtttaccagtgtgatggctgtgacacagctccactccacgggtggacacagcagagggcaactgggctggcctggttcagtgtgaatcaaaccgcttaacccacacatggtacatgtgattttcttttgtgagccttacaccaagccaaactattgtcaaagcatcatttctatagaaataaagccttatcttgacctgttctattaaaacctgccacatccgccctttcctacctagatttaatgagcccaagtttttttacatggaagaaatgactctggggcaaagacccctaatgaactagtggcagagccaggaataaaacttgagtaactaatgagtcacttatgggcagagtatgcaaaaaccttaagtggaaaccaaatagaccctggtatcaagaaagcacaaagtattaatagaagtttctggttggggtgatctaggttcaacagaaataagatgatttctaagtataaagccatttaagaattccagagtagggtgggaaagcaaaaagccagctctgaacaggtaacagctacatggtgactgagtctatgggcaaaagttcttgcatcacaggcttttgggaactagcctatcacagggccctgtacaaataaacttggctgcaatcccagctctccctctgatgttgtgtgaccttaaggagtgtaaatggcaccttagtttcagggtcacttgggtatgagcattggatattcccatccccacctcagtaactgaaggacaaaccaagataagtgtgtctatctactgtgtcccaagcttctttatttaagaaaaaagtgatacatgatgtgggattaaaatcaagagcatcattgaacttcaccttccctccaaccagttgccccaaactcccctgcccccaccctttgtgttcccaattccttccttagtgaatgaagaacttaatcccaaaaaccctggcacaaactccaggttttctttccctagctcctcccctccccctgtcccccattcctagaagggcaggcacctcagtttgaatgcatgggagagcccagagtggtgacagagacagggggaaaggcttccccctcagggaaagggaccgaggagtacagtgcagtgaagtgagggctcccatagcctggggtaccaaaatggggccctggggccagaggaaaggacactggtccccctgagaaaggagacccagcagcctcaaaatcctctcgttgtgcatagtcgctgcttgatcgcttgcccttctggcgccggttacagaaccacactcggaccacctgccagtgaatgacagaaaggagaatgacattagacaatgagctgagagacgggcctgactctgcttggacattctatccaaagccaacagccctagagcagttagaggaggacattagagaatgagctgagacaggcctgactgcttggacattctgtccaaagccaacagccctagagcagttggaggagccagagctagggaaagcgaggtggtgacaggggaaagagatggagcccgcagagagacatggcactcacatccttctcgagcccaagctgctgggcgatgtggctgatctgctgcagtgtgggtttcgggcactgcaggaacaaattctccaggttgcctctcactcggttctcgatactggttcgctttctctttcgggcctgcacgagggtttctgctttgcatatctgtgcaggtgggaagggggtgacaagggcaagctttggacttgctgagtaacagcatcacaggggtctgtgactagatgtgtcagcagagccaggtggtggtgtgaaaaggcaggatcctggaagggttggctctggaccttatcccagcagaactgaggaatttcactccatcccactgagaaccactgcaccaaagacggagagctacgagccagtgatggaagcaatggaaattaggccaagaaagggaaggtccccgggtatccccctcccacccttacctcctgaagattttcattgttgtcagcttcctccacccacttctgcagcaagggccgcagcttacacatgttcttgaagctaagctgcagagcctcaaagcggcagatggtcgtttggctgaataccttccctgggggaggccagtcaaaagagaagcaaaatgagggagcacgcagggcccttgtgaccctgagatccaagcttaccacctcttcccagagggagctcaaagcccaagcatcttctccctctccctactcctcttcatgggtgagggtagagtctgcccctgcccctccccactaggttcagggatactccttagaggggagatgcggtcagaatctgcagaggggaacccaccaaatagaacccccagggtgagccccacatcggcctgtgtatatcccagggtgatcctcttctgcttcaggagcttggcaaattgctcgagttctttctgcagagctttgatgtcctgggactggattttaaaaggcagaagacttgtaagaacataaacacaccagttatcaatctcccctttccattcgggattcaagaacctacgtgtggccccaaggaatagtctgtagaagtgcatctgccttccaagctgcccacctaacttctagaaataacctacccacaaatgtcattcacccattccctgttcactgactcatgcatgtaacaaaggactactcttcccccagaaactggcacatccaagggatgcagagcatcgtgaaaggacagaaagagagaccctggcctcgaggagaacacctgtcaggttatgaaggttagaagttctttgctgggcgcggtggctcatgcctataattccagcactttgggaggccgaggtgggcagatcacgaggtcaggagttcaagaccagcatggccaacatggtgaaaccccgtctctactaaaaacacaaaaattagctgggcacggtggcacgcacctgtaatcccagctactcaggaggctgaggcaggagaatcacttgaacccgggaggcggaggttgcagtgagctgagatcacgccactgcactccagcctgggtgacagagcaagactctgtctcaaagaaaaaaaaaaagaagatagttcatttaatacctgcaaaattctctcactcaagtatcacccccagtttaaggatgttttgagattagagaaatagataagctgctaagttctgggttaattaaaaaggaagagcatcatgtctcagaagctaaattcagtatatactctccccagcttgctttgagggtcccacaaactataacatggcatgcatacacacaaacacagcaaaaaagtaacaggtgtcataagaatggataaagtgctttgtgtgtacttactcctcattttttaaattgattatccctcatctttactgtatctttttcactatagaggcatcctaattgatttttaaattcaagagatttatcgagcaccttctataagccagcggctatacaaagtggacaaagagccctgacatccagcatgacagaagtgctattcggcacttgttcttcaagttgcccacttggatctcttccaagtgcactttccttttttccctgccctataactttttaataataaacttccactcctgctctgaaaaataaaaaagtaaataaaataaaaaatggccaggcacagtggctcatgtctgtaaatcctagcactttgggaggccaaggtgggcagactgcttgagcccaagagttagaaagcagcctgggtaacatagtgagacccgtgccgccccttctcccacccctgctgcctctatttaaaaaatatatatatattatggaaaaaagcaaagcagtccgggcgcagtggtcatgcctgtaatcccttcactttgggaggccaaggtgggtagatcacttgaggtcaggagttcaagactagcctggtcaacatagtgagactctgtctctactaaaaatacaaaaattagctgggcatcatggcgctcccctataatcccagctactcaggaggctggggcaggagaattgcttgaacctaggaggtggagtttgcagtgagccaagatcgcaccactgcactccagcctgagggacagagtgagactccatctcaaaaattaaaaaaaaaataaagcagtctataggagtagggtaaaggagggaaggagattatggaggagggtgacacttttaaagacagagaaggtgattgtttgagcaaaggacaagagtctaatgtggcaaggccctgaagtgggccttccagagcccaaagctggtctggtggctaggtagatcctgttgcagacatagtgactttgttttagtccaagtgaaatgatctctcaccctttttctccccccccaagacggaatctcgttctatcgcccaggctggagtgctgtggcgtgatcttggctcactgcaatctccgccttctgggttcaagctattctgcctcagccgcctgagtagctgggactacaggcacccaccaccatgcccggctaatttttgtatttttagtagatatggggtttcaccatgttggccaggctggtcaggagacctcaagtgatctgtccaccttggcttcccaaagtgctgggattacaggtgtgaaccaccgcacctagcctcaccttttttttttttttttgagagtttcgcttttgttgcctaggctggagtgcactggcgcgatctcggctcaccgcaacctacatctcccaggttcaagcgattctcctgcctcagcttcctgagtagctgagattacaggcatgcgtcaccacgcccagctaattttgtatttttagtagagatggggtttcgccatgttggtcaggctggactcgaactcccaacctcaggtgattcgcctgcctcggcctcccaaagtgcctggccacaccttttaaaacactgactctagttgacgtgttggccacagacagtagggaggaagcagtataatttgagaagctactgcggtaatcccagcagagatgatggtggctgaggccagggttaggttgtgattgattcaggatgtttcttaaggataggatgtaggacgtgaaagaaactgaggatgactgggtttggccttgagcaactgggtgatcagggtggagcagttcagggagccatcacaagagacagaaaacgcggtagtcatctggtgtctaaatggcatttaagccttgagggtgggtgagaggaaggaagggtagatagagcagaggttgaaggactgagccctggggcatgccatatgaggctgccggcggacagaggtgcacagctagtgagaaaaaaacaaggcctttttgtagtcctgaagcctcaaggaagtgtttcaatggtgcttgatcatatcaatttcaaataggctgttttcatccccaacttctgctcagccaataactcaaactgataaatgccctctgctatcctggattttccaaattctgttttggggttttggaataaacactggtccaaatcctcgcttcatcatttagcagttaaaacccgttaaataggataataatacctccccctaggagattttgtgctggttaatgagataatgatgtataaacggagcacacagccaggcacttaggaagtggaccacaattgccagccattatcattcaaggctcagcagtgacctcctgcgaagaggttggggcttctcggtcactccagaaaccagtcacacctttctgtgaggtctcaaggcttagtatttaatctctaattgcttacacttgtcgccttggaggactggaagatacatctttaatagtcctcagcagggctggatgccttcaatcccgcagcagctctatatttgcaaatggcctggagaaatctctcaccatttttcttgtttacaactttggaactgaggctgaagtcaatcaaaatccagctttctacaaggggtgccagggtgtgcaccttaacacagtggccagtcattggcctgaggcagagatccggggaagacaagccctatacttgactggaggtaaacccagctcacaacgcgcacacacacagcccaaacaggagatcctatcagaaacgagtcacaccctagactttcaggaacaataatcctggaatgagcactgtttttaccctcaggctatgcttaaccctaaggccaaaatcttgggtctgataagggtcaaattttcaagcaggactaagggtgggaaaaggggctcaaaccaaccccaagctgggtctggtgctgggccagtaatgagtgaccagaccctgggcaggcctaggagatgtgagagaccctgacaagggctgggccagacagagcaaaggccagcctgggccagcttccgactctcccaggccgctctgccctcacctgcagttgtctcttcgaaatccagcttccagttcccacctggcccctgcctgccagggctgcctgcagttgatacacacccctccctggccagggcagctgaccctgcctgctcctctcctgggtgccaggtctgggcagctgcaggtgaccacttccccatcaggctgccctgtcatgaccacctccccacaccccaacc

SEQ ID NO: 10710 - DNA, 18341 bp, Homo sapiens
cggccaggtgaaaaaaatttatccaactttctcaaatccaggaaatgggaaaaactggcctttttctgacattcacctctctcgccaccaccagtagttaataagaaacctggtgacctgagcaaaatatatttctaaccaatatcattttttttcatctagcaaacatttaagcctagtaagtgctgttcattttgctgttaccaataatacaccttacaatagcagctactagttcttgaattcttcttggtaggtcctacattaacactggcaaggattatctcatgttatctttacttgtgtggtagagactataattgtgtccagttgccaaatgaggaaagcaaggcttggagaggttccattacatttgccgtgggcatatagccagtagctgatgtgtagatcagggatttaaacacaatgctgtctgtgctgggccttcaggagggtgggtgagtatatgtggctgaacagtgcatgctgggtacatgggagggagccacatgctgcaggggagggagagcgggtgcagtgtgactttggtggggatgtggttgacagagaagatatgtcttggagaatgagtgagggtttatcagtcagaggaagggaatttcatgcattttgggaggaggtaggagcggaggtggagagagccactgttttgacctcttgtaactttggagttctggggttttggcttttcagagtcacacaccctccagaccacggttgtctgtgagttgctggggaaccggagcagctggggacactggcactacaactgtcatggccaggactcccttcttagcacacttgagtctttcaactccagcaaaagccagccagaaccaagcagagctgcagaaggagagaagggaaggaaacaatccttcctgacctagagctgcgtctaccctctccggaaayacctgaaagctggggtgggaccacggcccaccgtaggtgtgataggtgcggactggttcatgtggggaaggtggaggagctgagggcactgtgggagggatggagtgcaggcccctcagccagccttcaaaactccatttcaatacccatgtcctaaatgaacacagctctgttgctgaccgtcctagccactctgctttccttccctctcccgtgcttggtcagcccttttcccacttggtgttcaagttctgacccagggctgagcacccaagggctctcaaggtggggcatcacctacagtcaccatggaacacagtggaatggtgcctaaagccctggtgtggaggatgtacggcagcttgataggaccagaggcagccagtttgtctgggaggtctttgccaccacttttccctgtcccgctagcccccttggtgcatgggactctctgcaaagcccctggagaggagccatcccaacatgctaggcccttgacttctatcctccagtgtccagctaacttagctgagggatgggctgccccagcccctgagtccctggaaccctaagccacttgcccccttgcatggcgctgctcagatgcccagagccagcagtctgctgtgatccctttgacgtgagcataggctctcctgtctggtgatgcaccaggctgatgctgagtctctgtgcaacctcagatgagcagctggggtttggaggcatgtagcaatgcagttgccgagtgcagtggctcgatctcagctcactgcaccctctgctgcctgagttcaagcgatttttgtttctcagcctcctgagtagctgggattacaggcatgcaccaccacatgcaaaaaaaacaaaacaaacaaacaaaaaaaccaccttttggtatttttagtagagacagggtttcaccatgttggccaggctggtctcgaactgctgatctgaagtgatccgcccgcctcagcctcctaaagtgctgggattataggcatgagccaccgctcccggcctcctcctatatctcttgatcaaacttcaggggaaaacctgccagattccccaggaaggatgcttggaggtaggtggcagggtacagggaggcctatgccaacttctcattgaacaccactcccagctttcctacccccatttctcttcacaggtgtgcagagaagtctacattcccatgtcaagtaaggggggtgggtagatgggagggcatatgagagccgggcagcaattttatgtcttagttggaaggaagtttagagttcattgagtccaaatcctctttactaggtgaggaaactgaggcacaggagggggaggtgccattagccagggagtcagagccaggacttagaacctggtccatgcctcctagtttgttcctgaccaatcctcccagctcacccactccttttgctctcacctctgactccctacaggctacagctagagagttgactcctctatttgaggtaagagtgtctggatttgggataaggtgacctcagtttgcaggtctcatgggggagatcagagggtcctttgttgagaagaggggacttggtccacagtgagcaaaggaatttgtctaaattgctattaagggagatcatctcccaaggtgggccaagcctgaaccctcagccctccatttcttccctttcttttgccttcagattgacaggcctcggaagtcaaaataagtggtttcctagaccgggtcgagagcaagtctctattggtcccaactgagttttttcagctggtttttcaaccaaacagcacctcatctcccagtgaggggaagggaaggctgggctgacagcagcaaggctgctcatctcacctctccccacccagccatgccagccgccacacctggtggggagaggtgggcctcacctgggtcccctggcagtgctctgtgaagggtcttgacattgcactgtaataataaaggtgtgtgtgaagtatctttttatggtgactttctaaaacccagggaatcatgggaccagttctgatgactcagcctggcttccagtctcctccaggcccaacggtggcccccagcactggttggggcctgggagagctggccttggctgaagtgaagccacctacccttcaggcataacaggacagtgagaaggaaggaaagcctgcctcaacctcccatcagccctgagcaccccagaagggggccggctaggagtctaggcatgcaggaggctgacccctgactgggctcatatccagccacaaggcagccagggacccaggcacccaccccttgtctgcgtccctctcgggaatgggcctcttgcccaggccagaaatacaccacctacagtacaaattataatctaaaaacaagagggtggtgttgagtggggaaattggggaaggtgttttaggagccactaggaaaatgggcagcagggactctctggactggcttgggaagagcgcttttggggaacctggaggatggcaagctgagaaacactggtgtggagattccagccaaatcccaggcctgcccctccccctcctctgagaggccgtcttcttggcagacagcagagagatgcatgacaaaggtgccgtgatggttctgtcctggggattgagatggctggggaggggcctcctcctgttccgaagcatgttcctcccacccccaccaggccccataatctacctgccttttgggcagttaaaggccgagaagtgaacacagctgcaaccccactgccttgtagaccttccggcagacctgtggcaggtattgaaatgcacgcatacaattaggctcaaaaagtctacacagacaggagatgggcacacgaacagaggcaacataagagtgggggaaaagtctcaaaagactcacggatgccaccaagatgaagacagctggccacgggacacccatccccttagaaggcagacagagccactgaccccagcagacaagcccaggcagggctgagcctggagcctgcaatgagaagccttacttaagtcgacagaggtcagcgtgcccagtccagacctggccttctggccttcgaagctgtggggagccctggcccagagccccctctggagcccccagacttaccccaggccctccactgagatcaagttttgggagcagacagacaaacatcatccctcacagacaggcattccgttggctattctcttgcaaacagaatcaagcactagaccagcagcatgagcctcaggatactcaggccaggcccagaaaaacagaccctgaaggggagcttagggcagccttcctgcacccctccacaaatcactcgccacctcctctgcgtctttctgccagccagccccactaaacaaagcacatccctcaatcttccgggctcggggagggatgcacgatgaagctggacgcctgagttccccagaggaaggaggaactagatacctaggtccctgtagggggcccttggtgcccgtctgaggctcagtctttgaggggattgcagaggggggttgctggagctccttttagcgtctctgaaggggattctgtgtgaggggattgggactggggggttggggagcaggaagcagtccccaggggagccatccaggcccattcaagggttgagcacttgtttagggttagagctgccccctctggggaccgggattgtccagccaaggccattgtcctgcccccttcccccagtccctcccaggcttctttgaacctgaagtcagatattttttctccacaccccccaccccctggttttccccacccagggcctagggctggaggcctgggccagggaggtgggggagggagaacggggcctaccgtggtattagatgtctgagttttggttgagaggggagcaaggaacctgatgtgcaggttccatagtggagggggcccaaagcgggtgtcttatcactctgtttcagcaaaggttgggaaactgaggcccaatcagtccaaagtctggtcccttgaaggggaagtaggggccaaccccttagtctgttagatgaggagagtctggagtctgattctggaagacggaggggtggggggatggggggtggggggatatagcacggaggccttgtctggcagtctactcttgaagatggggtgaaatttggcaggctgggcagatggtgccaggcacccaggctgcggggtggctggatttggccagtatcgggatgggaatgcctaggattctggatggatcgggggaaggcataagggagcagctggccattgtgcttatggctgttgatgcattgagggatagcgccacacacacattcaataaatttgaggagctgagagggtgactggcccctgaaggcacagtgccagaggtctgtggagagggggtcaagcacctgggttcctgaagaacatggaggtgtgggagtgattccagacagctgggatgtgcagagcctgagagagtgccagggagcgggttgggagttgaaagttgggtgtggtggctcacgcctttaatcatgacactgggcggcagaggcgggaggatttcttgaggacaggaattcaagaccagcctgggtaacatagcaaggccccatctctactaaaaataaaaaaactaacagggcacagtggtccaagcctgtagtcccagccacttaggaggctggagcagaaggattgctttggcccagtagatcgaggctacattgagccatcattgtactccactgcactccagtctgggcaacaaagtgagaccctgtcttaaaaaataaaaataaaaaaagtttctgtgggggacctgcactgaggtcctggaggggcgccagttgtgtctcccggttttccccttccacagacaccattgccaccaccattaggcaaacatccttcgcctcagtttctccccccacctccctctcctccacccatccagggggcggggccagaggtcaaggctagtgggtgggactggggagggagagaggggttgagtagtcccttcgcaagccctcatttcaccaggcccccggcttggggcgccttccttccccatggcgggacacctggcttcrgatttygccttctcgccccctccaggtggtggaggtgatgggccaggggggccggagccgggctggrttgatcctcggacctggctaagcttccaaggccctcctggagggccaggaatcgggccgggggttgggccaggctctgaggtgtgggggattcccccatgccccccgccgtatgagttctgtggggggatggcgtactgtgggccccaggttggagtggggctagtgccccaaggcggcttggagacctctcagcctgagggygaagcaggagtcggggtggagagcaactccgatggggcctccccggagccctgcaccgtcacccctggtgccgtgaagctggagaaggagaagctggagcaaaacccggaggaggcaagtgagcttcgacggggttggggtgtggggaggtggtcatgacagggcagcctgatggggaagtggtcacctgcagctgcccagacctggcacccaggagaggagcaggcagggtcagctgccctggccagggaggggtgtgtatcaactgcaggcagccctggcaggcaggggccaggtgggaactggaagctggatttcgaagagacaactgcaggtgagggcagagcggcctgggagagtcggaagctggcccaggctggcctttgctctgtctggcccagcccttgtcagggtctctcacatctcctaggcctgcccagggtctggtcactcattactggcccagcaccagacccagcttggggttggtttgagccccttttcccacccttagtcctgcttgaaaatttgacccttatcagacccaagattttggccttagggttaagcatagcctgagggtaaaaacagtgctcattccaggattattgttcctgaaagtctagggtgtgactcgtttctgataggatctcctgtttgggctgtgtgtgtgcgcgttgtgagctgggtttacctccagtcaagtatagggcttgtcttccccggatctctgcctcaggccaatgactggccactgtgttaaggtgcacaccctggcaccccttgtagaaagctggattttgattgacttcagcctcagttccaaagttgtaaacaagaaaaatggtgagagatttctccaggccatttgcaaatatagagctgctgcgggattgaaggcatccagccctgctgaggactattaaagatgtatcttccagtcctccaaggcgacaagtgtaagcaattagagattaaatactaagccttgagacctcacagaaaggtgtgactggtttctggagtgaccgagaagccccaacctcttcgcaggaggtcactgctgagccttgaatgataatggctggcaattgtggtccacttcctaagtgcctggctgtgtgctccgtttatacatcattatctcattaaccagcacaaaatctcctagggggaggtattattatcctatttaacgggttttaactgctaaatgatgaagcgaggatttggaccagtgtttattccaaaaccccaaaacagaatttggaaaatccaggatagcagagggcatttatcagtttgagttattggctgagcagaagttggggatgaaaacagcctatttgaaattgatatgatcaagcaccattgaaacacttccttgaggcttcaggactacaaaaaggccttgtttttttctcactagctgtgcacctctgtccgccggcagcctcatatggcatgccccagggctcagtccttcaacctctgctctatctacccttccttcctctcacccaccctcaaggcttaaatgccatttagacaccagatgactaccgcgttttctgtctcttgtgatggctccctgaactgctccaccctgatcacccagttgctcaaggccaaacccagtcatcctcagtttctttcacgtcctacatcctatccttaagaaacatcctgaatcaatcacaacctaaccctggcctcagccaccatcatctctgctgggattaccgcagtagcttctcaaattatactgcttcctccctactgtctgtggccaacacgtcaactagagtcagtgttttaaaaggtgtggccaggcactttgggaggccgaggcaggcgaatcacctgaggttgggagttcgagtccagcctgaccaacatggcgaaaccccatctctactaaaaatacaaaattagctgggcgtggtgacgcatgcctgtaatctcagctactcaggaagctgaggcaggagaatcgcttgaacctgggagatgtaggttgcggtgagccgagatcgcgccagtgcactccagcctaggcaacaaaagcgaaactctcaaaaaaaaaaaaaaaaggtgaggctaggtgcggtggttcacacctgtaatcccagcactttgggaagccaaggtggacagatcacttgaggtctcctgaccagcctggccaacatggtgaaaccccatatctactaaaaatacaaaaattagccgggcatggtggtgggtgcctgtagtcccagctactcaggcggctgaggcagaatagcttgaacccagaaggcggagattgcagtgagccaagatcacgccacagcactccagcctgggcgatagaacgagattccgtcttggggggggagaaaaagggtgagagatcatttcacttggactaaaacaaagtcactatgtctgcaacaggatctacctagccaccagaccagctttgggctctggaaggcccacttcagggccttgccacattagactcttgtcctttgctcaaacaatcaccttctctgtctttaaaagtgtcaccctcctccataatctccttccctcctttaccctactcctatagactgctttattttttttttaatttttgagatggagtctcactctgtccctcaggctggagtgcagtggtgcgatcttggctcactgcaaactccacctcctaggttcaagcaattctcctgccccagcctcctgagtagctgggattataggggagcgccatgatgcccagctaatttttgtatttttagtagagacagagtctcactatgttgaccaggctagtcttgaactcctgacctcaagtgatctacccaccttggcctcccaaagtgaagggattacaggcatgaccactgcgcccggactgctttrcttttttccataatatatatatattttttaaatagaggcagcaggggtgggagaaggggcggcacgggtctcactatgttacccaggctgctttctaactcttgggctcaagcagtctgcccaccttggcctcccaaagtgctaggatttacagacatgagccactgtgcctggccattttttattttatttacttttttatttttcagagcaggagtggaagtttattattaaaaagttatagggcagggaaaaaaggaaagtgcacttggaagagatccaagtgggcaacttgaagaacaagtgccraatagcacttctgtcatgctggatgtcagggctctttgtccactttgtatagccgctggcttatagaaggtgctcgataaatctcttgaatttaaaaatcaattaggatgcctctatagtgaaaaagatacagtaaagatgagggataatcaatttaaaaaatgaggagtaagtacacacaaagcactttatccattcttatgacacctgttacttttttgctgtgtttgtgtgtatgcatgccatgttatagtttgtgggaccctcaaagcaagctggggagagtatatactgaatttrgcttctgagacatgatgctcttcctttttaattaacccagaacttagcagcttatctatttctctaatctcaaaacatccttaaactgggggtgatacttgagtgagagaattttgcaggtattaaatgaactatcttctttttttttttctttgagacagagtcttgctctgtcacccaggctggagtgcagtggcgtgatctcagctcactgcaacctccgcctcccgggttcaagtgattctcctgcctcagcctcctgagtagctgggattacaggtgcgtgccaccgtgcccagctaatttttgtgtttttagtagagacggggtttcaccatgttggccatgctggtcttgaactcctgacctcgtgatctgcccacctcggcctcccaaagtgctggaattataggcatgagccaccgcgcccagcaaagaacttctaaccttcataacctgacaggtgtkctcctcgaggccagggtctctctttctgtcctttcacsatgctctgcatcccttggatgtgccagtttctgggggaagagtagtcctttgttacatgcatgagtcagtgaacagggaatgggtgaatgacatttgtgggtaggttatttctagaagttaggtgggcagcttggaaggcagatgcacttctacagactattccttggggccacacgtaggttcttgaatccsgaatggaaaggggagattgataactggtgtgtttatgttcttacaagtcttctgccttttaaaatccagtcccaggacatcaaagctctgcagaaagaactcgagcaatttgccaagctcctgaagcagaagaggatcaccctgggatatacacaggccgatgtggggctcaccctgggggttctatttggtgggttcccctctgcagattctgaccgcatctcccctctaaggagtatccctgaacctagtggggaggggcaggggcagactctaccctcacccatgaagaggagtagggagagggagaagatgcttgggctttgagctccctctgggaagaggtggtaagcttggatctcagggtcacaagggccctgcgtgctccctcaytttgcttctcttttgactggcctcccccagggaaggtattcagccaaacgaccatctgccgctttgaggctctgcagcttagcttcaagaacatgtgtaagctgcggcccttgctgcagaagtgggtggaggaagctgacaacaatgaaaatcttcaggaggtaagggtgggagggggatacccggggaccttccctttcttggcctaatttccattgcttccatcactggctcgtagctctccgtctttggtgcagtggttctcagtgggatggagtgaaattcctcagttctgctgggataaggtccagagccaacccttccaggatcctgccttttcacaccaccacctggctctgctgacacatctagtcacagacccctgtgatgctgttactcagcaagtccaaagcttgcccttgtcacccccttcccacctgcacagatatgcaaagcagaaaccytcgtgcaggcccgaaagagaaagcgaaccagtatcgagaaccgagtgagaggcaacctggagaatttgttcctgcagtgcccgaaaccsacactgcagcagatcagccacatcgcccagcagcttgggctcgagaaggatgtgagtgccatgtctctctgcrggctccatctctttcccctgtcaccacctcgctttccctagctctggctcctccaactgctctagggctgttggctttggacagaatgtccaagcagtcaggcctgtctcagctcattctctaatgtcctcctctaactgctctagggctgttggctttggatagaatgtccaagcagagtcaggcccgtctctcagctcattgtctaatgtcattctcctttctgtcattcactkgcaggtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctcygtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcttgggacacagtagatagacacacttatcttggtttgtccttcagttactgaggtggggatgggaatatccaatgctcatacccaagtgaccctgaaactaaggtgccatttacactccttaaggtcacacaacatcagagggagagctgggattgcagccaagtttatttgtacagggccctgtgataggctagttcccaaaagcctgtgatgcaagaacttttgcccatagactcagtcaccatgtagctgttacctgttcagagctggctttttgctttcccaccctactctggaattcttaaatggctttatacttagaaatcatcttatttctgttgaacctagatcaccccaaccagaaacttctattaatactttgtgctttcttgataccagggtctatttggtttccacttaaggtttttgcatactctgcccataagtgactcattagttactcaagttttattcctggctctgccactagttcattaggggtctttgccccagagtcatttcttccatgtaaaaaaacttgggctcattaaatctaggtaggaaagggcggatgtggcaggttttaatagaacaggtcaagataaggctttatttctatagaaatgatgctttgacaatagtttggcttggtgtaaggctcacaaaagaaaatcacatgtaccatgtgtgggttaagcggtttgattcacactgaaccaggccagcccagttgccctctgctgtgtccacccgtggagtggagctgtgtcacagccatcacactggtaaactgctgtagctggtttaccaggctttctcttgccctgacagtacaggtgaagcctgtaaataaatcttctgctatctttgtgaacttaaccaaatcccagttaccttatttaaatggcaatagatctgttttcccttaaactagaaaccttaattacctgtattcctacctccagctcaacccatatatttgcacctttccagtaagcaggtttgtatttccatctctccccttcccctaagattctgaattagttctccagaccttgccaagcacattctccctggaaagcaaggaatatcacagacccacaagaagagtaaatgcccaggagtgaatgaagcggcttgtccttgacttggaaataaaagcaaagctgtgaaaagccaggtcgctacgattttgttggcagcaggactagccacagagtagggaagttttggggccaggccctaggttttcccagaatgccttgggtgatgccaccaagaaccttaagaactccctcttacattttccatcggttgcaggcatggcttttgcaactgataggtgctctgactacagatattctggtgtccatggcaacarggccttatggcttgtaatagtgggaacttccagctcactggcaatttcctggaggtggcaatatctttggcaggaaaccatctcttctgtcttggccaccagggtctgctccaggccctgaatgagtccacatcaatccatccttcttccctgtagtcattccctcttggggagggaagggaaggggggtatttatcagacctatttgctcgctgctgtgtctactcatgggcaggtgtgtccgatggtgccttggcrgtggaccttaggtctgaatgccagcccggcaccctgggcatcggaagtcggcctccctggcagcctggatgctgcagccaacacaggccacatggaaccagacgtcacagccatcacactgaacccaggccactgtctcttcctggggcaggcagcaacaaggagctgcacagggctccccgcccccaactgcagggggagccatgggagcgctcactgggtacttccgaggacggccacgtcgatttctgaaggaagtgacacagacacaagggtcaccggaaacctgtaggagaaggcctagaccttgccaccctatggctggtcatagggtgaggccacagaggcacagtggtctgagaactaaggtgagcctggactctgtccttaaaaacacatagggtgggcctaaaaacctctagtgtgagcctgaaagttccccatccttaggcactagaagaatggggttaaagccatatgaatgtaaaaagcaggacatgctcactccggttgttttataagcactgccccaccccacctctcatgttctcctgcacatatttttcttttcctatcagagctaacccaggtcttgccattccatctattccacctcccgtgcccatccccccaggcagggggacctcctcacagcctagggatacaaggaatcgaaaagcagtaaaacactgagagggccaagtgaggactccacttacccagtgggagtcagtggggctttgtctacacggagtttcttcctgggctccataaggaccggtggcgggttctcaggaggctcactctcatcatccagttccgccaacactcggtgaacagatttcctccgattgcgttgbggtggagcagaaggcgtggtccccayttccccaggtggggcgggaacaggcaggctctttggtccaccccaactaggggagaaggtgaggggctggggccggagcttgctgaggctgcctatggagtttaggatcagtgtggccttgggggcaggggagaaggtgctgagaggccgctgtggagccccctgggagggcagcataggccggaaaccagccccaacccgggcttctcccctagaccgtgggatggtaatggcagcaaagtcctgaggcttgactcgtacttgttggaacatgaagtagaactccgaggggctggttcctggggrcccttcagggccaaaggtcaggaggtctccatcactcaattccagcctgtgacctcttgggagtcggacattattgaccaaagtacctgttgatggtggggcaccaggcaaatatggaggacaaaaacagaaatgaccagagtcaggagtggagaaatctgtatgatttctggggaagaatatgaaactgtagtcagattctccctcacatcctaagcccctcagcaggtgacaggtaccaggcagtacactccttgtcagctaggaacaagtctgtgtttcttgtgctttcctacaaaggatccctgccctcactgtcctaaggtccaattttctttctttcttctttttttttctttcttttttttttttttgagatggagttttgctctattgcccaagctggagtgcagtagtgcaatctcagctcactgcactccgcctcccaggttcaagcaattctcctgcctcagcctcctgagtagctgggattacaggcatgtgccaccacgtctggctaatttttttatttttagcagagacagggttttaccatgttggccaggctggtctcatactcctgacctcctgatctgcccgcctcagcctcccaaagtgctgggattacaggcgtgagccaccgtgccccgccctaaggtccagttttcaaacatgctcactctcccccagctccagctcgttcagatcctagctctaccacttaccagttatgtgaccctgggcaagcttttggtttgtttgtttgtttgagatggagtctcgctctgtcgcccaagctggagtgcagtggtgcgatctcagctcactgcaacctccgcctcccgggttcaagtgattctgctgcttcagcctcctgagtagctggggttacaggtgcacgccaccacacctggctaatttttgtatttttttttcagcacagatggggtttcaacatgttggtcaggatggtctcgaactcctgacctcgtgatctgcccatctcggcctcccaaagtgctgggattacaggcgtgagccaccgcgcccaggctttttttaaaaaattaattaattttttggtagagacaggttttcaccatgttgcccaggctggtctcgaactcctgagctcaagtgatccaccctgccttagcctcccaaagtgctggattataggtgtaaaccaccatgcccagccctggacaagttccttaacctctttgtgcctcattttcctttactgtaaatgaggataatattagtaccacctacattcaatacacttaaaatagggcctggctcataacagtaagcactagatgaatgttggctactatagtctaataaccataacactcctacagctgactttaccaagaggcagtggcaaaactcaaatgtgaatctaggctttctgaggctaactgcctcaagtcacggagaaagacatgcccagattattaaaaacattattcaacatagaactgccctaacccaggaacagagtgcctcagcaaagctggaaactgaatcaagtctaaacttggcctctagtggcctcagaacatccccactgtgatatctttctgatgatatcccaggtcctgtatgagctaaacgggaccaaaaagggtcagtctggcagagagcttctgactgtgcacacttctggtgggaagatgaaggtctggaccacgactatccatccaatctgatgggagtatgggaggcaggcagcaaggtcttgtggagaccttactcattccagcctggcgcttcaaccacccaggggcaaagctgccctgcttaatgctcaccttggctgctgtggtcttccaggctgaccctccagtcatcaccccggggctcggcatgcagttcggcgtggatcccagagatgaggccaggctcctgctggggccgcagggccacatcacacaggtcggccctgtggcccaagcgataggtgcagccagcccyggcgggggggtggaaggtgtagagatcaccgcccctgccgccccctatgcgcagcagttggaagcagggcagcatgggcggtgccccctctgcaccacctcttccacttcaggcatccatttcctttcccactcctgggccacgcaccgctggcttaagttcgcttcccagtctgatgcaaacttgagttgtgctgtatgcggtttcaactttgagcacactacctgaatagcccaaattcagagtgcaagcagcctaggactcaatgcaaaattggttaagccgacttgcaaatgaaaaattccaggaaggtctccgtgcaatgcaaactcaggaacacgtcctatggcacctcacttgagctggatcctcagatcacaaaatatttggggagcctccaatctgcaaggcaaggatactttaggcagctcctgtgtgtgtcggggtggcggggcgcggggaaggaggtcctgttatacacacgtctacgtgcaatacgaacacatcacctctgtgtaattcggagaagagcagcttcttcctgtcaaacttgcttatcctaatagagcactcctgcttgcctgcgccccgatcttctggccaatccctcactcataactggttgaacctccgagggcaatgaatccactgtcatcccccaaaagaaagtgcaaacgagtccttaagtactccaacaaattggacctaaacccctacttcccggcttctctaggtgggataaaaacaggaaggagctccccgcgatcatgcaaggcatacccggccttttcccactccgccccagccccgtttcggatctacccgcgcggcgcagtctccgagtagcctcctcttcaagcagtgccagcctgtgcggcggatcccgggaccccttgggctcctcggcaggagccgacgttgctgcatctgtttgacagccaagaagccggggccaggaggggcgcggcctctgcgcgcgggcagcgcctacccctccttcggaattcccgggcccgaacttcgcgccgagcgagcccgcccccgtgccgttcccgattggccagctcatttgttctcttccgcgccattggacagcgccccaagatctcccgccttccactttttctgattagttcacaagttttcccgggttgccgcagtgaggaggagccgcctgggcgcggagatgctccgacgcattta

SEQ ID NO: 10711 - DNA, 48678 bp, Homo sapiens
ctaggtggtgccctctagcttctgtctcccagggaggtcttacctgcatggtgtctggtctcctcaactgggtctggcagaacaacttctggccaaggtggtgaactcagggatgttttaggaacatatctgtaaaacacatttcgtagacaaatgtcacaagcacctgaaaaggcagctcaaatcctctaagaaatggccacacacaaatgttaggaagggatccccggcaacaaaaggctcgctctttcggacaggccccgcccctctggggtaaccccgaggacaggctccctgtatccttttagaaccacagggaacaatggctcatcattcaataatcaaagcaggaactctcattgttctgcaaaagagccctcacttgggtacttctcagtgctggaagggtgcccatccaagaaggctgggcttgtggtgtcttggggcacatttatcttggaggcacaggctgcctctactttccccacaacccaggacacagggccagcagctctcccgcctcccttggcatccagtggccctggaatggcagctccaatgacccttcaccacatcctgctcaaacaggaccatgacgttccctgctccacctccacctcctcctaggtaggtgcctgctcttccttcacacccaggtgagtgccaggcagaactggctcggaaccccagacaattctgtgtcctggtgtctacaactgagcaaatgggaaaacaagcacccgcctgaaagggctgtgttaggtattagatggctactgttcacagccggtcccagcatggccagtgagggtcgggtgttaggagtgctcagtctcagcagctatagcactgcggtccccagccacttcccctccccaccstcaggatgccaagcttggtgcgggcaatgccttttttttttgagacggagtctcgctctgtcacccaggctagagtgcggtggcatgatctcagctcactgcaacctctgcctccagggttccagcgattctcctgcctcagtcaccttagtagctgggattacaggcacatgccaccacatctggctaatttttgtatttttagtagagatggggtttcgccacattggccaggctggtctcgaactcctggcctcaagtgatccgcccacctcggcctcccaaaattctgggattacaggcatgagccaccgtgcccagcccaagatcttcttcatttcctaactctcccctgcctgctcagcctcaggtaggtggaggggagaggaagggaggaaagaaagaggggggcctagattcaaaaggaggtggggtctttctttctgtagtctacaaagagggagggtaggtagatcccaaaccgaattattcagaaccgtttttaagcttttattgctgctgccactgcaaagtaaaatttcagtctttctactccagggttgcattaggaggaagaaaacgacttgctccatatgcaaaatgcaccggcctccacaccaaagaccaggcccacccgtcctgttggctggcgcgcaggaggggctccacaccaatctgggagaggaatgaatgctttcccagtggggtagggcttggagctcctagagacatgaactccgtgatctgtggttggtcaatgaccttgagagacaaggaggacaaggaaggtgctgctctctacaaaacgtctttgacctgtttgatgtctagtctccccatacgggttcagcagtgcccagtgtgagaagaacacgctggcaggaaggtgctaacctctcacacaggacacaggggtagtaggcacaacctacccacatgctcacttacaacttcttcctatgctcagaatgttttgccgcttctttgagaagcaagaaagactcccacatctccccactgcagaggatccctggagtcccagcagcagttccagcagccaatgttttgtgagtgctgactgtatgccaggcactgttctaagagctttaaatgtatacatttacttaatcctctccaacacccatgcagatagaaatgaacattacttccatcttgcagaagcctggcgtcccaggctgtgaggggcagccggaactgcaccccgggggggtccctacagtaactgctatccctgcactgctcctgtgtctcccaccagtgagtggaactttgtcgaatgttttctgcagtttatgatacctaaaaatgttttctcaagtataaaattttaacactgaatgtgctttttcaaataatgagtttctcttagagactctgatacaaacttcctcatcagaaatcttgagttaagacttcaagctcctccataataaaagagagcaaacacatacagaatttctctttggtctcttgcagttacgtcttcttttaagggtctcagaaaaataccgtcaaaaaagttaaagctgaaagtggtggtgcatgcctgtaatcccagctactcaggaggctgaggcgggaggaccactttaggccaggagttcaaaaccagtctgggaaacatagtgaaactctgtctcttaaaaacaaaagaggaaatttaaatattattgagaaccaaaaggtaggaagttttgactttagaaagatggttctacaaatgaaaggaaaagaggcaccaaaacccacattttgatattaccctggtagatatgaagtgctctgtgaattgaaccttcgagaagcagaccaaagggaggctgagggaagaagagaaacacagatcattaccattaatactacaaatgcaaactgccctttatgatgctaaatgcacagctgctgctcctggtacatggtatgaaccactgcatgacagcctgcccacagaaacacctaggtgagcaaaactacaagaacgtcacttacagctactggttatatgtgttgagatcagttagccacatcatctacaagcgcctgagaccagaaccacccgtccactaactcatgccttgactaagtgcctggtaggttcagactctgatctgtgcccaagcgtgggagcagcctccaagatggccctgctgggccccgcctcctgctattcttacccctgttagccccctgggagtggcctgtgtgtccaacagctagtgacagacatgctagcacgtggcttctgggatgaggtgataaccaactgggacttccatcttggatgcctgtgctcaccctttctgatctctggccttagggctgccctgctgtgagcagccctacctagaggtccacatggcggggaactaggcctatcgccaacacccatgggaacgaccttgcaggtagattctccagccgctggcgcagtggagtcttgagataactacagcccctgcagacttgcttgctgcaagctaagaccctgagccagaaccagccacttaagctgcttctgtgttcctggctctcagaactggtgtgagttaataaatgttttaagctgctaagttttggggtaatttctgatgtaaccgtagataacgcatacaccaggaatacaccaggaaacaaagacattcaatctactgagaagacaggggatcaaaataagtgcttaggtgtaaaaagcagagaacagtttctcaataaccacttttaaagaaactcagctataatttacacaccataaaaaccacctttttaaagttcacccattagcaccagctccccatttgcatctcctcggctgctttctcctctcctctcccatttgggcatccggggctcaacccttggccttgacctcctctccgcccatggccattcctctggtgactgcatccagtccgatggatttaaacacccccaatgtgctggtgactcccaagtttacacctccagccagggcttctctcctggttttgcatacccacctatctatctgccttagccactcgtgtctgacgagcacctcacacctccagaggctcctcatttcttcccatgcctgcttctcccacactcctccctctcacatgagggcaacttcatcctcccagttgctcaggccccaaacctccatcagttttgactcttctctcgcacactactcagtcaacccattggcaaatccatcccactattaaaaacttagcaggcttctgtacctaatttgcttctagctttgtttttgggtccccagggaacaaacagtctccttcctctcccacaggatttcctttaggtagtcctagagactgtgactgtgtacttccatcacgtctcctttgctcactcttcaaggccccagctgctcactgttttggtcaccttgtctctactcgcttcactgtgtgtctttctctcctaaygcgtgagtctgtacttgaacatagcattggaggggtggtttcatgtaggtaggtagaatggagtaagtcccactgcttttgtaaaaactttcctgcctacttaaacctaagttttattatggaaaatgtcaagcatacaaaagtaaagagaacagaatagtgaactctctcaattatccctttccaggttcaacagttaccaactcatggccaattttggcatctacattgcctctggcccaactctgtgattattattaatttcttaatagactttattttttagcacagttttagtttcacaccaaaattgagtggaaggtacagagagttcccatatgtcccctgtccatgtgcccacagcttcctatcaacatccctcaccagagtggtacaatctttacaattgatgaacctacattgacacatcattgttatccaaagtccatagtctacattaggggttcacccttggtagtgtacattctatggatttggacaaacttataatgacatgtatctaccattatatcatacagaatagtttcactgccctaaaaatcctctgagctccacctatttatccttttctcccccaatcctcttaccccccatgtaactttttactgtctccttagatttgccttttccagaatgtcatagtgggaaacatacaagatgtccccttttcaggttggcttcttttacttagtaacatgtatgtaagtttcctccatgtctcttcatgactcatttctttttattgctgcataatattctactgtatggatgtcctacagtttatgtaaccattcatctcctgaaggacatctgggttgcttccaagttttgggaattatggtactattcttttaatatcgtccaatatagagttagatccagttttccatttttgggggtcatggtgagacatgaaacccaggtttaaaacatacataaacactcatgcacacaaatacacactccaaccattttcaagcagagatttatagagtttttaacggacataacctttttggagcctcgtatcagcccagcgccttaaatacggctgtttcttttgcagaatgagttcagattaggcgaggatatccatcaccatttttcagaccagctcgcagcctgggggcagtggttcaagcacaggctttggagccgaaatgactgcgcctgaagtactcttcttccacttccccgctgtgtgaccctgggcacgttacctagctcctctgagcctcactcttctcccccataacatagggcctataccaaagttcaagggctattgtcagtattcaggctactaactgaaggaatcaaaatctgaacctgggttcccccgactccaaaacccgtgctatattcaccacaaatgcgatcaacacacaaggcaccaggtcggacccaggcacatacgtggcgagaccgcagggagcagcgctcgctctgcgtcctcccttcctcccatatcccaggtctcacctgctccgggccccraaggtctcaggatgctgtggctgcacgcggacgccagccgccctaaggtgaccgtcagggaagatgctgccatggccgccgccatcttcccgcagcctcggccggaaacggaaacgacgcgaaccgcgtgcgtaacgcacgggcccggcggggaacaccggyccgctgtaacaccggcccggcgcagaagcgggacgtcggcttctaggggcccaggccggcggcggygatggcctcggcagctgtggagagcttcgtgaccaagcaactggacctgctggagctygagagagacgcggaggtggaggagcgcaggtacgggaggccgccggcgccgctccctcgcggtcggtcccgccgtgtcccgggcagagtctccgaggggctcggcctcatagtctggggcgggaatttcgtctccgacccttcgagtcaggggcagggatcgtccgtcccctgcttggccacctcccgagttgtcagtctcatcacttcctgggcagcgcgttccgtttggggacccttaagaagcactttgatttcccgacccgagaycccccactaagcttacactcctgggccctggccccgaccccagttccacccgcagcgagttagcagccctttcccttattcattcagtaaacatggtttgcgcccattctcagtcaggccccggcagcatgagtcaggtgcactggctgcccccgatccggccagcggcgggctgggcataagcagagagtcccttcccctccagtgcgtccagggccggctgcgtgcgtgtcgcggggaaagagcctggaggaggaaggcccttccctggggagggtcatggtggcttcaaggagggagtggtgcctgaaggaaaattggagttaagctggtgggtgcggggtagggtggggagccgtcctgagaggtgtggggagccatgtgagagccgggcttgtttccgaatgggactatttacttgtccaaaacaatcagagctaacacttacgtactttccatgcgttaattcttttacacctcatcccatgccaaccctacagtgtaagtttcttttttttctttttcttttttttttttttagacagagtctctctctgtcgcccaggctggagtgcagtggcacgatctcggcttactgcagcttccatctcccgggttcaagcgattctcctgcctcagcctcctgagtggctgggactacaggcgcgccaccacgtcctgctaattttttgtatttttagtagagacagggtttcaccatgttggccaggatggtctcgatctcctgacctcgtggtctgcccrccttggcctcccaaagtgttgggattacaggcgtgagccaccgtgcccggccgcagtgtaggtttctgttactgtcattttccgtctaaggagatggagacagagaggggttaagtaacttgccccggggtgacacagtgtagcccgatttgctgtcaggcagtctgcttccagagtttgcagtcagccatatgtgggtaggatttgtctgagatgcttttgatcatggcaatggagagcttttgcagttatgttgagtttcttagaatcccagctgtttcatttatgsctgtgtgactttgcaggttctgtctctgagccttacttacttcatctgtaaaactgggatgattcccacctcacaggcttgctctgagaaygaaacgatcccctgtcagtcaggtgctcagcgtggtgccaaggacagagtcagcccccatggcagtggctctttctgaggatgctgagcagactggcagggcgagcctgggaagggcctggctaaggagctagtcttctgttctgtgtatgaaggatgggccatcagcggggttaagcaggtgagggaggcgaatagctttgcattttaggaggatttcttgggtctcctgcttttgattggacgtggagaggccagaggtaaggtagttgagaggctctgtttagtccaggtgagcagtgatgtggatttgaaccggggctgtggcagccaggatgagaggcagagaagtccaggtagaaatgggaggggcctgataggacttagtgacagatgggaggagagaggggaatgctgattgaaagatctgtctcaggtaactgagagaagggttgtggcattaactgccctagggggatgtaggaggagcgggattgggagtggagccaattcggagttccattgggacatatttagtgcctgtgagtagatctttatctatgtttctttctcttttacttttcctgggtgggtggaagtagaaactagtaaaaatcctgaagcatcaataccgggtgtcttccaggtcctggcaggagaacatctctctgaaagagctccagagccgaggcgtgtgtttgctgaagctgcaggtatccagccagcgcactgggctgtayggacggctgctggtcacctttgagcccaggcgatacgggtccrcggcagctcttcccagtaacagctttacttctggtgtgtgcgtattgacctagacagacattgaaatttactggcattcagaccgtgacttgtaccctcgtaaagactggattaaaatgaccagttggagaataaagcgttgcaatgaagaactcttaatcagaagtccaacaattgatgtgggttttagttgtctagatcagcgttgtccaaaatggtagccattagccatgcgtggtcatcaaatgtttgaagtgtggcttgtaattgccgcagatacagaatacacaccaaatttggaagattatgttaaaaaaacaattgggaatatcttgagtaatttttctgaatactgattacatgttgaaataatatttttcatatattgggttaaataaaaaatatcttattaaaataatttacccatttcttttctttttttttttttttttttgagacagagtttcgctcttattgcccagtctggagtgcagtggcatgatctcggctcactgcaacctccgcctccggggttcaagtgattctcctgcctcagcctcccgagtagctgggattagrggcatgcgccaccgtgcctggctaattttgtatttttagtagagacggggtttctccatgttgttcaggctggtctcgaactcccaacttcaggtgatccgcctgctttggcctcccaaagtgctgggattacaggtgtgagccagtgcacccagcctcttttaaatttcttaatatggctactagaaaacttaaaactacacgtgactgggtgcctgtaatcctagcactttgggaggccgaggtgggtggatcacttgatctcaggagttcgagaccagcctgggcaacgtggcaaaaccccatctctgcaaaaaaatagaaaaattagccagatgtggtggtgtgtgcctgtagttcctgctacttgatgggctgaggcaggaggatcgcttgaacctgggaggttgaggctgcagtgagctgaaatcacgccactgcactctagcttgggggcaaagtgagaccctctctcaaaacagacaaaaacaaaagaaaaactacatgtgactctctttatgtttctatgtaatgggcagccttggtccagctggtaaacatgcaggatgtgtacttctgtattcccaaccctttcttgtgccaagcatgctttggctaaacttgtgccagcctggttggaaaggagggacagttagaagaagcttcttaaccacacgcctgggatgcttgtgttagacaaccacagccttggaagcctggaggaagcagcgttgccagggctgtactttttactatggaagtgtctctgccttgttttggtggtgacggagttttaaatttcatattttgatttcgtagactttagcccaacaattactggaatactggctggatttggagaagatgagatgagggtattgagagaggagagggccaggaggggaacctgtaggttggagtcagacctgagcagagtttgagattttttttttctgagatggagtctcactctgtcgctcaggycggagtgcagtggtgcaatcttggctcactgcagcctcagcctcccgagtagctgggaccacaggtgcccgccaccacgcctggctaattttttgtatttttagtagagacgggctttcactgtgttagccaggatggtctcaatctcctgacctcgtgatctgcccacctctgcctcccaaagtactgggattacaggcgtgagccaccgtgcccggcctaacttactttcttttttttttttttaactgttactgattgcatttactaaagaaagtaacaaagataaaatatttgaagtatagtggattttattacagaaaatgatattgaagctttccccagtgtcttgtgtcactgagtctttgtttttgcaggtgatatcgtgggcctgtacgatgctgctaatgagggcagtcagctgkccactgggatcttgacccgggtcacccagaagtcggtcacggtggcctttgatgagtyccacgatttccagttgagcttggaccgagagaattcctacagactgttaaaacttgccaatgatgtcacttacaggcgactgaaaaagtaagtggatgggactggaaatcctaagtaccatcttccttcaacacagctaatccattcttacatgcctgtcgcacaaaagagagcaacaagtcatggtgtgggtgtggccctcatgggagttkgtggcagcattggggcagaggctcgggcactgaattgcaggtgttctaattttagttttctcccttggcagagccctgattgctctaaagaagtatcattctggcccagcctcctcactcatagaagtgctctttggcagatctgctcccagtcctgccagtgaaatacgtaagaacttctgagttttcttttttggttgaaatcactactgaaagtatagagaacagtgtgaccttgggccgttttaataagagtttgagaaagtatgactagaagaagtctccctgaacatctttgtaggagtgtctcggagggccttgcatgaactggaccgtcctccttgtactcagtcctaatgaactggctcgttccattgaggttttttttttttttttgagacagaatcttgctctgttgcccaggctggagtgcagtggcgcgatctcagctcattgcaaactccgcctcccgggttcaagtgattcttttgcctcaacctcccaagtagctgggactacaggcatgcaccaccacgcctggctaatttctgtacttttagtagagatgaggtttcaccatattgaccaggctggtctcgaactcctgacctcatgatccacccgccttggcctcccaaagtgctgggattacaggcgtgagccaccgtgcgcctggccccattgagtttttagttaaaaaaatttttttttggtggggggggtgagggggggggcggatggagtctcgctctgtcacccagactggagtatagtggcatgatcttggctcactgcaacctccgcctcccgggctcaagtgattctcatgcctcagcctcctgaatagctgggattacaggcacacgccaccacgcctggctaatttttgtatttttagtggagacagggttttgccatcttggccaggctgttctcaaactcctgatctcaagtgatctactcacctcagcctcccaaagtgttgggattacaggcatgagctaccgtgcctagcctccattgagttttaaaataatgttctttttagtgtatataaatcttttattttgaaatgtaatgatatttcttttagcttagtactttgtgaaaatagaggaaagctgatcatactttatgcttgatagcaattttaggttggaaaaatcttttttttttttttttgagacggagacttgctctgtcaccaagagtggggtgcagtggtgcgacctcggctcactgcaacctccgcctcctgggttcaagtgactctcctgcctcagcctcccaagtagttgggattacaggtgcccgccaccatgcccggctaatttttgtattttttagtagagacaacatggtttcaccatgttggtcgggccggtcttgaactcctgacctcaggtgatctacctgcctcggcctcccaaagtgctgggattacaggmgtgagccaccgtgcccggtctgtgcactttttatgtcctttgctgttcttggagaacgtcatttttgggaggagtttgttgtctcatccagtcactgcccatgatttaacagtcctgtgagtattggacttggcccatttgtaaagcggtggctttggccaagcctcatgcaagggttaccccacagctattttctatcatactgtgctaggcaagccagtgttgtgttagcttcaaacacacaggaygactttgtagcactctttcagcatgcagtccctcaagatgtgttgtttttaaatactcattttctttctgcattttcctttggaaattctaaatgcagtcacatttcagtaatgctttatttctatgaaatatttactgaagggctcctatgcgtcacaaactgaattagaaatgtatttactgtgtcttagggactctggaatggcttggctagagcacgggaacgtggggttcaatggcctgttactagctgcacaccctgccgtcttccatgttggcttcagtctcacaagtcagggtcagcaaacaccctttgcttatgagctgctccttatccgataggcgtctctgtgtagtgggcaccatgtagcgaatgccatggctgcagggctgagcacagcaccacctgctctcaagagcacagcataagaagcaggtcttggccaggcgcggtggctcacacctttagtcccagcactttgggaggctgaggccggcagatcatgaggtcaggagatcaagaccatcctggccaacacggtgaatccccgtctctactaacaacacaaaaaattagctgggcatggtggcactcacctgtagtcccagctactctggaggctgaggcaggagaatcgcttgaacccaggaggcggatgttgcagtgagctgagatcatgccattgcactccagcctgggtgacaagcaagactccatctcaaaaaaaaaaaaaaaaagaagcagatctttagtcttggtcgtggaagattcaaaatagaaacacgatcctagaatttgttaatcattgtttttgtcatttgtctttatcattttatgggcactttaaagagggacattatgttagaaaggaatatgctctaggaaacatttccttcattcctgttactctagagcaggggtttttcctgtaaagggatggattgtgaatgttttgactctgtgggccatatcatacgtaccgtctacagctgcctgctgtagayggtatgtaaatcaatgggtgtggctgtgctccagtaaaactcaccaaaaccggcagctgactggatgtggcccacagtttgcckattcctgttcaaggagaaaccttgtgaaaataaagcagacttaattttgtgttgattgggttgccyctggggaggtccggcgtgttcctgacaggcatcactcatcccccggggcacacactctctgaggaggaacacccacagagctccccagagcacctgagcctcacgctgctgcttcttccacagacccgctgacattcttcaacacctgcctggacacctcccagaaagaagcggtttyatttgcgctgtctcagaaagaacttgccatcatccatggacctcctggcactgggaaaaccacgactgtggttgagatcattcttcaagctgtgaaacaaggcttaaaggtgggcagtgcatgccacttccctgtcagagcccgtccgctcctggtctgttgtgttcagtgggtgctcagcgacctttcagcctcagttctggtgggatgggtcaggaacattactgagcatttattgattgagccttggactgcccctgtttgatttccagcatccccgtgagtcttggggagcacgcgcaggagccgtagcctgggttgttgaggaaggctcctggagccctttgaggcgtggcagccttcgtgtcggccaggccctgggtcagggtttatttgttcaccacgcttgctgtgctcgtgctcctccgtgtgcacgcccgtgcaggggcctggagttggcctgggcccggtctgtgcccgtcaggagctcagcgtctggttgaggtgttaacagctaatcagatagtctggttaatggatacgatgcacatgtccagtgcacagatgaatgattttctgagatgtggaatataacattgtacattattattcacttacattttaaattttttttatttttattttttggagacggagcctcactctgtcacccaggctagagtctggagtgcaggggcgggatcttggctccctgcaacctccgcctcccgggtttaagtgattctcctacctcagcctcccgaacagctgggattataggcgtgcgccaccatgcctggctaatttttgtatttttagtagagatggagtttcaccacattggccagtctggtctcactcctgacttcagttgatctgcctgcctcagcctcccaaagtgctackattacaggcatgagccactgtgcccggcccagttacatttttaatggctgaaaaaggatcttttatcatcatctgcatcagcttgagtcattgtggatcttggcacatggagagtttttttttttttaatttatttatttatttttaattatactttaagttctagagctttttgaaaaaactttctggtttataaaaatgttggataatgatgagaattggaataatggccagttttgtagtttgatgtttactgggtgctgcctaccaccaggcatcgttctgagcacccatttaatcctcactgaaaccctgtgccaaggcaggtggttagtggccccagtttgtagacaaggaagccgggtgtggtggctcacacctgtattctcagtactttgggaggctgaggcgggtgggtcacctgaggtcaggagttcgagaccagcctggctaacatggtgaaaccccgtctctactaaaaatacaaaacaattagccgggtgtggtggcacacacctgcaatcccagctacttgggaggctgaggcaggagaattgcttgaacctgggaggtggaggttgcagtgaaccgagatcgcaccattgcactccagcctgggcaataagagcaaaactccatctcccaaaaaaaaaaaaaaaaaaaaaaaaccaaaaaaaccacgaggaaactgagaaacaaggtcaaatgcccagcactcagagtggcagagccagcaatggaactcgggcagagcgcagggaagcctgtcacttgcttaaaagattacgtccagcggttttccaatgtgtgagtgtctttgcacatgtttgaaaactggtaagaaaagatgacttattggaagggagcagattggtggttttaattgggtgccgactattcactaaaagtgagccaagacacacctgtgtgcacgctttggtggagatatgcctttggacatgccagtggggttggaggcgatgctgggcatagagagtgggtggctgagcctccttcctgagctgctgtttgttttgagcttaagggcctgtagagactctgcctcctctgctggttgccacctcctcttttttttttcctcagagatggggtctcactatgttgtccagggtggtcttaaactcctgacctcscaccttggcctcccaaagtgctgggattacaggcatgagccaccgtacttggccagcgtctcacttttaatagtggagctgtggctgggtgcagcggctcatgtctgttatcctagcgctttgggaggccaaggggggaggatcacttgaacccaggagtttgaggtcagtctgggcaacatagcaagacccagtctctacaaaaaatagaagaaattagctgggcatggtgatgcatgcctgcagtctcagctacttgggaggctgagccaggaagatagcttgagcccagaaagtcacgaaacaccaggagtgtggtctaggtcttgctgctcgccacacagaaagccagttactgaggacaagtattgccaaggaagaggctttataatcagatggtgcagccgaggagatgagagctcatcctcaaacccatctccctgactaaaactaggggtttatataacagggaagaaatgtagcaatgtgtaaaaaacaggaactagggagggcaaggaggcacctgtagtggtctggtgattttcagatctttgatatttttttgagaggcctcaatgtccttttctgaggaagaaactcacataaataagtttgaagctttaacagcagatggtcaatttctctttatccaaaaacaactgtccatgggactattgagccggtttctccatgatcctgccactgcgctccagcctgggccatagagcaatttgtttcaaaaaaaaaaaagaaagaaagaaaaatatagtggagctacagtgttcgggagacaactgtgagtccatttgaaacgggaagggttcccttgtccccctcgcagggcgtgggatgggggagtggctcgcttcttcagtgtcctgctgctcagacctgcaggggagcatacagatgggcaggctgtgggctctgacctcatggcagtgtctaggggtgaatgtttacagctctgkgagttacaggrtgctctcttagtttgccgtctataggtggcttatgttaaccaactcaattagatccccttccttgtcacaaggacagagggctttctgtatcctgggttcttgccttggggtaccggaagaatcggatcacacgtgggcttggaaaatgaatgcaagatttgattgagagcacgtgtgtacatgccttgtgcttctttctacctttaaggctttttgttgttttagtgtcaacttcagtggtttgattacaaagtaaatgaccagatcctaacttgcggttcccaggttctgtgctgcgccccctccaacatcgccgtggacaatctggtggagcgcctggctctgtgtaagcagcggattctgcgcctgggacaccctgcccgcctcctggagtccrttcagcagcactccctggatgcggttttagcgcggagcgacagtgcccagattgttgcagatatcaggaaggacatcgaccaggtctttgtaggtgtcatggccagtgtccatgtggggcgtgggcttctgatctgcagtctttttaaggagcaaatttatctgtctgcattcctcttgaccttctcttgcttctgtcgattcctttaataattttaaaaattgggctgcccttttttttttttttttttttttttttttgtgacagagttttgctctcattgctcaggctggagtgcagtggtgcaatctcggctcactgcaacctctgcctcctgggttcaagcgattctcctgcctcagcctccctagtagctgggactgcaggtgcgtgtcaccacgcctggctaatttttctatttttagttgagacagggtttcatcatactggtcaggctggtcttgaattcctgacctcaggtgctctgcccgcctcggcctctcaaagtgctgggattacaggcgtragccaccatgcctggcctttgtttttgtttttttttttgagatggagtctcgctctgtcacccaggccggagtgtagtgctgctgtcttggctcactgcaggctccgcctcccggggtcaagtgattcttgtgcctcaccctcccaagtagctaggactacaggcatgtgccaccacacccaaccaatttttttatttttagtagagacgggggtttcgccatgtgggccaggctggtctcgaactcctaacctcaagtgatccacccgcctcagcctcccaaagtgctggattacaggtgtgagctactgtacccagccagggctgcccatttttgatagagaactatacttagcatttaacagagtctcaactgtcttcagagcacttggttagtaggtgtgaggaattgtaaagaaaacattttccggccggatacagtggctcacacgtgcaatcccagcactttgggaggccgaggtgggcggaacagttgaggtcaggagttcgagaccagcctggcccacatggtgaaaccccgtctctactaaaaatacaaaaattagctgagcatggtggcgggcacctgtawtcccagccacttgggaggctgaggcaggagaatctcttgaacctgggaggtggaggttgcagtgagccatggtcactccactgcactccagcctcggtgacaaagcaagactccgtctcaaaaaaaaaaccaaacattttcctgggtgtctttctgtctggtcctgttgtcttgctagtagtggcaatgggagaaaagtagcctgaacataaacattgaaaaaattggcatcctcctagagctttccgtccattccaccttctccttgtgaaagaggacaccagtcggctggagaagtagggtggtggtaggtttcttccatttgagagggccttttccccccagcccgacactccgacacttttgagctctttggttctcccgtggacgctttgttgtagtgtctgtgctcacgtcctgtcctgtgtgctcactgtcggtactggtactccttggtgtcttagtctcagaggagtgatggcagcagggagggtgctggagccagtctttgctctaatgtctgtgctcacatcttgtcctgtgtgcttacggtcagcacctgcaccctcggtgtcctaacctcggaggagtggcggcagcagagagggtgctgggagccagtctttgctatgggcccgtggcatcgaggctgcttgcgtggctgcttgcatggcagcgtggggatgggccgcctgctgggagggggaggaaggatagatgcatgtcatgcaggttcgaggtggtggaggaatatgcatgatgtttgctcatcacaaatgtgggtgatttcatttcctgttgaaattggtgcttttgaggattttctttctctgtaaattatacacagtaaaatacctcctgtcacccctgctaaaactccatcccccaaagtagaaatcacaaataaggaaaggttacatcttttttttttttttttttttttttttaaagaatcttgctctgtcgcccaggctggagtgcagtggtgcaatctcggctcactgcaacctccgcctcctgggttcaagcaattctcctgcctcagcctcccgagtagctgggattacaggcacacaccatgcccagctaattttttgtatttttagtagagacagcgtttcactgtgttggccaggctggtctcgatttcctgagctcgtgatctgcctgcctcgggctcccaaagtgctgggattacaggcatgagccaccgcgcctgaccagttccatctttttgagatattaaagtaagttgaggttttgattatgggttgaaaaaattttttttaatctcttgaaaaatgtagaataatatgtgaagctcagtctctctattcgtaagctcctacaacccaaatcctggggcgggcaagcgctttttcttccccaagatcaaatgcctgtgtgcagggcagggctggtccaatttctggtctcctctgagttaaaaacgtggtctctttccaggacttaaaatgtctcttcctgtgacttcaaggcaagtgaggatgtaaggtgcttagttgcgtgtgtgtatctgtgtctctttcaaggaagatttctgagtgttttttacggagtttattgaactggactgaatgatagaagcacttcataaatagagttgaagaagtacaaagttggactgaagtaagtgtatctcctttgtttttctttataggtgaaaaacaaaaagacccaggataagagagagaaaagtaattttcgaaatgaaattaagctgttaagaaaagaactgaaggagagggaagaagcagctatgctcgagagcctcacttcggcaaacgtggtccttgcaacaaacacaggtgagggggcgtctccatcctgcctgtgtggcctcgaagaaggagttggggtgtgttccctcttctgttttctggaagagtttgtttagaattggtatttctttcttaaaagttgggtagggttcactagggaaggcctccgtacctgcagttttcttcatggagaggttttgaactacaaattcaacttcttcaatagataaagggctgttcaggttgtttttcttccatgagcttgtagctttcaagaagtttgtccattttatctaaacggttgaatttagaggcatgaagtggttcctaatatgcccttattcttcttttactgtctgcaggatctgtcatgatataacctgtattattcctgatactggtttgtgtgctcttttttttcctgctcttctggctggagggttttttttttwaaatttagattttatatatacatacatatatattttaagagacagggtctctgccaggcgcagtggctcacacctgtaatcccagcattttgggatgccaatgcgggtggatcacctgaggtcaggagtttgagacctgcctagccaacatggtgaaaccccatctctactaaaaatacaaaaattagccaggagttgtggtatgcacctgtaattccagctacttgggaggctgaggtaggagaattgcttgaatcctggaggtggaggttgcagtgaaccaagatcgcgccactgcactccagcctgggtgacagagcaagactccgcctcaaaaaaataaaaaccccaaaaccaaaaaaacaaagcaaaacaaaaaaagagacagggtctcactatgttgcccaggctggtctcaaactcctgggctcaagggatccccctgcctcagcctcctaaagtgctaggattacaggtggacccaccgcgcccggcctggctggaggtttcaattgatcttcccaaagaaccagcttttgctttttctctattgtttttctgtttcatgtatttccacattgatctttatcgttttctgttttcttgggcttgttctttttcttgcttcttaatgtagaagctgagatcattgatttgagacctttctttttttctgatacgagcatttagctccataaatgtctccctaagtactgcttttgtggcatcccacaaattctgatctgttatatttcattcatttcaaaatgctatctcatttgccttttggttttttagaagtgttatatagtttctagatagttgggaaatgtccagatatctttctgttgttgatctctcctctcctctcccctcccctccccgtccccgtccccgtcctgtgtgggatctcactgtgttgctcctctcctctcctctcttcttctctcctctcctcatccctgtccccatccccatccccgtcgccttccctatccccatccccatatgggatctcactatgttgcccaggctggactcaaactcctgggctcaggtgattctcccagctcagcctcctgaggagctggggctccctgcatgtgccactgcacctggcttactttctgttattggtttctaatttagttccatgtggtcagaggacatactctcatgacttggatagttcatcgagacttactttatggtccagaatctggtctctgtctttgtgagtgttccatgcacacttgatagaacgtgtgttctgattttattgagtgttctgtaagtagtcagatcatgatggttgatgatgtggttcaagtctgctgtattgagagagggacgttgaaatctctgaatataactggacatgtctgtttttcctgcagttctattggtttttgcttcatatctttggaaactcttttactggggtcataaatgtggggctatgttttcttgattaattaacaaatttatcattatgaaatgaccttctttatccctgataatattctttttttgaaatctactttgtctgacattaaaataatcatttcagcatttcagcttgcttttcttttcattatggtcaaaaacctgtaaaatttaccatcgtaaccctttttaagtctgtagtacagtagcattaattgtatgcatgttgttgtacagcagatctctagaacattttcatcttgcagacctgaagctctggatctgttgaacagcaattccctttttccctgtcccagatcctggcagtcaccattctcctgtctgtttctaagaattttattattttacatacctcaagtaagtggaaccatgcaggatttgtcgtcttgtgactggcttgttttatttagtgtaatgccctcatggttcatccatgttgtccagctttctttttatttttaagagacagggtcccaatctgtcacctaggctggagtacagtggtgcggtcaaagctgtactccagccttaaccatgaatgtgggacctccagcaatcctcccacattgacctcctgagttgctgggattaacaggcgtgagccattgcacccagcccccacctttctttcaactagtgttagtgtgatctatctttatcctttttcttagaacctatttgtgtctttatgtttaaagtgatcttttaaaaaatatttgagacacggtctcactgtgttacccctaactggagttgcagtggtgcaatcatggctccctgcagcctcaacctcctgggctgaagtgattctcccacctcagcctcctgagtagctgggacaacagacacgtgctatcacaccctgctcatttttttgatttttaatagagacaagatctcactgtgttgcccaggctggtctggagttcctggactcaagtagtccttccacctctgcctcccacagtgctaggattacaagtgtaagccactgtgcctggcctgtttatttctttttaaagagagagtcttgctctgttgctcagactggagtgcagaggcgtgatcataacttgctgtagccttgcattctttggctcaagtaatcctcccacctcagcttcccgagtagctagtactgtaggcatgagccattacacctggctaattttaaaaatgttcttttcttttttccttttagagatggggtcttgcaatgttgcccaggctggtctcaaactcctggcctcaagtgatcctcccactttggcctaaagtgaatttttttgtagatagcatatagctgggccttgctttattatccagtttgacagtttctgccgtttgttctttgttatattttcctcctcttctgctttcttttaattaattaattgaacatttcttttttttttttacataagttctcactatgccccatgattgaagatttcttaggaatttatttttatttatttatttatttttaaaagataatttatagagacaaggtcttgctgttttgcccaggctggtctcgaactcctggactcaggggatcctcccaccttggccaccttggtgctgggattataggcatgaaccatcactcctggcctatttttgtttttgttggcttgttagctatatatctgtatttgattctttcagtggttactttaggccttacagtatgtgtcttcaactcatcatagtctgttcatatgccacctcacatatagcataagggctttatgattgcaagctgacatttctctcctcttagcatttatgcttttgtcatatatttttcttatacgcatattctaagacttacaatgcttgttcttgttttaatggtgaattatctttaaagagatctaaataataagaaaaatgtcttcgtatttgcccgtgtagttaccacttttggcgctttgttttcttttggtttaggtcgtgtatttccacgtggcatcattttccttccacctgaaaggcatccatgatcatttcttgtagtgtgggtcagccggtgatgcagtccaatagcttttgtatgtctgaaaatatcttgtttcacctgcagttttgaaagatatttttgctgcgtgagaattctagattaacacttttccttgcaatattttaaagatgttgtccactgtcatctgcctgagtatttctgaagagaaattggtcatccttatccttgttcctttgtatgtaacgtgtcttttttcttctgtctgcatttaagattttttcagccaggtgtggtggctcatgcctgtaatctcagcactttgggaggcttaaggcgagtggatcacctgaggtcaggagtccgagaccagcctggcccacatgtactaaaaatacaaaaaaattagcagggtgtggtggtgggcacctgtaatcccagatgctcaggaggctgaggcaggagactcgcttgaacccggaggcggagattgcagtgagctgagattgcaccactgtactccaacctggacgacagagccagactccgtctcaaaaaaaaaaagaaagaaaatgatgctttctttatcactggttttaagcaatttgactatgatttgccctggtgctatttgcttcatgtttttttttgagacagagtctcactctgtcacccagactggagtgccgtggcgcaatcttggctcactgcaacctctgcctcctgggttcaagcgattcttctgtctcagcctctggaatagctgggagtacagatgcacaccaccacgcctggctaatttttgtatttttagtagagacggggtttcaccacattggccaggctgctctcgaactcctgacctcgtgatccgcctgccttggcctcccagagtggtgggattacaggtgtgagccaccgcacccggcctcatgttttttaacattgtggtgagaacacaacatgagatctaccctcttaaatgtttaagtgtactatataatattgttaactatagacgtcgtgttgtgcagcagatctatagaatttatcttgcacagctgaacctttatacttgcttattgctgagttcactaatttccttctttcatgcctaatctcacatctgtcccatccagtgtaactttcatctgacatccagaaataagagtctttttatatctttgatgttcttatttaatttttttaacatttggaatacaactataataactgttttgaatattctagactattatttctctatcacctgtgtcatttttggtctctttcgatgaactgttccccttgagtggttgtgttttcctacctttttgtaggcctgctaatgtttgtttggataccggacattgaggattttacgttgttgcatgctgaatattgaatatttttgtattcctataatctttttttttgtttttttgttttgtttttttgagacagcgtcttgctctgtcacccatgctggagtgcagtggtgcgatcttggctcactgcaacctctgcctcctggattcaagtgattcttttgactcagtctcccgagtagctgggactacaggcatgcgctaccatgcccggctaatttttgtatttttagtagaggcgaggtttcaccatgttggccaggctggtctcaaactcctgacctcaagtgatctgcctgcctcggcctcccagagtgctgggattggtgtgagccaccacgcccagtctcctataatattcttgtgcttggttttgggaagcagtaaagttacttgtaaacagtttaatccttttgagtcttgcttttgagatgtgttagggtctggatcagtgcttagtccagggttaatattcccctgtactgaggtaagaccctttgagctttctacccaatgcaccctgtatcatgagatttttgagtttgactggtgggattaggtgctgttcccggccttgtgtgagcactgggcacttttctctcattgttttggatggtatttttcccaggcctggagtagttttctcctaagcatgtgctaatcacaatacccaagggaatctcgcagcagatctctggggttttttctctctgtgtagcagtctctttggcattttgtcctggaaactctgcctgcattggtcgccacagattctcagccttgtctcctcaactcagggagccttctaggttctacctggctgccccttctctgtactctctcctggaaactctcaaggcagaaagctggggtaaccccagggctcacctcctttgtctctcgttattcaggggttacttttctttgttacctgttgtctagtgtcctgaagagtgtggtttcagttattttaaaaaaattttaaataactggctgggggggttgttatttgagatgggagagtaaatgcagtccctgctattccatcttgggcagaggtggaggacrcacattctctcttgtagccaggagagagcactcccgttacagagctgtgtaccttgtgactgttgtgggaatcttgtcaaccactcttttggggtttaggaatgtgtttgtgagacctctggtttgttcctgtgtgataatagtaccacaaaggtagcagctgaaaacaacccacgtttattattctacagtttatctgggcggagagcccaggcccggctgaacaaggtgctgtgctcaggatctcacaaggctgcgatcgaggtgtcagtgggggctgcagtctcatctgaaacttgcctggaaaggatctttcttcaggctcacgtggttgttggcagcattcagttccctgtgggttcttgctgggtgttggctggaggscgctcttagctgtttgcccttaggccttgccaacatggctgcttgcttcctaaaagccagcaagagacacagtctcctagcacaatgggttatcgtcttatgtaatgttatcaagggtgtcacatctcatcacctttcccctgttctgtggattagaagcaagtctcaggccccacccacatttgaggggaagggattatgcaagatgtgaataccagtggccaggatcctggggcataccttaaagcaagtttgtctaactaaaggcctgcaggccacatgtagcccaggatactttgaatgtggcccaacacaaatttataaactttcttaaaacattatgagatttttgtctctgtgttttttttttaagctcatcagctattgtcaatgttagcatattttatgtgtggcccaagacaattcttcttcttttaatatggccctgggaagccaaaagattgcacatccctgccttagagtctgtttgccacaacctctcagctggtgggctgctctaaggaacagagtccaggttctttttttttttttttttttttgagacagcatctcactctgttgcccaggctgtagtgcagtggcacaatcttgattcactgcagcctcctcctccygggttcaagtgattcttgtgcctcagcctcctgagtagctgggattgcaggcgcatgccaccaggcccagctaattttttttgtatattttgtagagactggatttcaccatgttggccaggctggtctcgaacttctgacctcaaatgatgtgcccaccttggcctcccaaagtgctaggattacaggagtgagccaccacacctggctagattctaattggctttgtagttattgctttatccagttgtgttttaaatcagacaggagaaaaaargggtcacaagcagaaaatacatttatggggtcttttatatctacccatgtagttgcctttatttcttcatgtagatttgagttactctctccaaaggactccctttggtatttcttgaagggcaggtttgctgtgacagattctctaagctcatctttatctgggcatgtcttagtttctccttcattttttgaaggatagtcttgctgggtatagaattcttggttgacagtctttcagccctttggacgtgtcattccattgcctgcatactttctgatgggaaagcagctattgatctcattgagggctccttatatgtgacaagttgctactctattgctgctttcaagtgtcgtcttttgtcttttgagtgtgtgattatcatgtgttaggtgtggatctctgtgagtaaattacatggagtttgtggaccttcttggatgtttagattsgtgtttttcatcaaatttggggagttttcagccattattttttcaggtattctttctgcccttattctactctcgtctccatctacaactcccattatgaatcagttgattcacttgataatgccccacagatctctgaagctctgttcattttcctccatttttttctttctgatcttcaggctggatcttctcaatggacctctcttcaagtttgctgatcattctctcctgttgaatccttctagtgaatttcagttattgtacttttcaactccagaatttctgtgtggtgcttttttttttttttttttttttttagatggagtctcgctctatcgccagactggagtgcagtggtgtgatctcggcccaccgcgacctctgcctcccaggttcaagcaattctcctgcctcagcctcccgagtagctgggtctacaggcgtctgccaccacgcccagctaatttttgtatttttagtagagactgggttttaccatgttagccaggatggtctctatctcttgacctcatgatctgcctgcctcagcctcccaaagtgctgggattacaggcatgaaccaccatgccagcctctgtgtggtactttttaaaaaattattcctgtctctttattgatattctcttatttggtgagacattattctcatattttatttctttagacttgtttcccttttgctgtttgaacatacttagaatcgctgatatttcaagtctttgtctagtaagatcagcatctgggctttctctagtatccagtttatttatttatttatttaattttttggagatggagtctcactctgttgctcaggctggagtgccgtagcgtgatctcggcctgctgcaacctccgtctcctaggttcaagcgattstcctgccttagcctcctgagtagctgggattacaggcgtccaccaccacgcctggctgatttttgtatttttagtagagatggggtcaccatgttggccaggcaggtgtcgaactcctgactcaggtgatctaccaaccttggcctcccaaagtgttgggattacaggcgtaagccactgctcctggcctcaagtatctgttgattgccttttttcccctgaatattggccatattttcatgactctctacgtgccttgtagttttttgttgaaaatggatgattttaaataatagaatgtagcaactctggaagtcaggttctcttcccaccccggggtttgttgttgttgccacttgttgtttgtttagtgacttttctggactaattctgtaaaatctgtattttttgtcttgcgtggccactaaagtctaatacaacttagtggccagctagtgattagacagaaatccccctgaactcctggagccataaatgccccagtctttgctgagtggctctgtgtgtgtgcttgggcacacctccaacacagagccaggctgtttgtgactctcagctttcacttcccgtttgtgcagtgcgttgagctgagccacagatgagagctgagggcctcccgaggtctttcctgagccctgtacawgtgtgtggccttctagattcccaggaatatgttggagcttttcaaagccccctgaggatatctcattccccagcttaaaactttggttatcctatcatttgctccgaccattattctctgtcttagaaaactgtgatgktcaacaattacctctgattgtttttgacagacaccaccagggaaaaggctgtttgtattacatgagctcagataaagtcttttgagtgtggtctaccagaggattcccagacagatgagataagcacagtttctggagtggggcttttcaggaatgccaaccctgttctgcaccccccggggctggcaggtgctggttttcaccctgacttcaggctgagggtttcaaggctgccatagggatggctgggaatagggcaggtttcagtgccaccgagctcccgtgctgacggggattcagatgcttttctggaatgaacacttccctgattgctgcagcctttggcgagtttccagagttctgagaaagttgattctgaccatttgccgatgtcttgttgctttcgtggaggagagaattctcagagcttgtgagagtctctttgctgacatccttctctggcttcaaggacagcacttgctggaaatcaggaggcatcccctgagccccacaaggtcagcttgtggcctttgtggcctttctgttccctgctggttgttggggaactagagtgagttcctggaagtgcttctccatcatgaagtctggtttctctctgtactgtgaagtcacatctgtgacctaaacatgtctcttaattatccaaagcccagccaagttctgtctcctctgtgggtgctttttctagccatctctgaagagtcaatcttgagaaatttctcagtatgtcttcatcatggcattatgtacatatcattagcataattcactcagatggaaggcagaaagggtgggaactaacattgatcacatttatggaaacctgccttctcgtgctgggcactttatatatgttatctccctttgtggtgcaatctcatgacatgcagtcattgtccatgtttgtgggtgaggaaacaggcttaggggtgggaggctcgcctgaggccccacactgttggctggagacagcgtggggcctgagtcttgctcacagcctgaacgctgcactctgctgctccgcgtcccaggaaggaaaagctgctgcagtgggtttgtgttgccaaatacatggaggcttttttctgggtgagtgcccagcagttgattgttctgtatgtccaagaaagtcaccttagaaaagaattaggttctaaatttagaaaataattgagttacaatatttagaactcagacagcatcccttgggcttggggtcacagccccgaaggggtgattaattttgccaattgaagatcagaggggcctgtggccagagtacccactgcttaagacacaggtgagctggaaccatgagttttaaaatgtcttggccaagtttttattacaagatacaaatttatcccacacagttgcaatgcaagccttgatgaaaccccagcttgatggtgtctcctctggtgtggctgcgctgttgggaagcagctgtgcccctggagactcccggctccctgtttccaccaggtgcgtctgccgatggccccctgaagttgctgcccgagagctacttcgacgtggtggtcattgacgagtgtgcccargccctcgaggcgagctgctggatccccctgctgaaggccagaaagtgcatcctggygggcgatcacaagcagctgccccccaccacagtctctcacaagtaagacccctttgcctcacatgcccttctctgccccygccctcctgcggtccttccacgctcagccaggagccccaggctcaccaggagcccctgcggtgcctcctcggtttctcggcacagctcctaccccgtcttacagcattcattcatctcaacgtcgcatctgtgagatcatgtactccccgagggtggggtcgcatcaccttcatctttgtagcttcagaactggacacagggcctggcacgtttctggtgttccgtccctgcttgttgagttgaatatcccctcatgaaccaggcaggtttgatggtagagtgccgtgagagccttgggctgggctaactggcctctgggtggatgtgggttctttagtcttcaatctgtagacacatccctggatggagggcactgggcagagactcagcaaaccatggttctgccgtgcggagacaccggagccctgatgcagtggcctggcccaggctgtcctggtggagacactggagccctgatgcagtggcctggcccaggctgtcttggtggagaaagtgctgcccgcccccccagcccccctctcacctctccccatactacccagcactcactgcttcagccacacaggcctcgctggcccctctgcctggaccactcctgcctgggtgtggcgggcgtgccctctctccagatgaaccctctgcatggtatcccttgactgcccttacacgaggcctgtgaacagggcctggcacgtgggctgtccttggacaagtccctgttcagaaagttgtccctgaggaatgaaacacttctgagactcctgcatcctggccctcacttccaccgggggaagattgatttcttcagatttcggttgccttttgaaacacttctctgtttcactgtgggtgtgtagaagctatgaactcggaactttcgttgttttccgaggaccggaagaagatgtgcaagaaatcctgtcgagtagaatctcatcacaggggcgtgggcagcccaggagttggcgggtatgtagagagaggtgtcaaaaatagtaattgagagtgagctttgggaggaagatgttggaaataaagatggtggaagaaagaggagtgctgaggaaaggtgctctgaaagatcgtcctggtgggagacacatggggatctagagtggaaatgttacgggatctctggggtgttgatttttctggctggaaacctctgcggccgcagcacctttgcctcagttcttgtcctgcatccaggaagaatgaggtacgcagattagtgaagggtgaagaacagttttatttagtgttagaacagctcagagtagtgggtagctcctctctgtaggcaggtcatccgtcgagtgttcagctgtcagcagaggaggccctggagagggtggctcctctctgcaggcaagtcacttggacatctctgcaggtctctgaagctctcagcagagagcatagatcctctctgccctctccgtcctctggctgtcctctcgccttctctgactgagcccagggcttttatggacctcaagagggaaggaaggatgtgccaattggtccatgggtggccatgggygggcctggaataggtaccatgagtcctcactctggtccacaggactggcagcccagctgccagccttcaggcccttcctggccttccactgtccccttccactcaggactctgtctgcctcccgctgccattcatggccctggggcttggctccaatcccactctgagatccgagtgggtgctgggmgctgagagaggccaggcagtggaagcagacacccatgaccctgcagggatggtgtgggggttgtccttcctggggcgcctgagggtgcaggctgcagaktgggagggcagctacagctgcacccaagagctcccgacccaccacctcagaagaggccaggctcctgcttgttcccggctcctgcctgcttcgtggagcaggaagcccaggtctgcagccacagatctggcggctgcagctgcacgcggaaaggcagatcctacctgttcccggctcccctaagagcaccgggagacgcagatccacagctgcagtttgggcggctgtagcccygcccttctggagcaggaggcctgggtctgtagctgtgaccctgtgtctgggctgcagcggccactctacctcagaaggggcggggctcccactggcttcatggagtgtgcagccacagccagggttccctgctgcagccggcatgatggcagcagccactgccatcagaacctccctgggagcagggaggacaggcgtgggaggaygcttattcagtggcttcttccagggagaggttctcgagatgtccttaaaggaggtcttcatcctctggaaagcctttgggtggaggaagtttggaactgtgcccttgagcagggaccctgttgtgtaggagggagtaggatggtttcgggggaagacgttgggtggcgttccctgcagagagtaggatggttttgggggaagacgttgggtggcgttccctggagagagtaggatggttttgggggaagacgttgggtggtgttccctggagagagtaggatggtttcggggaaaacattgggtggcattccctggagacagtaggatggtttcggggaaaacattgggtggcgttccctggagagagtaggatggtttcgggggaagacgttgggtggcattccctggagagagtagaatggtttcgggggaagacgttgggtggcgttccctgcagagagtaggatggtttttgggggaggacgttgggtgacgttgcgctgagtgttttgggtttgcagttggtactgatcatcgcgtcctgtcctcattttgttggaattaaaaatacrttaatcacagaggtctggtaagtttccagagggaaggtctctgaagtggagctgggtactgccccagggttttggtggggttggtgagccgtagtggtgcagagggtgggctctggcaccaggtggcccgggcaggtcctggctctgcagctcacccgggcagctgtgggctggcagcctcctctgtctcacccttcttacatgtaatatgggagtcataacagtagccacctcatgaggttgttataaggatgaagggagttaatccacatctggcacacccagcagtgcctggcgcctgggcagtgctcagccgctgcagccgttcttggtgggagtggacttgactgctcacagttggagcatgttggagtgtgttcgttccctgttatggctgtgacaaatgaccacaagcttagtggctgacaacaacagattttctgacctccagaaacgacaatctgggggtcagatgtccaaaatcagactcaccggcttaaaatcaaggtgtgggtggggttgcttcttctggaggatccaggggaaaacccatctcctggtcttttccggctcctagaggccaytgcttgacttgttgccctttcctctgtctatgaagccagccgtgttacgtcttcaaatctctccyctcggtgaccttctctgactgaccctcgcatgcccccttataagacccttgggttatcacctgggtcatccagggtcgcctccccatcccaggatccttaacttcatctcagctgcagcgtccctgttgtcctgtaagggaacattcacgggccttggcgattggatgtaggtgcctttggggctgtgattcagccaaacccgccccttggttacttctgggtcagaatccaggggagagttgggtcctgaggtttggggcctgtcctcctcacttsctgtggttcacacctggactctggggctcaggmctgccttccccctttctccctcctgggcgcagggctgcgctggcaggactgtcactcagcctgatggaacgcctggctgaggagtacggcgcgagggtggtgcggacactgacggtgcagtaccgcatgcaccaggctatcatgcgctgggcctcagacaccatgtaccttgggcagytcacagcccactcttccgtggcaaggcacctcctgaggtgagtagctcggcaccrcccgccgccccatccttctgccctggctaatcctctgcgtcacctgtttctacgcagcaagctaaagtgaagctttctgcatgaaagtcgactctgaggctagctttttggaagagagggtggccttgccctggagagctgggtcaggcccgctccctcccttctgatgtcctgatgtgctcattgtcctcccctacctaagccttttcctcgtgggaggggtcggttctgttgggtggggcctcagtgctgcactgtggccccctgatgtgctccctctctgcctgtgtgccagggamctcccaggtgtggctgccacagaagagacgggtgtgcccctgctcttggtggacaccgccggctgcgggctgtttgagctggaggaggaggacgaacagtcgaaagggaaccctggtgagcttgcttscagatggccagcttttttgtttaaacatacctccagctctttaaaaataaaaggcactttaattgcctaattccgggaggagctgagagcagttgttgatggccgtgaaaaaacggagccccacactgcaagaggctgagcagcatcgttttctccagggtgagcagaccgctcytgggtgagaygggcctggcagcattttacggccttctcctgaatggtggcccagctctgcctggctggtctggtgatgggaactgtcattgctcagctgacaccaccatctccccagttccacgttgaacaggatgcacggccataggagtcaaaaggccttcattgctgatgtgaaattcaagttagytgggcatggctggtcctggggccctgggacacagatgattagctcccaggaagccayctgagtggaggatcagctggccatgatagacagaaacgtgcccgaaacacgtgttggtggtggatgcccacttggggcgaccttgtgctgctcacccgttctttctttccctccaggcgaagtccgcctcgtyagtttgcacatccaggctctggtggacgctggtgttccagcccgtgacattgctgtggtctcgccatacaacctccaggtacgagggtttccttttgtccctctacagagcagctggggctcacacaacctagagggtgaaagaaaaagggtgatttgttggctgtggtgaccgaaaagttcaggggtagggctgaccttattgtgactggatccagggcccaaatgatgtcgtcaggggcccctctgcgtgttcgtctgcccgccccaccttgccccgccctgcccggtgccccagccttctgcactggcttgtgttctggccagatttgctgggtgaccccggcagcctcaggctgacacagtccttccacgggcagccctggcggaacagcctgtccttttctggcatttcccacaggagtctcagccttgagccttgctggtctggctcaggtcgtgttcccatgcgtatctcatttggtaggaaaaatgtaccttctggagtatcgggaggatctgtggaagtggccatcataccttcctggtgtgcaggcatcacacatagggctgtctgaggctggcggctgtcataagccaaaagaaatgatcaaatgccagggacagggtgtggtattggcgtgcatgcgtgcccgtgaggagggcgaacgggaagcctttcccyatggggctcctgcaggctccgcttcccaggtcctggctgtttcacagcgtgaggccctctgctgagctgaagggcagggtcttgctgcgctggcatgggtgggtgaggaaaccacagcccggctggtgtttcaggtggacctgctcagacagagccttgtgcacaggcaccctgagcttgaaatcaagtctgtcgatggcttccaaggccgagagaaggaggccgtgatactgtccttcgtcagatccaacaggaaaggtacggagccctcgccagagtcctttggggacagcacagaagtgaatttattgattgaggggcatattgggtgtctgctgggtgccacactggtttctggcagtgtgctcatggtgcascttctgtccttagtaagttcacgtcaggcaaagcacaggcaagagagtctgcagaggctcagaggcgtgagtgtgctgtcagggagcaggtggctggggtggcagctgggggcgcagggtgggctgggaatgatcaggacatcctgccgaggaggtgaagccccctgcagcccagagctggcctttagcctccatgcacggagccgcggggtgtggtggtcgtggctgyggtttctgtgctgcygtggtgtgtgrgctttcccatttgggatgagcattgttcccagaagcaggtttagtgaacgggctttgtgagacattctcagaaggcagaaagcaggtgaggcctggctagaagctatgggggaaagaagggaaggtcctggaaggtttcttgtgctttctccctggtgccagctgcagccacaccccaggcggcccctgaggctgggcttagaaggaaaggagcgacagaacccagtcgggttccccagagccccactcagtcagccgtggcagccagatgccagggcaggtgtggcatcacggtgccacgcgtggccgggcacccgtgtggatggtgggccacgcgcaggggactacacttttggtggtggttactgataagggcgtaggagcctgactgtgtttcttagtctgaaacctgcttctcactcmcctctggccttttgtaggtgaagttggttttcttgctgaggaccggaggatcaacgtggctgtcacccgtgcccgacgccaygtggcggtcatctgtgactcccgtactgtcaacaaccatgcatttttgaagaccctggtggagtatttcacacagcatggggaagtacgcacggcctttgagtatcttgacgatattgtcccagaaaactattcccatgagaactcccagggttccagccacgctgccaccaagccccagggacctgctrcgtccaccaggaccggaagccagcggcaggagggaggccaggaggctgcagcacctgccagacagggcyggaagaagccggctgggaagtctctggcctctgaagctccatctcagcccagcctcaacggaggcagcccagagggagtggagagccaagatggcgtggaccacttccgggccatgatagtggagttcatggccagcaagaagatgcagttggagtttcctccttccctcaattcccacgacaggctgcgggtccaccaaatagccgaggagcacgggctgaggcacgacagttcyggggaagggaagaggaggttcatcactgtgagcaagagggccccgcgaccccgagcagccctgggacccccagcagggaccggtggcccagcccctctccagccagtgccccctacccctgcgcagacagagcagcctcccagggagcagcgtggcccagaccagcctgatctgaggacgctgcacctggagagactgcagagggtcaggagcgcrcaggggcagcccgccagcaaggagcagcaggcctcagggcagcagaaacttccagaaaagaaaaagaaaaaagccaaaggtaagtcaactaataagaacttggggcagtgtcccctcactggggtgctggccccacttggagcccacctgccaccatcaacagaaggaagggcttcctcctggtggcaccgtgcccgtgtcattttagctttattttcagtcatgccactcccagctccgtctgggctcccctaggtcggtgatcaggtcacgggcaccttcttttcccagaccctgtgtgggactcggcaagtaggcagcactcagagcatgtctgcagcagcaggaggggcctggaagagcaaacatggatggctccctggagcccctcgggaatggagcgatcacggggtcccatgcaacatgtggccctggagggtggaggtcttgcacagcgaaagggtgcactctgcctggaagttgtcctgggcaaaatgctcagaaccacaggggctggctgagcgcaaaaccattcttgcccttgggccatgtggagtccctgggtgggctctgccccrtttgccacatcctgcattgtgcccaccccgcaggagctggctaggcgtgcagtgggagttggccaggcatacgctggcagagcgtgtagcggtcttggggaactcctgctactgccattttcctcagcaagagcatgcaggagttccagcttgcattgattcattgaattcctgaagcgaagctacaccagcacatgggtggctttgaaaggggcctcccagagcctggggctccagaggaattcactccccaaacctttgttgagcagctactgtatgccacgctttgtgctagaggacaggactgatgccacccctgcccccaggcactgacagggtagcagagggaagacacatgagctgctttttaattttttttagaattaatagagacggggtctcactctgtcactatgttgcccaggctagttttgaactcctggcckcaagcagtcctcctacctcagcytcccaaaatgctgggattacaggtgtgagccaccgtgcttagccatgaattgattttaaaaccttaaatgaggggccaggtgttgtctttccgtttgcctgagtgacgcgggtcttctccaggacatccggccacagatctgcccamggaggaggactttgaggccctggtttctgccgccgttaaggctgataacacctgcggctttgccaagtgcacagccggcgtcacaaccctgggccagttctgccagctctgcagccgccgctactgcctcagccaccacctgcccgaggtatgtcggcctcccctcctgcgatcaaacagtggggaggggtggtgggttccgtctccaggaagcagaccctgggcagacttgttccagtcggaacagttagctccttacaakctccagataccttcagaaacagaaatcagacactgactcatgatcggttttcagcacatcagggcacaagcaaacaaaatgccttatttgctgagctgcagccacgttagtgggaattctgggcagagggaattttgtcccagtgtccttgggttctgtcagtggcctaatctggtctgtttggcataggggaggtgggaggcagagcctccagcccgtcatctgagctggccatggcccggctgctgtgtcattcattccttgagccggggttgatgagaaccccctgggccaggtgtgggcgcctgtggaaagccgaggtctgaaccagccttgtctctaccctggaggatgctgggcctggtgggggacctgggtaagagaccagcatacagtaccaggtgttgagtgctctgaggaagaaaacccagggccagggtggcagcagggtcaccyacccagatgcagcagtcagggtgggcttcctggaggaagtaacactggagctgagacctgtgggacagaaggtgggagctgggctgggaaggacagggccgatggcgggtgggcaggcaggctatccacccttagaacatgcataaagccccaggcccagtcagagagttgggagtagagtgtgaggcagatggctagagttgaggctgggcatgtcctggcgagctgcctggaggagtcaggcctgatctgaaggcagtggggtaccctctagggtgtcagcagggctgtgatgtyaccagtcttggctgcagtgtggattaggtaggcggaggctgggaggcagtgggaagtggccgcagggactgtgtggtcagtcagggtggtgccatttcctgtgtgcacactcgggggctcccgccacaccagggtgcagaccaccccgccgctctcccgccaggcagcctgcagggtgaaggactgacatggcgggaggagtggccttctctgttggggcgcctgtggccccccagctctttgatrggcagagctgcaggatctgcctccttgcccctgtgagcccagcagtgattcttgtgtcctccccagatccatggctgcggtgagagggctcgcgcccatgcccggcagagaatcagccgggaaggggtcctctatgccggcagcgggaccaagaacggatccctggacccagccaagagggcccagctgcagaggaggctggataagaagctgagtgagctcagcaaccagaggaccagccggaggaaggagagggggacgtgaccggccgcatccttgcacgccycgcggagctctctccatggtagcccagggcgctggcagaccatgctccrcctccaccagggccacagaggagcggaggggcctatgggggaggagcggagggccctgttggggaaggttgggtttttggaccccagggataagcttttccgatgtcacaatgtggaggaaagcacctgggggacaacagtgctcgtgcaggtggggcttgggaaatgcacgtcccttcccctyactccccgccaaaacccacatcccagcctctggatcctggggaaggttccagtccctggagaatacccagggcctcaaacttgaagtcactcctccaatgtctgggacttgccagctcagcccgttaggatgagggtgctgagaggaaacaggaaacaagactgcgaatggcgctcaggcagggagcagggagtggcgtttggcttgcacgttcccatgtggccagatgctggggccactttccttctgtctgctggtgactgcagtgttccccctcctcctcaccacggggctcctgtgagtctggggggcacctctttctggcctgtgcacctctctctggcttataaaggtgcctggcctgtgccagcccctccttgttgcgcctcaccgtggggaccaggtgagcyggctctcccacgtggytgtcccgggaaagctgccccacagcctcagcatcttcagcacttaccgatccagagcctcccggccttctccggtgtcctgtaccaactcttctatttaagagaacctcagatgatgtacctgagcctcagggttttgtttcagagggatataaattatttaaaaattaaatgaaaacgttgcacactgccccagtgtgtctgctgcgggtctaaggggcgcgccctttgcctgttctgctcagctgctgtgccctccccgccgcgtctctcaagccccctctccttctgacctctctgcggcagactctcccggtgcaggctcctctctccttaaatcccattcatgtccttttatgtccccgatggttctgagtgaggttgagcttccctgacctgcacctagggtggctgtcccccagaggccatttacgcagcgcattcggctaatgtgtcctcaggccaggcctgcacgctttgactgccgtgttcttgctggtcctgggcgactctcccttcctacccggactgacgccccaccctgggccactagagcccctcctcctccccctgtcctgtccttgtctgttcccgtcaagtggcttttggactgaattgtttgggaaggggaccaggactctactgcattttgtgtcaagtgcggcagagttaatctggttgcttccataagtgctgagcaccatgcacagaaggctgcagttctcatgctctttgaggacccgtggctgtgggaggcatttgtgtaatgatgctcttgggggatgagggcaccattggaagcatctcccggttgacacagcacacagggacaggtgttcttcctgygggggcgggggtgcctgcttaagctccccaacttcccagaatccaaacagctgataagagtcctgccctggggttgacacggatgctgaaagatgttggctcttgggtgggagacagccgacagccacactccctgcctcctaggtagcctgtctgcaggagagaaggaggccaaagagaaacagacccaaaaatgggggtgggagagtgacctgatgacactgtttgagcacctggatgtagccatgcctgacctccaccccattcttcctggtgtcctgagctagtaaatccccttttttagctgaagaagtctgccttgggtttttgtcacttgctgccaaagaatctttgctgacccagtcatgcccacatctgtttatcttattgggcatacccctcccagcatggaggcagtatggaattagtgtcgccccactcattagagaaggcacgattggaatccaagccctgtacctttatccaggtgttcttctgtgggccgtcccaccaggaggagcttgaagtagaggaaggcagccagcatcagcggcgggccgggcgggtggggggtggaagcttctggaatcggagggacctgagtctgaacgccagccagcaccaccgtccactgaggtgtggcctcagcaagtcacctctcctctctgagcctgtttgtcatctatgaagcaggacgggaacagttgctgccgcgccagctgtgctaagtggaagacatgaagtgcagcatcacgtccttgcgggacctggctccgggtttgtcgtctccctggctgtgccccccagcctcctgcatggagccttctccccttcagcactgaccaccgcggcccttggtgatgcattgttaaaatgccagaacccaaggttgcaacataaaaagtttccatttctcatcccagagaggccttgttaggaaaatatttgtagctggttgtttgaaaagtaccctacagtttggcctggatagggtaacccaagaaaaggaaaaaaatttcccaagccaaacgtctccctggccagctggagtgtggtcttgctgacagtagctgcaggctgtagcccacccgggccggaaccgggtggaagagagtagaggactcccttctaaggagaactgcccacctccacccgtgcggctcccctgaggtagccccgccatgtgctcctttccgggggtgctgggcagggcagtgggcacaggcaggagcccctgccagctctgggctttgctcctgagtttacttgggatgtgctgcgtgccttggggcctcagtttcctcctctgtaacatggggaagtaacaagacctgtctcagggtagctgtgaagatgaaatgatcaaacacacaaggccttgggtacggcgcctggcttctaataaatgtattgccctcctcctcgtcatcttgcaaagcagcagtggagaggaacgagacggcacatgccgctatagaagggtttcagcaaatggcctttcctaccagagacagaggcaagagtgcccaggtcccaagggcccaccggtcagctgctggtggaagtcgcaggtcccccagtgtgggtctgcctggcttccttgcacccaacacagctcgcccccgccctgtgccgagcaggccaagggtgggccaagggcgggcctagggcaggcctgctctgtttaccttggtttgtttggagctgccccagagggatcccagagtgggctgaagggcaccacgctgctttgggaggttttaggcccacgttatagccctggcacttaaaaggaattgtggtcaccactgggagcatagcaaaagctgcagccttatttggtctggaaacttctttgcttgcaggaaaagcagaatggggaagcaggctctcgtgtgggtgggcagattggggccagttcttcattacccagggatatgaattactttgctacctcacttggctctggttttggcttctggccttctccactgaagctgcagctcacaatctcccccagccctcagctgccaatgagctgttctgttgtgcagctttattgaggtgtaattgtcatgccatagaatgcactcgttgtaaatatacgattcagattcgatgatgttagtaaacatggggctgggccacatacccctacccgtccctactgctgggtgctggtctgcagttaatctctgctcctgccctcagccccaggcagtcaccagtcagctttctgtccctataaatttgccttttctggaaacttcatataaatatagactgtccccaactccccgtggttttgacgtaacgattttttgactttacaatggtgcaaaggcttgtatgcattcagtagaaaccaccattctgtgttcatgttcagtacagtattcagtaaatgacatgagaaattcaacactttatattatcaaataggttctgtgttagataagtgtgctcagtaagcgttctgagcatgtgtagggtaggctaggctaagctacgatgcccaggaggtcaggtgtattgaaagcattttcaatctgcaatgttttcaattccccatggatttgtggggaacatattcccatcataagtcgaggaacatccgtatccagccccgtgcatctgcgttcttttacttcacctgatgtttttgaggtttgcccatgtggtggcgtgtatcagtgtttcagttctttttattgtcaaacaatgtcccattgtatggatacacccatttagtgtatccactcatctatcggatattcagattgcttccactttttggctgttttgacccatgaggctgctatgaatattcatcgttcaagtccttctgtgaaaacatgcattttcatttttcttgggtagattcttagaagtggaattgctgggtcataagttagtttattcatttaagaaactaccaggcttttccagagaggttacaccattttacattcctgccagctatgtatgcgggttctagtttttctgttcttgccaacatttggtattgtctgattattattactattaccgccatgttggtgggtatatactatgatctcattgtagttttaatttgcattttcttaaagactaaggaagctgagcacccttttcctgcgcttacgggacatgtagatatctcctttggtaaatttttcttttttttttcttttttttttttgagacaggtcttagtttgtagctcaggctggagtgcagtggcacaaacagggctcactacaatctcgacctcctgggctcaagggatctccaggctcaagggatcctccaacctcagcatccccgagtaactgggactacagacgcgtgccaccacacctggctattttttttttttgtaaagatggggtttcgccatgttgcccaggctgatctcaaactcctgggctcaagtgatttgcccaccttggcctcccaaagtgctgggattacgggcgtgagccaccacacctggcctcttttattattattattttcatagagacagggtcttgcttttttgcctgggttggtcttgaactcctgggcttaagccatcctcctgcctcagcctcccaaaatactgggaatatagcttttgctaagctcccagcagtgaccacaattccttttaagtgccagggctataatgtgggcctaaaacctcccaaagcagcgtggtgcccttcagcccactctgggatccctctgggcagctctgggattataggtgtgagttaccgtgcctggccctttggtgaaatttctgttcaaatcttttgctcatttttaagataaattgaagtgtcctattattgagatataagatatctttaggccgggcatggtggctcatgcctgtaatcccagcactttgggaggccaaggcaggcggatcacgaggtcaagagatcaagaccatcctggccaacatggtgaaaggccatctctactaaatatacaaaaattagcgggggcatggtggtgtgcacctgtaatcccagctactcaggaggctgaggcaggagaatcgcttgaacctgggaggcagaggttgtagtgagcccagatcatgccactgcackccagcctgggcgacagagggagaccctgtctcaaaaaaacaaaacaaaacaaaacaaaactttatatagcctggatagaagtcttttatcagatgtatgatatgcaaatattatctcccagtctttggattctttcaatatttccttaatattgtctttggaagtgcaaaagttttaattttttaaagtccagtttatcgattttttttcttttatggctgtgctttcggtgtcatgtctaacatctctttacctaaattgagatcacagaggtttttcctatgttttcttttagacattgtacagatttagttcttctgttcaggtctgtgatccatcttgagttcattttcatgtatggtattggtataaggcaagggccaaaggttggttggtttggttggttggttgttgcatgcggatctccagttgtctcagcaattgttgaaagactcctgtttcttcacggaatttccttggcatcgtgttaaatattgtttgagcataaatggaggggttcatttctgggttctcaattctgtgccattcatctgtccatccttacgctaataccacaggctcctcccgtccccatcatgagggcagccttctggtcatggagacattgcaagtttacacttagaggcacggcccccacaacccgtctctgactcagcgaaaatggaaagagttttgaaaacatatagccacactcaagataaacacccccgtgttccagaccacagagagaaacagggctggctgggtgcgatggttcacatctgtaatcccagcactttgggaggccgagacgggcggatcacctgaggtcaggaatttgagaccagcctggcccaacatggtgaaaccccgtctctactaaaaatacaaaattagccgggcatggtggcacatgcctgtaatcccagctactcgggaggctgaggcaggagaattgcttgaacctgggaggcggaggttgcagtgagcccagatcgcgccactgcactccaacctgggcgacagagcgagactctgtctcaaaaaaaaaaaaagaaagaaaaagaaacagctggccgaggaggggacgctgtggacctgctagggtcctcgtctggtcaggagcaggggcggcctggagccttttttcctgtgggcaaaaggaacaaaaacggccagttacgaagtgggatctgagccaggctctcactatgaaactagatggtaaggcagggcttt

SEQ ID NO: 10712 - DNA, 67163 bp, Homo sapiens
gatggtctcaatcttcctgacctcgtaatccgcccacctcagcctcccaaaatgctgggattacaggtgtgagccaccacgcccggcctctcagttgattcttataaacaagcaggacagctgctgatgttcttgccagttaatatctcagggtctcagtttgttcttcacagtagggatggtaatgctggctcatgggtttctttgaaaacttcaatgagaagatgagtgagaagtgcttagttagctcagtgtctggtgtgcaggaggtgcttgataaatactagctgctgtgatgatcaagtgatgtggagagaacgctgggctgggagtcaaaaggtggcaactctactagccagagctatgatatgagtcactatttgccttgggcaagtccccttgcctcttgggcctccctttctccactctgtacagggctgagctggatctggggttcttcccgctccaccattgttggtctctgattccccaaacagtgtttaactcaatctagtgcttggggcatgaggatctgcacccaatgctgggccaaatgagaactttgttgggagcagctggctgattggctcagtgagcaagagctttgatgggaagcagggaagcagctagggagccaggcctcttgaggagttttgcagaaaagttcagccctgactcttatcggagccttggaatctgccggttgccatgactacagagacagcatctaagctccaggtctctgattagcaggaacagagccgccgggaggccttgaggaattcggcactcgtggctccctccctccatctgtgaagtggagtgtgccggcccttgactccactgttttagctgtccccaaagatttcggcttcttttaagtattttttaaatgcgatatagaaggaaaatgaggcaactgccagtacttctcagcaaagatggaacacagaatttttcataaggacctgcaaagatgcaaggctggaggtagggaagggagataggtggggctgtggagggctgagggctgtggctgaagcctgattccactgcagcgttgagtgacctcagactctttacttgtacctctgcttctttatttgtaaggagagttaggatccgatctgtggttcccacatgagatcggtaatcacaattcatttgttcatccatccatttattcatttgttcattcaatgaatgttcattgagcaggaagctacacgacggtttccttcttcctcccctcagcatttcctctctgcctggcagaattcattttatttctgttggttttattgcaaaattccaggtgggatacccaacaccaggaaggtgaaataagtgctattggagaaaaagaaaaatctaccacatcagagggtataaagttacataaattcctgcaactccattgtgtctttcctcaccaaatcatcttcaagatttccccatatctgattcctgacccctgttgctgacaatgatggatgaggcactgtcctcaacctaagccttacaccccagggctctggcagtagcatccaccagcttcccctgtacttcagataactcacgcctctactctctccattagacaagtcactgagacttcccacccaatgccagcacactcaccatgtgtttattcaatgctaaattcctcacagttctcagcttttgcctatcatgggattgcttgtggtatcgatttattttctacaatgtcccaaagagttcagaattatattcttatgtgtctccaccttgacatagtaataatgtgtgacttgcaagaattggttacaaagggcagcttctgccttgctctcttggattgatcattgtcggggaagccagccgccatgttgtgaggatactcaagcagccatatggagaggcccatgtgaagaactaaggccttctgccaacagccagcaccagcttgccagccatatgagtgagccaccttggaagtgaactatcttatgtgtcaaggctttgctggacaatacacacaaatcaataagctcactgatcttttctaaaagaaatatgaggttgaacagagaagacatggattgagcagtctgagtagactgaggcattggctgagttactgaccctttctaagattccattcccaccaactataacatcaggaaattagcccaaagcatctcaaaagcactttctaactttttgaaacaatgttctctttggccaattttttaccacttttattgattcattgaaaaaatattgcctgatgttcactaagcagcaggctctgaggcagaaagacgcagtcttgctcgcagggagctcatagtccaatttgatagaagacaattaaatgacaacatattattaagagttgctggcaagggagcaaaggcataccacatcctagaaaaggggatagatcttcccaaaagcttgctccctactctaccttctccatctcctcaatgttgacgccatccttccagttgctcaggctcaaaaccttggagtcatccttgactccttctcctgtcttactctcttacttctcacatttagccagcagtaaatcatgtcagtactactttcaaaatttcttagaatcagaccacatcttatcccccactccattgctactacactgatcggagcttggactattgcaaccatttccccatctctgcccttttctcccttcagccttgtgtccctcaatcactagagtgatcgttctcaaaggtaatccagtccctatcactcctgttccaaagactcttctcccatctcagctacagagagccccaaaggtcttcccatgacctgatctctgatctcacctcttgccactctagcccttgcttgctgttccttattattattattattattactattgttataggcagaggctcattctgtcacacaggctggagtgcagtggcatgatctcagctcactgcaacctctgcttcctgggttcaagcgattctcctgcctcagcctcctgagtagctgggattacagacgtgcaacaccataccagctaattcttttatttttagtagagaaagggttctgccatattggccaggctggtctcaaactcctgacctcaagttatccacttgcctcggcctcccgaaatgctgggattacaggcatgagtgactatgcccggccgctcttccttataatatgttaacaatttttgaacttgctattccttctgcctagggcacacttctcacttcgagcagatacctgtgtagaagctatatataactgtgtaacaaattattccaaatcttttggctgaaaacaacaacaaacagttattatggttcatagtttctgtgactcaggaatttggctgagtggttctaactcatcatctctcatgaagctgtggtcagatgtcaaccaggtttgcagtctcatcataaggcttgactggagctgaagaatcctcttccaaggtggctcactcatagggctaacaagttggtgctgactgttggcaggaggcctcagttcttcttcacataggcctctccatatggctgcttgagtgtcctcacaacatggctaccaccagaatcatcaacccaagagaggaaggcagaagctaccttttgtgaccaagtcttgaaggtcatacattattacttctactacattcttttcattgaatgtgagtcactaagcccatccgatattcaaagggagataaattaagttccgtcttttgatcttttgatgacaagagtgtcaaagaatctaagaacacattctaaaccacccaaattttaagattagtcctgaatccttcaagtctccactcccttgttacttctcaggaaggacttctctgattattatatacaaagtagcagccactcctcccatttcttagctctgtatgctgctttagtcacaccaaaatttattaccattcagctgaaaatggtggctcatacctgtaatcccagcactttgggaggccaagtcaggaggattgcttgagcccaggagttcaagaccagtttgaacaatacagtgggaccctgtctctacaaaaaaaaaaaaaaaaaaaaaaaaaatctgggtgtggtggtgtgtaactgtggtcccagctacttgggaggttgaggtcagaggatcacttgagccagggagttcaaggctgcagtgagctgtgattgtgtcactgcactccatcctggacaacacagtgagactctgcctcaaaaaaaaaaatgtgttaccattcaacaagccctatttttacttgcttatgtatctattcctccatctagaatgtaaacattccgtaatcacaggagacatctccgtcttgttcactgtgtctccacacctgaaactgacctggatacaatttaggcactcaggaaattgaagttaacaaatgcaggttaccctaggccaggacaagtatgggaagaggcaagccttgctgggtgttaggcagaaaatagaagctttgttgtcagacagcagacagggcagcattcctcagagataaatgggcagaagtaaagacatggaaaggtaacccccataggagggaggtttagggaaaactgaggctgagcaggatggaagggagttctggaagcacagagttggcagtgagaagggctgagaagccctaattagaatctccagccctccagggcttgcagtatctaccagctcggcttctaaagatgcactcataagtggctgacagagatggatgtgttttgctgcccttccttcaatattgactgggcttgacttgctctcttagaagccctaaggagcagggggcttatcagatgcattcatcctgagtcataaaaccaatctggatgcactgatgcagaagcctggtgcatgagacatgctaatgcctttgatcaatacttgacatggggtctgaaggcagggtgagcagggagggatgttctctgcgtgtcaccaaatacgcctgtgactctcaaactcctgactcttcctagttaagagccaggaacttgggtgacagtctcttcaaaagctgagtaaccaggcaacttctttgccctctcaggaactcccataaagacgtgggactcatagacgacgcctcagtattctctgcagcctgtgtcattggcagagttgggggctgcaggactgcaggccttcatgggaactgctgttccaagtgggtggctcataccaattaaggacatcagattggagatttggtttacaaggaagtaaaaccaaagaaaactgacttttgaggcctttctgcttgtatattttatctcattttatcttcacaatagctcagaaatacatgaattgatactattcactattttataactgaagaaactgcaactcagagatgttgtgactggacccagatactatagctactaaatagttaagaccatttgaatctacatataggtagtccatacagaaataaggcagagaaatggaatagaaatggcaaagggggatttacactaatcctatcatgctttggcctcccattatgtcttgagaaaagaaatgaaatgctggtttccagcatctctctgtgatctagtccaaatagaataagctatgctgctgtgacaaataaacctacatcaaagtggtttaacctaatttcagttatttctctcttgcaaagtctgatgtggtgaaggcatctttccttcatcaaatagtttcacctttcagaatgcgtggactctaaagtcgctatgacagaggaagggggagctggaaaggtacacagatcttgattgccttgaactggaaattacatgtgttccctcctgcttagagaccattggccaaagataatctcatgggctcaacctaactgtaagggaagctgggaaatactagtaattctatgaatatttaatgaacattaagtgtctctgtatattctaacacttttgtgtccttatttcttcttctgtaggacagagccccagaataaccccgttgtcccagctcaggatggaccctcagaaaagctgggtcagcatctggccaccgagcccttgggcaccaacagttgggagagagacaagacctgtcgggaactgggtgccaccagaggacacaggtgagatccaatgaggacgttcaagttgaagatacagaaataaagtctgcctctctggccatggctcacccctctcttatgcaagttcctctttcaaacccttaaatcaagggttagtaaatatttaccgtagaggaacaaatcagaaatattttaagtttgtagacccagtggtttctgtcacaactactcaactcagccattgcagtgcaaaaaacagccataggcattatgcaaacaaaaagcatatctgtgttccaataaaattgtatttataaaagcaggaggcaggctaaattggcccactggctgtagttcagcaagccctaccttaaatgatagcgttcctttgcattttagtggctctatgagccactgactcccaaatcatagtttcagcccagacctgtctcaggagtttcaggtctctgcatgttttcttttactcagttgtttaaccagtactttttgagcacccactgtgtgatggcactgtactagcacacawatgcagagagcactgtatacacatactccataaaaatactgtatactcagcattttactgaggctgggagaagtaaagtgagttccccagaatatgacagccactaagtggcagagtgaagttttgaactccagtctctctgatcttaaatccttgactaaaacccactccattatcctatggatgytactgaaaaacaaaaaaaaaattatcccctgcctcctgttttcagcatatgcttataaagtctggcccatctttggcctctgggaaatctatttctagaagatgtgatcactgaattttagagaagtggcttgggaaactggagtcattttttttctttttaatttttatttcattattattttttaacttttattttasgtttggggctacatgtgaatgtttgttgcgtaggtaaacatgtgtcatagggatttgttgtatacattattttattacccaagtatcaaacccattacccaatagttatcttttctgctcctctccctccatccaccctytctcgtcaagttgtttccttctttgtgttcataaattcttataagtgggagttaagtggagtaattttcaaaaatgaagtctaccccaccacctaggctgccctctcagctacaggctttagttatgctgcaatttcaaagagagagaaacagttaagccctatcaacttggagaaytgaagttcaacctcatgtctggagagttctcccaaggaaacaggaagaaagttgtttccatgataggcagarggagataaagagagaagtgagaaggaagggaatttccctacttttaaaacattgggccaggcatgctggctcacgcctgtaatcccaacactttggaaggccgaggtgggaggatcacttgaggtcaggagttggagaccagcctggccaacatggtgaaacccttgtctctgctaaaaatacaaaaattagccaggtgtgatggtgcacacctgtaatcccagcactctggaggctgaggcagaagaattgcttgtacccaggaggaggaggttgcagtgagccgagatcgcaccacagcgcttcagcctgggcgacagagtgagactccgtctcaaaataaaaaataaaaaatattgtctcctagatggaatctgagtgtacaaatcttgaccctgtcacttacgaactgagcaaccttgggcaagtttcttttcctccatgggcctcagtgttcacagctataaaatgggaatgttgagatgtaattctcaaggtcaggatgaggattaagttagactaggcatgtacagattgtggcagtgagactagagcagaggaaatcctaagatatrttagtgagagtttcatgaagccagaagagaagattctggttatgaaaatctgaaaaaatgatgccatgtcatacagcatctctattgtagagctgttktactctagtgtacagcatctgggcctctcactcccttctatctgtgactgaccctctgatgtgacaaaaccacaataatgatgataataataataacagtgataataaaagtaatcataattatattatataataaatttattatttaataattaattataattataataacagaaaccccttatactgtcctcttactctatgccagaccagggcacattacctaagtcagctcctttattcctggaagcaaacttaggacacaggtaccatgtttcttcccatcttgttgaygatgaycaagatgagactcagagaggtctctgagccctgttggaagtaagagagttagactttaaatctaggtttgtcagcttctggaccagcattccttactgctgcatactttactgcatatgtaacttctgcatatgtaaccactgtgttggaaccactgcatacttaaccactgcttttttttttaattttttttgttatacttcaagttctagggtacatgtgcacatcatgcaggtttgttacatatgtatacatgtgccatgttggtgtgctgcacccattaactcgtcatttacattaggtatatctcctaatgcaatccctcccccctccccccaccccacaacaggccccactgtgtgatgttccccatcctgtgtccaagtgttctcattgttcaattcccacctatgagtgagaacatgcggtgtttggttttctgtccttgtgatagtttgttcagaatgatggtttccagcttcatccatgtccttacaaaggacatgaactcatcctttttcatggctgcatagtattccatggtgtatatgtgccacactttcctaatccagtctatcattgatggacatttgggttggttccaagtctttgctattgtgaatagtgccgcaataaacatacaygtgcatgtgtctttatagcagcatgatttataatcctttggttatatacccagtaattggatggctgcgtcaaatgatatttctagttttagatccttgaggaatcaccacactgtcttccacaatggatgaactagtttacactcccaccaacagtgtaaaagtgttcctatttctccatatcctctccagcatctgttgtttcctgacttcttaatgatcgccattctaactggtgtgagatggtatctcattgtagttttgatttgcatttctctgatggcccgtgatgatgagcattttttcatgtgtctgttggctgcataaatgtcttcttttgagaagtgtctgttcatatcctttgcccactttttgatggggttgtttgatttttttcttgtaaatttgtttaagttctttgtagattctggatattagccctttgtcagataggtagattgtaaaaattttctcccattctgcaggttgcctgttcactctgatggtagtttcttttgctgtgcagaagctctttagtttaattagatcccatttgtcaattttggcttttgttgccattgcttttggtgttttagtcatgaagtccttgcccatgcctatgtcctgaatggtattgcctaggttttttatggttttaagtctaacatttaagtctttaaaccatcttgaattaatttttgtataaggtgtaaggaagggatccagtttcagctttctacatatggctagccagttttcccagcaccacttattaaatagggaatccattccccatgtcttgtttttgtcaggtttgtcaaagatcaaatggttgtagacgtgtgtgttatttctgagggctctgttctattccattggtctatatctctgttttggtaccagtaccatgctgttttggttactgtagccttgyagtatagtttgaagtcaggtagcgtgatgcctccagttttgttcttttggcttaggattgtcttggcaatgcgggctcttttttggttccatatgaactttaaagtagttttttccagttctgtggarraagtcattggtagcttgatggggatggcattgaatctataaattaccttgggcagtatggccattttcatgatattgattcttcctatccatgagcatggaatgttcttccatttgtttgtgtcctcttttatttcgttgagcagtggtttgtagttctccttgaagaggtccttcacatcccttgtaagttggattcctagatattttattctctttgaagcaattgtgaatgggagttcactcatgatttggctctctgtttgtctgttattggtgtataggaatgcttgtgatttttgcacattgattttgtatcccgagactttgctaaagttgcttatcagcttaaggagattttgagctgagacaatggggttttataaatagacaatcatgtcatctgcaaacagggacattttgacttcctcttttcctaattgaataccctttatttctttctcctgcctgattkccctggccggaacttgcaacagtatgttgaacaggagtggtgagagagggcatccctgtcttgtgccagttttcaaagggaatgcttccagtttttgcccattcagtatgatattggctgtgggtttgtcataaatagctctcattattttgagatatgtcccatccatacctagtttattgagagtttttagcatgaagggtggttgaattttgtcaaaggccttttctgcatctattgagataatcctgtggtttttgtctttggttctatttatatgatggattacatttattgatttgcatatgttgaaccagccttgcatcccagggatgaagccaacttgatcatggtggataagctttatgatgtgctgctggatttaaaataatggtttgccagaattttattgaggattttcgcatcaatgttcatcagggatattgggtctaaatttctctttttttgttgtgtctctgccaggctttggtatcaggatgatgctggcttcataaaatgagttagggaggattccctctttttctattgattggaatagttacagaagaartggtaccaactcctttttgtacctctagtagaattcggctgtgaatccatctggtcctggactttttttggttgctaggttattaattattgcctcaatttcagagcctgttattggtctatttagggattcaacttcttcctggtttagtcttgggagggtctatgtgtccaggaatttatccatttcttctagattttctagtttatttgtgtagagtgtttatagtattctctgatggtagtttgtattwctgwgggatcggtggtgatatcccctttatcattttttattgtgtgtatttgattcttctctcttttcttctatattagtcttgctagtgatctatcaattttgttgatcttttcaaaaaaccagctcctggattcattgattttttgaagggttttttgtgtatctccttcagttctgctctgatcttagttatttcttgccttctgctagcttttgaatgtgtttgctcttgcttctctagttcttttaattgtgatgttagggtgtcaattttagatctttcctgctttctattgtgggcatttagtgctataaatttccctctacacactgctttaaatgtgtcccagagattccagtatgttgtgtctttgttctcattggtttcaaagaacatctttatttctgccttcatttcgttatgtacccagtagtcattcaggagcaggttgttcagtttccatgtagttgtgcagttttgagtgtgtctcttaatcctgagttytaatttgattgcactgtggtctgagagacagtttgttgtgatttctgttcttttacattttctgaggagtgctttacttccaactatgtggtcaattttggaataagtgcgatgtggtgctgagaagaatgtatattctcctgatttggggtggagagttctgtagatgtctattaggtctgcttggtgcagagctgagttcaattcctggatatccttgttaactttctgtctcattgatctgtctaatgttgacagtggggtgttaaagtctcccattattattgtgtgggagtctaagtctcattgtatgtctctaaggacttgctttttgaatctgggtgctcctgtattgggtgcatatatacttaggatagttagctcttcttcttgaattgatccctttaccataatgtaatggccttctttgtctcttttgatctttgttggtttagagtctgttttatcagagactaggattgcaacccctgtttgttttttttttgttttccatttgcttggtagatcttcctccatccctttattttgagcctatgtgtgtctctgcaggtgagatgggtctcttgaatacagcacattgatgggtcttgactctttatccaatttgccagtctgtgtcttttaattggagcatttagcccatttacattttaaggttaatattgttatgtgtgaatttgatcctgtcattatgatgttagctggttattttgctctttagttgatgcaatttcttcctagcattgacggtctttacaatttggcatgtttttgcagtggctagtatcagttgttcctttccatgtttagtgcttccttcaggagctcttgtaaggcaggcctggtggtgacaaagtctctcagcatttgcttgtctgtaaaggattttatttctccttcacttatgaagcctagtttggctggatatgaaattctgggttgaaaattcttttctttaagaatgttgaatattggcccccactctcttctggcttgtagagtttctgccgagagatcagctgttagtctgatgggcttccctttgtgggtaacccgacctttctctctggctgcccttaacattttttccttcatttcaactttggtgaatctgacagttatgtgtcttggagttgctcttcttgaggagtatcttgtggcgttctctgtatttcctgaatttgaatgttggcctgccccgctaggttggggaagttctggatartatcctgaagagtgttttccaacttggttccattctccccgtcactttcaggtataccaatcagacatagatttggtyttttcacatagtcccatatttcttggaggctttgttcatttctttttactcttttttctctaaacttctcttctcacttcatttcattcatttgatcttcaatcactgataccctttcttccacttgattgaattggctactgaagcttgtgcatgtatcatgtagttctcgtgccatgattttcagctccatcaggtcatttaaggtcttctctacactgtttattctagttagccattcgtctaatcttttttcaaggtttttagcttctttgcgatgggttcaaacatcctcctttagcgcagagaagtttgtaatcactgatcatctgaargcttcttccctcaacttgtcaaagtcattctccgtccagctttgttccattgttggcaaggagctgcgttcctttggaggagaagaggctctctgattttyagaattttagcttttctgctctggtttctccccatctttgtggttttatcagcctgtggtctttgatgatggtgatgtacagatggggttttggtgtggatgtcctttctgtttgttagttttccttctaacagtcaggaccctcagctgcaggtctgttggagtttgctggaggtccactccagacactgtttgcctgggtatcaccagcggaggctgcagaacagcaaatattgcagaatggcaaatgttgctgcctgatccttcctctggaatcttcgtctcagaggggcacctggccatatgaggtgtcagtcagcccttactgggaggtgcctcccagttaggctagttgggggtcagggacgcacttgaggaggcagtctgtccgtttgcagatctcaaactctgtgctgggagaaccactactrtcttcaaaactgtcagacagggacatttaagtctgcagaagtttctgctgccttttgttcagctatgccctgcccccagaggtggagtctacagaggcaggcaggcctccttgagctgcagtaggctccrcctagtttgagcttcctgaccactttgtttacctactyaagcttcagcaatggcggacgcccctgccccagcctcgctgccgccttgcagtttgatctcagactgctgtgcttgcagtgagtgaggctccgtgggcatgggaccatccaagccacatgtgggatataatctcctggtgtgccatttgctaagaccattggagaggtgcaatattagggtgggagtgtcccgattttccaggtaccctctgtcacggcttcccttggctaggaaagggaattccctgaccccttgcacttcccaggtgaggcgatgccccgccctgctttggctcatgctccgtgggctgcacccactgtccgacaagcccccatgagatgaacccggtaccttagttggaaatacagaaatcacccgtcttctgcatcactcacgctgggagctgtagactggagctcttcctattcggccaccttggaacctcctcaccactgcatatttaattgatgcatgtttaactactgtgtacctaactgctgagcacttaaccactgaatagttaacctctgctacttccccaaggtgtgcttaactaccatttgtttaaccactacagacttaactgctgcacatgtaaccactgcatactcaactgatacttattgaactgtcatatatttcatcactgtatttagccatgcatatgtaaccacagcatacacaagcattatgtacttaacccctgcacctgtaaccagggtatacttaacaactattctgccctttcctgaccctctatgatggtacaagtagaactagtgtagggaaaaatagggggtagaagaaatgtagacctaccagggtaaaggcgtttgggatttattgagggagttgatgatccccatctcacacacctcaaatgtctccaaattcaagggctttctgagttttaccccattacttaaatgcaaatcaaggacgaagttctcaaatcatgctctcctgggaccctgggattccagaagttatagctgactgaaacaataggctctttcctcattttgtaagacacactctaaaagatttttttttctctcaagtttttctcctttcattttttccccactcaaattcccagtagctgttgcactgggaagtgtttctatgaaacaagatgatttaacaagaagctcaattatttcattcatttattctctcttttggtcactcagcaaatattgattaggcttttgccctgtgacaagcactctttaaggaaataatttggtggccgggaaccatggctcatgcctgtaatcccagcactatgggaggccaaagcaagtggatcacctggggtcaggagttcgagaccagcctggccaacatggtgaaacmctgtctctactttaaaaatacaaaaattagcctggcttggtggcgggggcctgtagtcccagctactaggaaggctgaggcaggagaatcgcttgaacccaggagatggaggttgcagtgagctgagatcatgccactgcactccagcctaggcaagagagtgaaactgcgtctcaaaaaaaagaaaaaaaaaaagaatttggaagtagcccatcctgtttacacaagcatcctgtttgcttcctggacatgcatactgtgccttgtgctttataacatataagtgtagttaagtagttaggtacttaattcctgtgatacttatttttaacctactaaaagggaccctcttagaaatgcaaatcaaaaccacaatgagatgccatctcacgccagtcagaatggcaattattaaaaagtcaagaaacaacagatgctggtgaggttgtacagaaataggaatgcttttacactattagtgggaatgtaaattagttcaaccattgtggaagatggtggttcctcaaagacctagaaccagaaataccatttgacccagcaatcccattactgggtatatacccaaaggaatgaatatatgtcattctattataaagatacatgcacgcatatgttcattgcagcactattcacaatagcaaagacatgaaatgaacccaaatgcccatcaatgataggctggataaagaaaatgtggtatacatataccatggaatactatgcagtattccatactatgaacaagatcctgtcctttgcaggcacaaggatgaagctggaagctattatcctctgcaaaccaatgcaagaacagaaaaccaaatactgcatgatctcacttataagtgggagctgaacattgagaacacatggacacaggaaggggaacatcacacactggggcctgttgggggagagtggtggctgaggaagagcattagggaaaagagcaaatgcatgctgggcttaatacctaggtgacgggttgataggtgcagcaaaccaccatggcacacatttatctatgtaacaaacctgcacatcctgcaaatgtagcccggaatgtacaaatttaaaattaaaattaaaaaaaaacagcacatcaaaagttccacattcaggaaagcaaattagtagaaaagctcaataatataaatagtctctcctccagctgtttaaataaaatgacatctgataatttttaaaaagtggctctcttgaaaatattataaatatagctatatgattcttatttgctgragatagagaccctggcatatattctaaccattttatcattctttctactaaccacaatgatccagattcttaaaatggaattaaatacagcagtactttatgatattctataaaaagttgggtaatttccagatgattggccacacaaacaagtttgagaaggcagctggttttgtggggaaaatctcagggtaggaatcacacaggccttgattcaaatcctagcctggacacattctaattgtctagccatcagcaagttaattaacctttctgaggctcaagacagtaaaagtcataccattctcaaagtgtttgtatcccaatatataaaaaaacttggcacataacaagcgcataaatgctagttgtgtcactgctgaaataatgacaatattagtagtaagattatgttttccccttgaggttccactaggttggcatgttccaattcccaagcagtttttcatctaaaaccatcttcctttgccatgggatagtgtttttaaaaaaatccctggagcctgccccaattataaaagaagataacttgacttcatttaactgcagcctcagcatttgaatttaattgaacaggaaataattattcttgaagagcggaggtttttgaggttctgcgaggcaatataagatacgtatctcgttacattagaccttggcaaatatacttttaataatcagctgctacttaacataccttccgcctgctattaaatttccagcaggaactacggacacgatatattggggagggagggggctgaacggctgatgagttatttaaaaagtgatttatttaccaaggcaagccatttgcaaattcaataataaatctatttaggagtagttaacctctataactctgtttttaataatcagttggtgtttgggtaacgtacaacgtctgtctcattaactcggcattaagtccttatttaggtacttagtctgaagtgtgacccaatcagccatgaggtggtaatgaggcactggctataggtccttgatcatccaaggacctgggtccttccctggctgcaccagctctggttggggagttggggaaccatgagttatctaatgctcctctctttgctcctcacagtgcctctcatgacaaagacttgacaccaccaccttcctccaggggaaagaagaaaaagaagaaatccactcggaagaagagaaggaggtaagagcaccaagagggagataaaacctgtaagatgcaggcagggacaaaatatgggtttcaaagtcagacagtggctccctcttgggttcaaatcccctctctgatgcttaactagctgtgtgaccttgggcaagtcactttacatctctgttcctgtttttattatacttctccaaaatggtgataatatctaccttttgagatttcatgaaaattacatgaaaaattaatgtggaagcggctgtcacagtacctggcacatggtaaatgactaattaataggaagcatagtcttttttttttttttttttttttgagacggagtctcgctctgtcacccaggctggagtgcactggcatgatctcggctccctgcaatctccgcctcccaggttcactccattctcctgcctcagcctcccgagtagctgtgactacaggcgcccgccaccacgccaggctaattttttgtatttttagtagagacagaatttcactgtgttagccaggatggtctcgatctcctgaccttgtgatccgcctgcctcggccttccaaagtgctggggttacaagcgtgaaccaccgcgcctggccggaagcatagtctttagcatgaatattgaattattttttgagagcttactagatgcagaggactagactaggcaccgtggtcttcattatctcttttatccctgaccattgtctaccaggaaagcattattattcccattttagagatgagaaaataaaggctcacagaggtggtgacaggatctacaggggcttgacgccaggttctcagttggttctacgacgcccacctaactagttcaatatctaggataataggtgggtgttggaggggaggggtgctgtttgtttgtttgccagctattgactctttggtatcctatgcattttttctacgtccaattcctttaaaatttttttatatttaaaatgatttccagatttgcttgtaggctgccactaactagactgaaagcatctctagtgtgccaactccagaggggcaggcttaaattaacccttaaggctgccaactgagaatcacagcaaacttctgaggcagtatttatagaaacctgtagggggcagcagagagcagcatctgatgacttgggcttcaactccaggttttctggaaccttgtttcacagacaccccttagcctcattctaaaaggacaggctcaaagaggagccagggggaaatatggatgaagactctgagtcctagccattgtagggtaggagatgaaattgaggcaagtgctttggatttcctaatttgaggggtgggccagagaatactctaaaaaaggaaacctcagatattaagattcactaattgactcgttcatccagtgaatattcactgagcatgtgtctggggacaaatgtyatgattccttgaaggctgaattgtttctcagccattcccttctgcagacatgttttgtttgacctgcaaagtgatttgattttttttttaattggtggtcaacatttccaaatcgggagatttcatatgaaaatgtggagttttggaggctcctttagaaaaggcaggtgctgtagaagcccagacctgaattcctacacaggatcttcggctaatctgagaagcagactcccctccagccagaacctctctggttcccccacagtccccactactccctactgtcttccacccagcctgcttcatccattcatgttacctgagagggccctgttagcattgaatttgtaacctctcatctgtttcaaccctggtcttttgtcagcggggaaataagagacttagagatgagccttgacatgcccaaggtggctctgtgagttggtagtagtcaagattggaacttaggtcacctgagcctcagtcttgagtcatcaccatggactcagagtagctctgttgctcaggtaacactttgatggcactatccgtgcagccgcagcctggcaagatatccttcaggggctcagtcttaccagggagacaaaggatggggcaaaggagaaaccctgagactttgagaggagggttgcagcttgaagggagaacagcagacagaaggaagcctttccagcttgaccaggcaggcagctgtgaggtgctatggtgactgagagcaaaaaccartgggatcccagctcatctacttcctagctgtgtgtctttaggccggtcacttcacctctctgaacttcattttctttgtctgaaaagggagggtagcaattgtacctacctaagaagtgtgtgaaaggattgaatgagataatgcttacaaaacacaaggtaatggtttacattaacttgttaaaaattaaaatcaaatgaaaagtaaaattaaatttgtgagcaattaaaaattgcttacaaatgcaagctagtatcagcatggatattatctttgatgtgtgttcctgcaagagctaaaaccctgtataaggactggggaaggttctttttgaaaccaaccttggcctttaagagcctccttctgaaatgtgtcttcttggccctggcaggtcctcatcctatagcccatcgcctgtcaagaaaaagaagaagaaaagttccaagaaacacaagcgacgcaggtattgtcctttttctctgcaaacaagacctccccaggtggggtggggaggacagttgatggcactaaaaggtcatctggaagcatatcatgtcatttatgtaaaacaattatctatgtctttttacgtatttgtgtcttgtgtaagctgggactgtggctgcgaagactagaggtccacacatgctaactgaggccagaggaggacttgattataaagaagcaggagtgactcagggaccagccaggcctgagcaaggggctagaacaaggagtggaaagctgacaggacccacctgggacctgaagtgcccgctgtctcctggtccccatgagggacatggctgcaccctgccccatctctccatgttgcaggccaagttgcaaggagacactgaatctctctgtcttgttccttattccaaattcccaaggaaatgcccctcttgtcagtccattgcatgctagagaatgagatcatgttgaaaaacatggctgtgctgagatttcccatgctggtgcatggggatgcagtgacggtagttacagcgcatcatgaactgggcccatgttcctggtgttcactgtgcacacacacacacacacacgtgtatgtttacaggggaaggaaaagactaaaaggatactgtagtcctggcactttgggagaccaaggtgggcagatcaygaggtcaggaggtcgagaccatcctggccaacatggtgaaacccagtctctactaaaaatacaaaaattagccaggtgtggtggcacgtgcctgtaatcccagctatttgggacgctgaggcagaagaatcacttgaaccggggagtcagaggttgcagtgagccgagatcgctccattgcactccagcctggcagcagagtgagactctgtctaaaaaacaaacaaacaaacaaacaaacaaaggatatacaacagagggctcaggtttgtggtttatggcccaaaccaacactttataattggaagattctgcaatacagaaatacagttttctagttcctctgtagagtcagaaggtctgtcttctctgggcctattttcccaygagcaaccatcccctggagctgaggagttgccaagcatttagacagagtgctccagttggccttaggacctgtccagcctgctctacccacttacaaagcctgcttggcccctggaggcaggaagtttgaagctccctatacaagttatttgctgtagtgagctgcggataatgggaaaagagtgatttatatattacttttgcttatccgtatcatccaattttcctacatcaattgtagattacttgtgcaattaacaacagaatgaatgagaggtaagaggttgtttggggcttccccctgcatctcaagtccagttcaaagttgcaccagtgtggcttttcccaatccagggatatgaccacatctcagtgctggttgctagagtggcctcaaactcagttggctctcactggttatgtcaaccacctgcccagacttcctgactgatgttatctgagyttgtgtttactacaaggcatgggcaaactaattagtgaaatgttgttaatttggtgtcagcaatctttccccaagtggagtcctttgtagaggcaatggcccacacttatgattctagatggccaccttatcacctccctttgctgagcagctcctcccaatttgggggttcgctgggggaagggagaacaactttcccatatttgggctctggaagccaagtggcttctcactcacagattccttctcatgagaaagacactgacagacagtcagaaacaggcttttcctgcccggtcagcccaggtcttagagctttacagagtagggggttcatatgagggagatgattaggaggggaaattctgttgctattccttcccaaaccctgacctcccgagcaccatcctactcctggtccagcctctccaggctcttgaaatgtttggtgaatgatagctgacacttttggagatgggacctaggggtagcgaaagcactgagattttttttttttttttttgtctctcctcagttagcaaggcttctgagtttttaaaaatttttcatttttctagctaatgcatgctgcacttaatacctaggtgatgggttgataggtgcagcaaaccaccatggcacacattacatgtagcaaaccagcacatcctgcgtatgtaccccagaacttagaataaaaattaaaatttttaaaaaatgatttttcacatctatttattgaacacccattatgtatcatgaatgaggattctgagtcccagaaaagaaaccaaaacccagtccctgccctccaattctcacattctagtggggaaaatcgatcattctaatatggagaagtctgtaccctgatgatgataagctcagaggctcacccagagcttgggggagtagacaggaggcatccaaccagcctgagggactcagaaaatgttacaaggagaagacggcctccaactggagcactgaagaatgagamgaagctacatgggtgatgctgtttgactctgagcaacttaatcaacttctctgatcgtcagtgtttttgtaaaatggttgttaatagtactccacagggcttggggaagattgaatgagattgtacgtgacaggtgctaagtacagaacctggcacacagtaagagttccacatgtggaagctggctgtctcatgatgatgacggtgatgatgaggatgaggaggaggaggaatgcacaacaagggagagagaagatgagatggagaatggaggaggggaaaggcagaagactctctctacgttctccttatccagcctcatccaggacagatttactgacagttttgggggaggattggagcaccggtaggctttgatctggaaattcagaatcaaaccagtatctcccatacaattttcatagtctctgaaatctaagagaggaggaggattagctaggtgtcccgaccccctgtagcgtgatcacaaacatgctgataccttcataccaggaaaaaaaaaaactttcaaactcacctatatttacgttttcccctccctcccttccttcaccatccctccctttcttccttcctcctttctctccttctctccctctctccatctctctctctctccctctctttctctgccttttttttctttgattcttcttttcattttttttctttctttcttttcaggtcattctccaagaagagaaggcacaggtaagactcttgttctctgactgcctgttcaattttctgctttctcagccagcttggggcagcttctaggtcagccctcagtttccatctgtgctcttaggcatgaccccttcatcttcctgggcctcagtttcctccaaaatgaaggtctgggctgttttttctgagtattccaagccagcttttgacttccatcaggccagggggttgatcttggaccagccctatcgatgtctcgaccccagaatgtctcattacccctgccactggttggaatcttgaactggggcacatagggaaacagtcctgtcacaccaccaaaaccttcccagatctggccaaggaacagggccaagtcctcgtatactggacacactgggtgaacacaaatagttattacttacagggtcctgactccaaactggatcctgagctaagtcccttccatgtgtagatgtttttaattctcattaatccctaycacaaccttgcacagtggatatgtttattgttcccattttacagatgaggaaactgagactaagatagaatgtcacaggaatgtccacagatagaaccagaaggtaacggagccgaaattcaaacccaaatctgtagacagagggtaaggggagtgacgatggcttcttaaataacaataaccacatctagagcaatctgcaaaatgcaaagccctgtcatttgttcacttaataagtagatattggttgccaatgtcctctgtccactcagctctgcagcttgagtaatggccccatttcacggttgaagaaaccaggttttaaagggacgggtaactaccctgatgtcacacagcagctaagaagcagaggcggatcttgggtccarttgaatttggatctgtcagcaaggtcctgggctctcccactgcctagggtgagtctcaacatgaagatagatcctgtggctggcttcaasgtgtaagatagttagatgaaataaaattgccccttcccaggtcctaggccagtmataggttcttggtgaccctctgcaaccagtctagcttaaactaccaaatagtgtgttcatcctccctgatctctatttgattacactgagaccccaagtcattcttatccattgtactcagaccctagccctatgactcaaaaaataatttaaacgcagatacttgaatatgaatgggcagaccatttcagaatctaccaagcgtcatgagagttcaaatatcttcctggatattccatttgcttctcttataaattgattgaacagcagtcaagagcatgggctctggggatccatggtctcagatccatggccacatcctagctcacctgcgcaatcctaaccaagtttctttgcccatctgaggttcagcttagaatgagcacttgttaaattgtgcctccacccataggttgtggagagaataaaatgaagttgttgacgaaagtattcaacagagtgcctagactgtaattaaagtctcaaaaaatggcagacattgttattactacctttattgctgccattattattaacctagcaaagctgagcttggcatcctccacactccatcctcaacatatgtgtgtgcgtcggtatccctagccgaatttgctgcatgaaaatgttggcagtgaattttccagtctgaggcaatgatcagtgtccattccaaaactgcctggatctcacactgtgtgttaagcattttaactacttgtttatctttaactagaattttgcatctttcaattaattgaccatttcttgtttagctcctctagcccaaaaagcaaaagaagagatgagaagaggcacaagaaacagtaagtagatactacctggaatgtactcatcagtttgaggagttggggcatctggcttcttaaaagccagagtcttagagttgccaaataaacagggaaagggaggagaaggtgagcgggtgaaaggaaggcaggaaggcaggaaggcaggaaggcaggaaggcaggaaggcaggaaggaaggaaggaaggaaggaaggaaggaaggaaggaaggaaggggagagggagggacagaaaggcataactgcgtgtgttgtaggtttaggaatgtatgaatgcaccgggtcgtgtgtatatgatgtgtatgtgtatgcacgcttgtttatgttgcatgaaagggtgcatgtgtgtgcctggtgtgtcccttatgagtataccttgtgtgtatatttatacatagtatgtatatatctagtgcatgcattgtagatgtctgtacatttttacatttttgtacactgtgtgtacaaatgtatacaatatgggaacattgtgtggtctatatttgtgcctacaccaatgcatttgtgtgtctgtgcttgtgtgagcatgaatgtgaatggtatacataggacacactaaattctatgcactgtgtgtgtgcgctgtgtaagtacctgtgtatattttgtgcacaggggtcgtatggtggtttttacctgtgcatgggtggtcatgggggtgtgagcacatgggtgcacgtgtgtgagcatgtgtatgaattcatgtgctgactgttggatttacagtgtggagatgtcagtgaagctcctagctccagtcttggggccccagctgtttcacagtttatagctggtagtagaaattcaaatcagccactgctgcctgtggagttcagttcccagccaaattaaaagtaaatttggttacaacctacctactttatatcctgcaaatgttagtgcgtgtgttttccaatcaactaatattttatctcctgccaagaagcttctaaagagaggatcaaagacaataagatgaaaggtagtcgactgccagggaggaaaaagaggaggcagggatgcagagggagggtgcccagctttgctgccccaaacggtcttttcacccaaggtcaggacgaaggagggcatttccgccaccaccacagaggcctggggaatgctccagaagaaagcagtagagccttgagttagctgagggaagaacttcctcatcatcgaatttgttccgctcaagtcaagagacaattattggccacgtgtattgaatgtgctttcacactaagcacagatagagtacacgttcccagcaatctcggtgtcacttgaccagtggggccccagggtaggcagccacagagtcagggggtaggcccagacctcaacagcgctaggaaggaccatcactgagataaggactgcctgcgtaaggggagcaaggtggccaccctccccgctggcaagagctggatgagccccagaaattgctagcagggcatcagaaagcttgtggaagccaaaagacaagaggcaagagagaaaaaagacaagaagaataaggctaggaatcttgaggattcaagataaacgatggcttattcttaccaagtctacggtcagggctgcttctaggcaagtggctgctggagtgagttagcctcctttcattcaacatcccttaatgaggccctactatgtgactggccttgcgctgggcccaaggacagagatgagccagacactgtcctggccttgaagagctcacaggagccagacatagggctggtcacagaacagcagacgaaaccctgggcattgtgggaacacaggcactgggaaaagggcttggtggcctcccgcaggaggcagcatctaagccgcaggtgaggatgggaagtaaccattccaggctgcaagttaagcaggtggtttaaactctctgtgcctcagtttcttcatctgtaagatgggaataataagagaatctatttcataggttrttatgaagaatagatgaatccctttaagaaaagtgcttagaatacagtgcctggcatgaagtatgtgttagatgtgggttacctgtcatcatcaccattgttatcatcatcatccctaagacatcatgaactgggaaatgtgtgagccagcatacatacagttcagagctgctttagcccaccaggccagggcagaagaagacaagcagtgaggccagagaactaggcaagggctagctcctgaagctgcctgaggttcaggatcagagtttgaacttgatatgagagcaatgggaaagttttaagcagggaagggatatggtctgatgattacattagaagaatccctgagtcctttgttgagataaccaagttacctcccaacagaatcatctctaactcccactggctttctcgtttggcccaaaccattgacatcctttatatatcttcaattaccactgccgctgccactactatttctgaattattactacttagaagtagctgaagtaacctgcagtaacaccactgttagtggtagtggtagtaattggtgttgttctaatttttgtttttaatgaggtttgtagcccatcctgaaaggtttttgactccatgctaagaacctggacttaattttccaggtctgaggttgtaaattggcagcccaaaggcctaatttactctgcaaatgtgtttcatttgcccaaaaaggtgcctttaaaaaaaaataagcttccatttaaaataagaacattttacctaaaaatctgtatttccacactcacttgaaaaattagaggatcaccacacaaatattctggaggcaaagcagcaccttctgttttaactcgggcctccggttgatattatgttagtgctgggctgatccacatatttatgctgcctgaatggcccctgaagctctgtgacgttgaggcgcctgccttgagtgatgcagaggagacatggggaagtgactttctgcctagggtgtcatctggggagcagggagggccctgagtcatccacactccctycagaggacccctttctgctcacccgtattcagtaccattggttacggaaccctccacccaatacccaggcaggaagctggactaacgcatggggttgagggagatggagarcttcgggagggatggtgacsagtgcaaaggaaaaacgggtgtcacaagatcaaatctctcactytcccttttttactctctctctcctctcctctgactcgttccttctcatccccccaagatctcgaagccggccccgaaagtctcaccgccaccgccatcaccgctgcccctcgcggtcccagagctcggagtcccgcccctcaagctgtgagagcaggtaaccccttgccccaggatcctcttctgtcagccacagcygagcccaggctaagacactgttaacactagcttcgcctccacacttccagcacagggtttggcccccttcctcagactcagcagctggcaccacttccctgtagagaaagggctggagagcctgggtgcggtggctcacgcctgtaatgctagcactttgggaggccgaggtggccaaattatgagatcaggagttcaagaccagcctggccaatatggtgaaaccctgtctctactaaaaatwcaaaaaattagctgggtgtagtggtgggcacctttaattccagctactctggaggctgagacaggagaatcgcttgaacccaggagatggtggttgtggtgagccaagatcacgccattgcactccagcctgggtgacagaacaagactccatctcaaaacaaaaacaaaaacaaaaacaagagaaagggctggagaccaaaaggtcttgctgccatcacttataggaatgacaacaccatactagctgcttttttttttttttttttttttttttgagacagagtctcaccctatagcccagtctggagtgcaggggggcgatcttggctcactgcaacctccacctcctgggttcaagcgattctcctgcctcagcctccagagtagctgggactacaggcgcccgccaccacacctggctaatttctgtatctgtagtagagacagggtttcaccgtgttggccaggctagtctcaaactcctgacctcaagtgatccaaccgtctcggcctcccaaagtgttagaattacaggtgtgagccaccgcccccagctctagctgctctttgtacatccacttgcaggatcctctctacaaccgtaacaagtgggcattattgttatccccattttaaatatgagaaaactgaggcatgggggggttaaggactttactagtctcttagcaactaagtgacagttaggattgaaatcagggaacatggctctagacttcactaagggaccactctaagcacagagaagctaagcaaactatgtaaacccaaacagtgcaaagtagaaagttcactctaatgccttttcaactcagttttctcctaacctggactctctctatgctaatacattggttgtcccaacctgagaaggcatcttgttgatgagaagaaggaggaagggaaggagaagagcaagaataagaactggrgctttaactataaatcatgctgctataaagacacatgcacacrtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccagacaccgcatattctcactcataggtgggaactgaacagtgagaacacatggacacaggaaggggaacatcatactctggggactgttgtggggttgggggasgggggagggatagcattgggagatatacctaatgctagatgakgagttagtgggtgcagcrcaccagcatggcacatgtatacatatgtaactaacctgcacattgtatacatgtaccctaaaacttaaagtataataataataaataaatttaaaaaaaagaactggggctttattggtgtttggaatcgttgatgttcaatggggacactgagacctccagcttccagatgtgaggagctgcttttttctttctgaaatgcatctcacacttgactctccrttcacatcacaagggtagattttaaaatgtcattgccctggccccacttttcccaaataaagcagaatatctataggaaaagggaggaggagccaggtacaatgtctcgcgcctgtaatcctagcactttgsggggccgaggtgggcagatcacctgaggtcaggagttagtgatcaccctggccaacatagtgaaaccttgtctctattaaaaatacaaaaattagccaggtgtggtggtgggcacctgtaatcccagctactcgggaggctgaggcaggagaatcacttgaacccaggagacggaggttgcagtgagccaagattgcaccattgcactccagcctgggtgacaaaagtgaaagtctgtctcaaaaaaaaaaagaaaagaaaagaaaagaaaggaagaaaaagggagaaggagaaggtagaagggggagaaggagaaagaggaggcaggagaggaatatttacccaaatcctgctctgtgtcagacactgtgctaagattttcaatacattttctctctcatcattctgataayactacgtgctatgctggtgcttgtctacttcggctgccsttttcaatcacttgggaagttttaaaagatgccaatgcctggatcccaccctctcaacattctgatttaatccagatgagatgagaccagaacagtgagatttttaaatccccccaggtgatgtgtgggaagcatttgaggaagaggcccttggtacctactatcacaattaggccttggtgtttctgctgaacatcaataatttccaagaatatcaccatccaacaaggccactctgcagccctgattgctcaagacaaaactaagccccctctgtaatcaagtctgagcccagatgagaacaccgcaaaacacaaaagtgaccaagcatctctctaccctgcctaatatgagtgactgctgcttcctcggcagtcagccttagcctcggtctagtcctccctctttctaaataagactgatgaagacacccagtcagaattacccccacttcctggcagcatccaattctgaacaaagctccagatctgtaaatgctccccaaaccacctatcaccagcccaaagcctataataggttctttttaacacccccttacagagacgcctgaaacttccctatggtatsaaggagtgacaacaatgtttgttcaaccccaggtggactcctggtggcctttttctggaggacattggccaaatgagctaaaacacatctctgatctgttacagcagagacaactgccttttggtgggcaaagggatctgagcgaggtcacatagctaggaagtgtctggcagagctggaataggcaccaggttagtgtgactcagcctgagcacttcacctacaccccaggctgaattatctctcggcagctaagccctactggcctgggccagagaatcatacaaggctttagcaacttacctgttaaataaatggttaacatcacaaacactaccccgggcctcctctgctgtcccatctcctcctgatggtgttggcatctgagctcccagtgcctactgagctgaggagcttcctagcagaaatggaagcaaactgagagctggcacgcaggttacacattcagtagaaacatgattttcaagccacagagcagtcaggggcactccagggcatgaatcccaggcgctagttcctagaggggcaaaaaactgccctggcccttgctctgccactttcaggctgtttgacctcaggaagatccctaaacatctctgagcttcggctccctcatctgtaaaatgggaaagtaataccttgccctgtctatgtcttcaagttgtagggaaaactgtgaaactgcttcgagaggtgtatacataccttgcaaatccataatgtgctatttttattactttggtggctcagataactaataagatatgcagagtctragcatgccctttctaagaagtcagacatgcctttggtttttactgcagaccaagcagccagatctagacgtgacaaacttgcagaaggcatctctgtcatttttgtcagccatttttttttcactaaagttttgggtgacagtcaacaggatgtctttatttcacagatggcaaagtcacatacacaaagacacacagttatacacagttacatttatagacaaacacatggaaacacagatggacacacccagacatacacayagtcacatgacagacaatcagagaggtacacaagtgacattaaactgaataactgaatctggatggggaccttttctgtttttaaagctgcatcctcagaccctaaagcagttccaggtacatgaagtagtatttgtcaaatgaacaagtaagagaatgaataaataaaggaatgaatagatggatggataggtggatgaatggatgaatagattgttggttaggtagatggatggatgaatggctgaatggttagatggatgaatggatgaatggttagttggacaaatggatggatggatggatggatggatggatggatggatggatggatggttagatggttagttggatggatgaacagatggaaggaaggacagatggatggatggatggatggatggatggatggatggatggatggatgaatgcatagatggttggctgagtggttggttggttagttggatggataaacggatggatggatggttggatgattggatggacggatgaatagatgaatagttagatggatggatggatgagtggatgaacggatggatggatggatagatgaatgaatggttggatgggtggatgatggatagatggttgcttagacagatggatggatgatggatagatgaatgaatggatgattgggtggatggttagatggctggatagatggttgcttagacagatggatggatggatggatggttagatggagggatggatggatacatgattggttggattgatggatggatgattgagagatggctagttagatggatgaatagatggttgcttagacagatggatggatggatggatggatggatggatggatggatggatggttaaatggatgaatggatggttaaatggatgaatgaataaataaatgaatatacacacagtccagctttcatacacacacatgcagacatacctaggaacaatatcacatatgaacatatacaaacacccccaaacacactttatcatcctcagatcctgttggtcctgsatacatctccctaccatgctccccttcaaaagaccctcaggtctctctcccccatccccaggcaccgcggccggtcccctgaggaagggcagaagtcccgccgaaggcactcccgccgctgctccaagaccctctgcaaggacagccctgaggcccagtccagtygcccgcccartcaacccctccagatgcttggctacctgtcagccaggggtgtagtaagtattcttcacagcctcctctgccagmcttggccacgacacttggggratgtggaggcacaagttcagggcagtgtayggtacactttaattcaatttctgacaaaatatcccactggctccagacctcattaatgatgaaccaaatgatcattcaccagactttggcaacactggcttggggattttggggggcagggggagaaaaactaaatacccagtctttttatcaggggaatgttgacaaataaatacctgtctccagagtgatatctgcaggaagacatgtttaagataccataggaggattttttgtttgtttgtttgtttttgggagagaaaggaaaagaagggctctttgacataacagaggcactccagcttttacatgaagtctgcatcttttatgccagctggctggcagcattggttggcagctgggatttcatttcacctataaacatgaccttgaatttatatgagaattttcttccaaggaggtcatagctcttgacctacatcctctcatgtagccacacaaggtcttgggagttgagggcacagctgttctcactagtcccttctacagataggaaagaagaatcaaggctcagagaggttaagggctggggtaaagccccagagcaaggcaagagttaatccaatttagcaacccagcattgaatagaattaagcagtgctgccccaagtcaacaaggacaagctggaatttgacttcatatagtttgacaccatgagcaagagacttagaaatggatctgaattcagtcctagcttggccacttcctagctgtgtggctttgggcaaattacttaatctccattttctcattggtaaacttgaagtaaataccacttccgtatggaattgttgggactatccaataagataaagtacgtgaaggccttttgtagactctaaagagacagacgaacaggaagagagtcaacattgatagggtctacaattgcagcagacagctgtgaaagggactgtcttctctagctacatgtgaacttgaaaatttcaggtagatggtgcctaaggaagggtgaggtggaagcaaggaaaagttcaggggtgcttgtggggatgtcaagaaagggaaagcaatgacaayggttgggcctggttgacacaataattatctgcagtgcattccaggaatcttctttaccagtcaaggcacccagcataaccaaggtctaattttacccaaatcctctgcctacctggaaccatctgcaactgtccccagactccttcttggtagagatgtctgtggttactgagtccttgcagatggcaaatgcccatctgcgtactctctctctcacaaatatccaaaaaggggtcttcccagcaagatagaaagtatagaggcctagatttgagtcttgttttggctggacttgtcattttacccctctcaacctcagctttctcacctgagaaatgggcatgattatcccgcttgtctcccaggaggattgtggcaaaggtaaagataaatttgaaatatgagcattaagaggtagaggaatgtttttaagttagtaaaggatgcctaattgctctggtcatggtatttgtggtggtccatctggaggtcccaattgaccctagctaaaaagtgccattggaagcaactggcttatacattcttacatgtctgggatggttttccaacaagatatgtctgtcaagatgttacaaaaagctgggtctgtcctcccacacaagctggggaggttaccagattggctattggtagtttgctttcctaaaacacatgggttcttaatggctttgaggtgcaatgcctcactgttcttcatgagcctggccctatcagaagagctaaaaaccagggttcacctgtacctataagagaggccttaagagctcagctagcctaatgctctgattactaagaaaggaaactgagattcacagaaaggaaatgattcacatgggccatggcaaggcagagttatttaaaaacatggaattattaattcgtggtcacatcatgtccctgagatagtagtaattacttaaatgtttctgagctgtastttcctcatctgtaagaaataataataaaataataataatatagataataacagtctcttcttcagaaggcagctgttgagcccagtacttgatacaggtgcaaaacttgacaaataatatgatgacaacattccagatcctggctctgcacttaccagctgtgactccttgagcaagtttctgtgtctcagtttcctcaaaaactgcaaaacaaggatagcaataagacctacctcataagattgttatgagaattcaatgacacaatgtaagtaaaagttttagagtataacaggcaagaagtaaatgctgcataatgcttactgcttgtgatagtaacagcagtagaagtaatagtggtgatagcagtggtgatagtagtggtggtaatagtagtggtgatagtggtagccacaatagtagtagcagtggtaatagcagtggtagtagtcatagtaatagtagtattgttccaggcataggctgggctgggactagagccaagacccctgcttcccagaccaatttctttctatcctaaatggtagctgcagcycacatggctactctgccccacttaaggttgcctggctcctggaagaatcacatggccccagatctggttctttgagtactcctcatgcatggccctttctcrtcttctctattacaaaagcagagatggaagaagtttccagattggatcaaaggttttccaaggttcctagccccaagtttttctctctgttaaagctaacagcagagtcattttcattgaatcacctgtctgatcattcatttaagtctacaaacacctatggagcatctacaaagggtcaggctctgacttatctcaggatccaattactaagaaagaaatagcctgtgccttctaatgaagcgagacagacaagttaaaaacagttaaaggcaatgcacaacaattggtgctcagatgcttatttgggggtgcaaggttagcagacaggggaggggactgggattagggttagggttgggcagagaaggtaacaattacctgaaaagctaagggtgagccaatgaagggggaaaataaagactagagttgagggttgagataaaattccatggcaagatatgggctctggaggtaaagaggagcmcaagcatgaaggattttctatgccatatttggttacagatatttcacatgcacagcttttttaaaaactcaaggacagttgcataatatcaaggggcttatttacatatatgaatatgcaaatttgggggttggttcttaatggaaatcttagttggtgagctaaagctaacctgaggctctcttgcttggtcagcacccaaatccaaatagaagatcccaagacagtttacctcacacatggtccttatcttcactccaccatctctgttcaaggtactggggaggcagagagattgtaaaaaaaaaaaaaaaagaagaaaagaaaaaaaaaaacactcttcctgaactccaggggctcacagtctagtagtcagaagaatgctgcaatatagtgtgatcattttgtaatcagggctgggattgagtcaggagcaccagtactttctccagttgttaaaatattcaaatactttcatgccagttggtaaataggccctgtcattacctcacccaaccccagtcaacctagccatcccttctctcccttggcactttctggatcttctcaaaatcctgaaacagaaaagtgacacttacttcccttcagcatcaaagccagcttcctytgtggtggggcagtacccacaacgaactagttatcgaatattgtgaatgtcactcctggcagtgatgaaagcaactacagtgtgtaatggaagcacagagtaagggccagacaatgttgtcctgatgtctgagaaggctttaccaataaaggatcatttgagctgggctttgaaggatgcataggagttcattgggttgcaattgttgatggacagaaggaggggaaaacaccactatgtgtcaggcactgtcacatactttacataatttttgcctcatttggtacctaaaacagttatttgaagtaggtgcaattattatcaccatttcgaagatgggaaaataggccctgtgaggtgctggtacctaggaatgtaacaaaattgggagaaaggggaactgttatgagttgtggtttgtgccttgaaagcttaccctgatagytggcatggagggtgggctggatgatgggaaggtggattggatgatggagaggctcatggctccaaggattagccaagccctttccctgtgatatggggctctctatcaagtctatcataaccagagaggaawtctagaaggaggctgatcaagtctggagctgggccaaagataatggcaggtttcttgttcctcttcttgcctccagcctgggccaatagttgctaatccttgtcaacaaaaacctgtacaaatgtcgaaaccaaaaacaataataataaaagcagaactcgtagtccataaaagaggatctcatgaaatttgtaaactggaagaggcaatatgattaagacatgaactttggaatggatctgggcaccctggagttcttgatctctccctgtgagaccctaggtgacagcaataactaatgcctgttgagcacctgccatgcaccaggtgtttactgagcacctactatgcaccaggtgctaggccaattctttacatgtatcatcatcattgcatttaattttataatagcttttcaatggagcttccatgaatatgtccactttatgataaggaaacccagccaagaaaaaataagtaaaaagcagctattcaacagagaagctagggtttgaatccagggagtctgacctcagagtccacatgtttaattacatgacctcctctgtgccatttcacgtctttgggcctcatatccttatctgtgccttgggctaataataatcatacctacttataggattgttatgaggatagagtaagataaggtatccattcatttcaaaaataaacactaagcatctactgtcctgccctcatgtagcttatgctctgtgtgaaaaaaagtatcccaatgcttgggacataaccctcaaagtatcctagttgccataatattttttgtcatcatagcagctttactaaacttatcccaaataaacccagatatgatgttctcggagtatctttagcctcaaaaagctgaatccatccaagatcgcaggtgaacttcacaacaaccccaggagaaaggcgagatgggaatatgcttccccctttgtagatagggaaaatagggctgagggagaatctggatggctcaggccttctgacccctagtccaggtgcttgcacattctgcaaagcctttgagctcttgctcaactgggagacacaatatccaacattcaataccatcatcatagttgagagaagrgaggaaccaaagtacagaaggtggatgaaatgagatttggggattttctgggccattggtttttgtttgttttgttttgttttgttttgtttaatgggargtgacatagcattgtcaacttttacttttgccaaggaagaacagaaaaaaccaccattttctatcactaaagggagattttaccatcagaagaagtaggaaagacacgaccttggaagaaaaaaatgagtcttcaaatcgaaagtatttagcaggatgaaaaactaattacattgaacttattttttcttgtttcaatttgggctggtgataatgtatctaactgggtcccggtggggatttctgagaacaggtgggcagggggtcctcaggagaggcttcaaagaaagggtgagcctgaagctgtcattccctctggctcctgcttaaggaaaataataaggaggccagaccacctctgcctaccaaaggttcaatgcagtgcacagccccatgggatagccccagccctaaaggactttgttgtcttcccacaatgcccggcacatctcccttctctttctccatctcctcctcctcccagatgaactcctaccaggtcaatgaatccattcttttgctgtcttcctaattagtgcactaaggaagatgaacaacagaaaggaaaataaacttaatgtctttgtgaaacaaaagcttttttttttttaaggaataaccagaaccctctagctaaaagctctaccatacagctccacactcacatgagaatttccagtctcccatatggcagggaagaaaaaaaaatttatagccgcctctctctatggggccatttgaagctcagtaaatggacttgttcagtttaattggaattctcttcttgattgtatttttgtaacctattaggccgtgctgcctcttgatcttagaattcagctgaaattaaattttgaagtgtaagtgagaggttgccttttttccccgttcttgattaaataatgatttgaaacaaaaacaataaataacagtgccggcttccctggagggctgagagagactcccagtgaaacgccagggagctggagttcgtggtggggggatttaactacttattagaaaaacctgaatgtgaacackgagtatattaaggaacaaggagatgaggcgaggtttggagtggagagagagagagagagagagagagagagagaggagatactggagcttcacattggaaggggttgagggagtaaaaagggaaatagttcacttccccccaatggccttgagttcatgaaaaacattttgtatttaaaatttttaaaattaaattttaaaatgtctgagattgactaccctgacccagagagaaagagtttataataactctgatgtctggatatggtttaatggatccggtctcctggttcctttcattgacaaaagtccaagagggattaaaaaggtcgagatgggagagatggagcaatacacttcacagatctggaaggaagagatgaaacatacaagatgtaccaggtttatgttactcacagagggatcagagtggcaacaaacttttagaacagagggtctccaacttagaggtcttggtggccagctaatagatatgagtaacaatgatctcgtggggtttggggtccggagagctcatgccccatctaaaaggggcagctgtaattgctctcagctgattcttgccaggcagggatttgggcccagtgttgccagatcttatttttcaacagaaactggaaatggggttgttacatgaaacctcccattctaccaacgttggcagttaattccagtttacttcctgacatactaagggagctaacgaaagcatgtctgaaacaaagcataactcggctcaccggttttccagtgttgacctggggtactgaagcagatagtgtccatatatagatcctcaccctctgcacttcggggcgcatggctgacttccagcttccagatagtattctctggtgccaaaacctattttctctgcctgtttggcagtctggacatactagagaattgatgctccagtgttcagccttgagtgatggggaactggtgtataaatatcccagctccctcactccttggttgaggttaactctggggtgcatgttctacactggttcccagggtgtcctcactgagattaagcatccactgcccactgtaatagctggtttgataatgcatcttttattgtctccctctctcctctgcatcatttccacactccattacagaggttccttgccctctcaaattattagcactcattttccatctcgacttctaagaatccagattagacaggcattatttcatttggccattaagtagatcttgtggaagctggattttcatgccataccccgaaagtaggcttttatgtagacatcatggagggtgagggctgagatggaagaagaggtaaaattggaccaaggaagagaaccctggtgtaagggttccagctcttaaaagggggtcctgggtacctggagggcattattaccagatgacagaggatctggagtggctcttgctaataagtatcttgggacaaagagcagttgcatgcacagagagaaactcccaatgcatgaagaggagctcttcaaagatgaattatgagaggcctattatataaataaggaggcaaaaagaagcaaaggagaaccatcctgttgtatcaatgtcggaggggggtgactgtttgcaccttatgtgccagagagagtggctgactaggaaggcaatacccagggatggaagggcagaggcaagaccatgggaggcccctttttcagcccatcagatgctcacaactctaatgtctcctctgcacttccacggtcagacctctcccatcctgtcttgggcttccctcaattgtatcttctttcctcctcttcttgtggagtgaatggagagctctgcagaaggtggagtctggggtttaggagaccattaaactatctgaatatctctgatgatgactttgtgaaaatgctcctaccacctggaaggataaacagagcacatcaagatttgtaaagacaataccaagtagagttcagctgaaaagaagcaggaatgaatgtcttcaggttaccacctcctctctgccagaggaatcttctaagtaggccagatggagtaagacgatttactcactccagatatacccgctagggacatgatgtcatgctggttgtcccctttgagagggtgaccagcatggagagcaactggcagatcaaaacccccctgccctccatttactaagctctgaatacagatgcaggactgcttcagcccagaaaaaggtgtactatctcttttctaatctttctggccagaaagggcacctttttctaattcttgacccataaggagcacctttttttttcatttaaaaaatttaattattatggctacataatagttgtatatatttacagggtatatgtgatgtttccatacaggcatacactrtgtaaggatcaaatcagggtaattgtgcatccatctcctcaagcatgtatcatttctttgtgttagaaacattccaattacactcttttagttattttaaaatataagaaaaattattgctaattctgccgggtgcagtggctcacgcctgtaatcccagcactttgggaggctgaggcggaacagatcacctgagatcaggagttcgagaccagcctggccaacatggcaaaaccctgtctctactaaaaatacaaaaaaaattacctgggcgtggtggcaggcacccgtaatcccagctacctggaaggctgaagcaggagaatcgcttgaacccaggaggtgaaggctgcagtgagcggagatcatgccattgcactccagcctgggcaacagagcgagactctgtctcaaaaaaaaaaaaaaaaattattgttaactatagtcgtcctgatgtgctaccaaatactagatctcatttattctctctaattgcatttttgtacccagtaaccatgcctactttatactccacttcccactacccttcccagtctctagtaaccatcattccattctctataggagtaccttttcctaataggaacaaagtcactatgcaggctggcagccttgctgcatgcaaatgactgaactcagtccatctttgaacttgagctcccatagtagcagagagtggaataagaagtaagaagacccagcacagcttgtttcatctgaaaggttttgcaggtcggaaacttctcacctgaaggctgcagcttatgctgttgagaatctgtgcagagcctctgggtgctttctcccagggtcctcggtctgaggggtatcagggggaatgagagaaagaacagagggctttctttctctctgccaggggtctggacctcaaactttcttctaagaccttctgttcaatagcacagtagagtggctctagtaaacaataatctattttatatttcaaagtaactagaagagaataattttttttggctcaggctggagtgcagtggtgtgatcttggttcactgtagcctccacctcccaggttcaagaaactctcccacctcagcctcccaactagctaggactacaggcacatgccaccacacccggctaatttttgtagtttttggtagagacaaggtttcgccatgttggccagcctggtctcgaactcctgacctcaagtaatccacccacttcggcctcccagagtgttgggattacaggcgtgagccaccatgctcggtcttagaagagaataatttgaatgctcccagcataaagaaaagataaatgtttaaggtgatggatatctatctctattaccctgatctgatcattacacattatgtgaatgtatcgaaatatcacatatattccaaaaatatgtacatctattatatatcaataaaaataaatatttgattctagaggttctctcgagctcacacacccagccgagctggtcttgagaccccaagcttcagccaggggtctccaagtttcctagaacgattctcagtgtgatggaggctggtttcttctcaaattcccaaagctggcagacacccagctggatcccacctgggcctgatcacccagttgtctctacaataaatgaagtcaggcaggcccacagaggcttycaarggaccggagagcaaacttgttcattaggcaaaatttactgagtgcctactctgtgccaggcattggtgaatgctggggtgcaacattgaaccagtcatggccctgccctcagcaagctccaaacccagtcagagagayggccaataaaataagcaactactgtacygaggaacagggctgtggcaaacaaatgacactcatttttgaatgagtgagtgaattcaagattcagtgaatgaatgaagygcagtgtattgtgctatcctggtctggaggatgagagaaggctttctagaagaggtgataggacacctggaggatgaataaatttagccatgtgaagtggggaagagaggagtattctaggcagaggaaatggcatgtgcaaatggcctggggttagaacaagatgggatggcagaaccaagaaaactcgaatctgaatcagtcagcttaggctgtgggggccagggtgggatggtgtggaagagatgctatttgtgaagtaggcaggacsrggstgtaaaaaacactgtcatccatgtcaaagagtttagatccattcaaagaaatgggatttttaaacatgcaggagaggttggtattttcaggcaccaaatttaacccaatgagaacatttcaatagtgcctttatccctgttttctggtgatgatggaaaagcataatgccttgtagatttctcagttctgaccacacaagttacatgtggataagtcagagccaggtggtgatactctgaaagtatccctgtgagctcagagtgttgggttgagaagatgaacaaggctagatccacttctatatccactagcccagaggggcctcacattcaagaaatccttgcctacggggatccatggtgcaccaggaaaaatgaaattcgtagtcaagactaggaacaagtacttgggagagaaaggcccagcctggcagcctccaggtagcaaaccacaagataatgaaaattattgtactcacaggcccctgtccttgagttcttccagcctagctccctccaggatgggcttgttggattcacttgtaatacactggctaccaaccactcaccatctctggggcaaagattccatgatcccatctttgtaccaagcccaagccagagatcgcagatctcagggtctagttgcctggcatgatacattcctgacagaggtggtggagatacatgtgttaccattgaactccagagttgagaaagatgtggcatctaaaatgcaaaacaagaagacaaataaataggaggactgaatgggaacagggcctttacattattgttttaaaagtctcactctagaaaactccaccagagcaaccttattttgaggtcccttctcccaaagcaaagctatccagtgtgccatgcaggtaaagtggcagctgtgctggacagaacttgctaaagctagactatcaccttgcctgtatgcaaagcctcctgggagaatctacaaaggaattcctgcctccccagccccaggagctgacatcctgaccrcaggagttatgctattctcacagttccaatgtgtctgtgtttcaccctcatgaccaattgctgagaaggcagaaatagttcttaagaaattccagaagtagaagtcccccctcctttagggccaagatgcacaagataaagttkggggaaagagtaggctttttatggtgaaagctgccctaacatttgtggggtcagagcaaaggtatagaagaagacccacaaattagatgtctaaatgtttataaataagtcagcaaacttaatatgttctcttatcttggtcaacataccttcaaaatgatctgaaagttagttatgaatttagacccttggaccatttcagagtgccaggatatgacatggcagtggcgggagaatctggccctggaaccatccctttctctctctgcatctggcacatccaacaccatgatggggcttacacacatgcatatagacccctcagcctgaacatccaagttctgtccaaatagctacccttggacctagaagtgtggacacttgaagcatggtctacctgcaggagaatggatccatggatgaggtctacagagacctggaaagtggcataggagtcatttaaacagagaattttgggatctcaggtacccagagagtggttaaggcgggcagcagtcttaagggggtgccttcttggtcccccagatttctcatcccatagggatggttatctctggagaaggcccagggcaggggtccctcccatccgcagctaagcatggtactgctggcagaggccagcatcaaacttaactgtgtcatcccagccacaacaggtctgaatatttaaagaaaccccycgccatcctgcttctaaaygcgtgcccgccttcccaagtgctggctttccatcgcctcctttactccttcattggtcctagatcagccctagacagggttctcggggcccctctttattcccagtcaccccaaagcccaatttccaagccccttccaaagccctctgttgcaagcgcatcctccctccctcgtgccccctcaatattcacacctaggtagtagatgcaatactctagctgccactggcatgttccacaagggtttcctgctccaacttgggccctaagggattgattaggttggctaggttaggtcccctttatgacaaaaccaaaacagaattgatgcccccacccgtcaagggcacttaaaaaaccaaaactcaaagttcagggccaagtttgaggatgtgcagaaaggtgtgtgttttttcttgtcaattgcgactctaatgatggactcacgttgcccgctcttccctttctcttacaccttacctacctactaaaggaggagttcttgcttggtaagtggatataatccgcaaagacatgagagaatttattagaagccactcaagagccttagctaccttctacaaggggaaaaggacacacacaaatatctatagtgaccctttttttcgtttatttttggtcagactgtttaacttccattttttttgtcccctcctttcttttcccctttagttgaaaactgctaaaatgtcagtttgcgaccttgactttatatttaaaaaaacaaaaaacaaactctcatctttatttcatttcttttccccatgtgatatttgtttaggtttctattcaggcaactttttcttttcaaaaaaaattgttaaattaattgaggatttggttgaagtttaaaattttggctttatctgcttttatttttaatttccaagatatattttttcaggcccatagttccatttctttttcccctttcccttcctttattttttattattgttttaggttaagggtgtttacaccccctttctattgagttgactcttttgtttaattcattagaaattaaattttgtataatttcctttttcttttgtttaatctgaatcgcatgctttttctctgcatgatacctaaatcttccagttatcctagcagggggtaaaaaaaaaatctcctttctgtggtattccttcaggaatttgtgcttttgttttttggcgtctcttctttcttctcctctctctctctttcctttcgttacagtgcatcatgacggtaaacatttcttggttatttagaaacagcccatgggcccagcgctcagcagtgtccaacgggtctttttgctttcagatcactgggtcggggtctgctgctgacctctttaccaaaacagccagcccgctcaccacctcrcgaggacgttcccaggagtacgactcaggaaatgacacgtcctcgccaccctccacgcaaaccagctcagccaggtctcggggccaggagaaggggagccccagtgggggcttgagcaagagccgggagctcaacagtggcaacacctctgattcagggaactccttcaccacctcctcaccccagaacaagggggccatgttggagaatctctcccccaccagcaggggcagagagtcaaggtcagtgcaccacacagggtcgggggtagacggtctcccaccttagctccaccttctcatgctctcatcccagcctcccccactccacccccaagattattttatttgtaagagagatgaaactcaactcagactggcttgttttaaaacactagtggcactagcttcaggtacagctggattcaggggttcaaaaatatgttgctggaaatccgtctttctcattacatctcttattctgcttcctcatcctactggccttattctcaagcagatcctcccaaagcattgtcaaatatgccaagcagctaacattctattggtttagccagccaacaggaaaacaatgcttctttctcaaagatttcagccaaacaccaaggcaggtgcttattggttctgtttggcccagcttaggtcatctgcccatcactgtcccaggggatgctatgctgttggccagaatgtgtcagatgccatcactagggctaatgagtcgaaccttcccacactcctctacaggaaaagccaggttattggtatcaggagagatggaggctaggcaggcaaaaaaacagatgacaattttaccagtaatcttagaaggaagtcgaacattgaccaggcgtggtggctcacacctgtaatcccagcactttgggaggccgaggcgggtggatcacctgaggtcaggagttcgagaccggcgtgaccaacatggagaaaccctgtctctactagaaatacaaaattagccgggtgtggtggtacatgcctgtaatcccagctactcgggaggctgaggcaggaaaattgcttgaaccctggaggcggaggtggcagtgagctgagattgtaccattgcactccagcctgggcaacaagagtgaaactccatctcaaaagaaaaaaaaaatgaaagaaagtctaacattaaattaattgtaagtcatttaagaacatatcacaggccaggtgcggtggctcacgcctgtaatcccagcactttgggaggccgaggcgggtggatcacgaggtcaggagatcgagaccatcctggctaacacagtgaaaccccgtctctactaaaaatacaaaaatttagccaggcatagtggcgggcgcctgtagtcccagctacttgggaggctgaggcaggagaatggcataaacctgggaggtggagcttgcagtgagccgagattgcgccagtgcactccagcctgggtgacagagccagactccatctcaaaaaaaaaaaagaacatatcacagtatttacccaaatgaattgaaaacttatctctacataaaaacctgcacttggatgttacaacagctttatttgtaattgctaaaacttggaagcaaccagaatatccttcagtacgtgaatgaatacataaattatgatacgtccagacaatggaatgctattcagtgctcggaaggtatgaggtaccacgctatgaaaagacatggaggaaatgtaaatgcatattactaagtgaaagaagccaatgtgaaaaggtcacacactgcatggctccaactgtatgacattctrgaaaaggcaaaactatggagaaagtacaaagataagtggttgccagagggtgaggggacagagggatgaataggcagagcacagaggatttttagggcaatggaactactctgtgtgacactacaatggtggataactgtcattatacatttgtccaaatccatagaatgtataacaccaagagggtactctgatgtaaactatagactctgggtgataatgatgtgtcaatggaggttcatcgattgtagcaaatggaccacgttggtggaggatgctgatagtggggaataaggctgtgcgtgtgtagcagcaagaagtatatgggagctccctgtgctttccattcaatcrtgctatgaaactaaaactgctctaaaaaataaagtttattaattatagatacagatataccatagtataatttatcaacatatcagagaacattgagatttctccatttttttacccatcttaacacactcactagatgcagttttcctgcagaaaactcttccacacagatgcatatgagccagttgtaattctacttcgtcatccgcttaactctctcactcaagaaatcacaacaaaatgctaatcactgaggttactgtcatcataatagctactaaaatttactgatcacttagtctgtaccattcattctgttgtttattcctcaacttgtttatcaggcaagtcctctctgccagacactcagcctggtgctggggatttaaaaatggaacagtcctttttctcaggagcttataattaatgaggcagatgcacagttgcgggatgggtggaaaagctttgctggtgccctctgtcatgctaacagtgaggtttttctacttctgagggtgggagtttgcctttgttccatgtagccaaaattttcaaaagatgactaacgccttagcactgaagcagctaacagcttcttcaaagacagagcactctttgtccctaacacataccccatttcagtcctggacaaacagcttgacatccacatgcagaactgccttcccatttgcctgccccaggtcatccctggcctcagctcacacccaagcttgactgagaacctgagctgggccagagccaatgtcagtgtctccaagaacaggcagtgaagttcccagaagggaggaggaggacacatgtttactgatatacagcagtgctattatgcaggaaaaattgaaatagcaataacaacaacaataataacggcagttcatattcgttgagcccaaatcacatgctaggtacactgccaaatgctttccagaaataatcttcccgagctcctcaaaacctttataggacagtactatttgtaacccttttttacctgatggggaaactgaggctcagagtggttgagaaactcagttaataagtggcagcaccagaattcaaatacaaatatgtcccccaaacaggaactaaagcctgagagacatctagcagttacctgtttaatttgatctccatggacagccaaattaagtaatttagacccagcctttcactttgaaatataaatgatggttgagtccatgactgtttatgtcatgccacttatgagcagagagggctcaataaatatgggctgagtggaagagacatcagctctaaatcaaaggaaccatagacactgaaggtagggagctggtgaggtgggaggggtggggactctggagctgcacagatcaaggtttggggctctgggtggttttgaggaaataacaaacccttctgagacttctctgtaaatctgggggtaataatagcattggcagctgggcgcagtggctcatgcctgtaatcccagcactttgggaggccaaggcaggtggatcacgaggtcaagagatcaaagccatcctggccaacatggtgaaaccccatttctactaaaaatgcaaaaactagctgagtgtggtggtgcgcacctgcagtcccagccactcgggaggctgaggcaggagaatcgcttgaacctgggaggcggaggttgcagtcagccaagatcacgtcactgcactccagcctggcgacagagcgagactgtctcaaaaaataaataaataatgatgtcggcttcagaaggttgttgggaatgaaatgatgcttgtgaaattctcagaacattgaaaaggtccccagggagctgtctccagggagctcaatatctgggacagaagagacagcctacaagtataagactaagtaagccatatagggataggcaaaacatagaactaaggtctgtggtaacacactggaggtcgcccaacccagacaggggacgggggtgtcaaggaaggttttccagaaagggtgaggtcaagctaaagccagaatcataagtaggagttgccagatgaagagggaatggagagggtttgcagacagccagaatgttctgaggcctggagacaaggaagagaatagggatatttcaggaggaataagtagtctatgacagctggagtcaggagaggaaagagtcaagacctgagattggaggggtgagcaggtgccaggccatcgtgagccttgaaaaccatattaatgtgatttgaacttgattcttggcccaatccaaataaatatgccttcactgagcacctaacagaggtcagcctggccctaggcagggtgggagtacagaagacagcactctagccttctgataatcctgaagcctctgtcttttgggaggtctcaattcctccaactgcaaaatgggttacatcaaaatttcccaaaactaaaccaacaacaggtcatcttgatttttaccatatccatgtactactgatattcctgtttactttaataaactcatttttaatatataagtaaaaggaaaatwacagtactatctgaaatagaaaattagaatcaaatgtccttggccgggcacaggggctcacatctgtaatcccagcactttgggaggccaaggcgggtggatcatttgaggtcaggagtttgagaccagtctggccaacatagtgaaaccccatctctactaaaaatacaaaaattggctgggtgtggtggcatgcacctgtaatctcagctactcgggaggctgaggcaggagaattgcttgacccctgaaggcagaggttgcagtcagccactgcactacagcctgggtaacagagtgagactctgtctcaaaaaaagaatcacatgtcctaaataaaaggtacctataaaaacacatatgattaaaacaatggatttaatcctactagttgcagttgcctaaccaaggctgagtctgaggtgtgctcctctctcttagagagattacaaagtgttagagaggtgttacaaaccaactagcacccaatgggggcttcctcattaatgtaatcagaaggacagaaaaagactagacagggaataaatttctcaccatgtaatctgatgttacttaccatcatgcccatgcctgatgacattctaaaatactccactgtggccccagcggtatgtgtttcacacttgaggaaatgctaacctgaattgtctacttttaaggtatcttctgtctctactcctctaacatatgtggcctgggaagtctttccagagagaataggatgggaaaaggggcaaagagggttctatgagagcaccacagcctaggccaaggtagggaggtattcaaacaagatgctcccagagtagtgggcagtcrgtgctcatggacattttcccacctgcaggggatttcagtcaccgtgtctggaatrtgccgaagtgaagaagtccagtttggtcccatccacagcccggagctcacccatgaaagggtgttcccgcagctcctcctatgccagcacccgatcctccagtcactcgtcccratccccaaatcccagggcttcccccaggtacacccaaagccgatccacctcttctgaaaaaaggtgagtgtggttttgacctttgctctgcagcacctttctccttaggaaattagttaattgcagatgtcctttgacccatgggggagagaagtcagacggacttaggtttgaatactcgttttgcccatttcgagctggtggccttgggaaagtcagttaatttctctgaacctgagttttcccatctgcaatatgaagaaatagcaattcttaccagaaaagattgttctgagggctataaggcacttagaacagtacacagaacataatgaatatcagttattattgctgctattggcatgagaatgagctaatgtgtatcaattaacttctgcatagaaaattatccccaaacttagcatctttaaaacaagtgctacttagttcctgatcctgtggatcagcaattgggctgggctcagctgggtggttcttctgatctcattgggctcactcatacgcctttgattgactggtgggttggctgggggctggagagtttgaaagaccccagctgactcatcactctactccatgaggtctctcctcctccagcaggcctgtcttggtttgttcacatggtgatggcagaattccaagagagagcacagtattgtgcaaggcttctaggcttggaagtaattagcatcccttctgctattctattagccatagcaagtcacaagaccagtacagattcaagggtattcctytcagtgaaaggagctgcaaagtcacattgcaggggatgtggacactgggagaagaaaaattatggccatttttgcattctgctacccagtttcaatagctattggtaatcgcttgattgcctcatgtagaataataatgtagcagaatgagacatgaaatctcagaaatcggaagattctatccaaacgaatcaacccataaattcagggagtccagctttcctctgcaaaaagaaattcccaataggagcttgattgttcctcttttgcaactatacaatcaaaaaacagttgcttatttagctggtcatctcaagactggtccattccaaaaaatgagacaaggcaactgatgaaaatattcaacatgatagagtgacataaatagaagagcaaatcaggctaaaagaaaaattaaggaaagaaatataaaattaagtcaggagacagtcccaaaagtacgtcctaccattctgtaaagttgctatggaggtaagctgcaaatatgacgtctgagctccctgacagacaaagcaaagaggaaaattactccctcatttactacattattaacaaaaaaaagataagaattgaaccagttgctcagaagagcagctatttcaggtttttaattctatgaaaaatgactcagatggctccacagaaaagggactctatatggtgcagtgaatggaaattctgataatatcctttcaaagtatccaaaaacaggtttcatcttgactctttcttatatctctcaatgcatagccaaagcataagttggcaaaagcacatttttccagtgaccatagctggacactgctgagggcactgagaakggaagagctattcctgcccctgttttctaaaagtgggaggcattaacagaaagcaaagaagactaggaggagcataaggattagtcatgtagatgcacaacaatatagtctacaaaaatcaagagcactttgaaaccaaacagacgtgaattaaatttggcttagaggcaaacagtcctgggttcacatctcttaccagctgtgtttagcgaagtgcatcatctctctgtgcctctgtttccccatctataaaatgaaattgataatagtacctaaccctaagatgtgttgaggattaaayaatacacacaaagcactggttcaatgtctggcacataataaaatatgtcatagtcatagctaacatttcctatgtcctgtctaattgatacttagcataggtgccaatatgctatgtgatttacccgaattcactcattcaatttacaattgtctagggtaaggactattattacctgcattttatagacaagaaaacggcccagggaaacgaaatcatctgccaaggtcacacagctagtaagtggccaggatagtaggcacaaaatagaagttgttggtattattattaaccacccggtggggaggggctttcattctttgatcggggcccagttcctctgcctggcttccagaaagaaaaaggtcactgcccagggacccgctgaataaagctcaagccgtcttggataacccaggcggacactcagcaggctcctcagaggctgttacctctcccccaggtcctactcccgctctcccagctattcctccaagtctggcaagaggagcccgcccagcagaagctctaggtcccgccgcagccctagctactcccgctacagccccagcaggtaccggccccgcccctcaaactaggcccgtcctaggccccacccctttgctctgatcctcctctctggccccgcctccccgttctcgggccttcttcctcttaggtctgaccctgactcagcattcttacagttccctttgtccaatcaggagtggcagcgaggcatcaaatacccttgtttcctaatgtctccagcccaaacagtcccgcagacataccccagaattcacatccccagccctcagcctctacagaccgtccccatattcagagcccccagttcttacccacgcaccagggcctgcgtaacattcacgtcctcacccctgcagcacctgccctgctatgatgcccacctgcaaatgctgacacccctgcacaagcccagcccccacccctacggtactaacaaccctcgcagactcttaccgcagccccgtcatcctccctccggtctcccttgcggcaacgtgcagaccccatcccgtgacccagtggggtgggaaagaaagggagtgtccctctcccacgcgctcacgcagaaaatccagcccagccccagctccccagtaaccccccgcgccccttcagggagcgggatcccaaatacagtgagaaggactcgcagcagcgggagcgcgagcgagcgcgtcggagacgtcggtcctactcgcctatgagaaagcgccggagagactccccgagccacctggaggcccggaggataaccaggtgaggccagggggcaagggggacccaccttcaycctcgttcccactcccattcttactcattcgagcctcaggctctccctaggcctccttggggctgggatttaggattgtgcgagcttatggtccccccaaccccaacatcattgaaattacgtgtctgttcaaagccttgggactgagtctcccagctcaaccagcagggcctgcaagaagggggcggggccagcctgaagaatcgggtgtggcatgggggagtggccaaagcctgagggtggagctggggccggggaggtggagctggggccggggaggcggagctgggggagagagtggcgtcaggccagggaatggaggccaaagcaatggagcaggaccttggcctggtggtggatcccgagcagcggagacagacctctaccctcagacctgtacactcagctgtcaggcttaaataaacctatatgtaattataccttgaaccaagtgtggaaaggacaaacaggattgcttagttcccaaagggacctagagggagccacggtggataagccggagagcactggatgtggattggaatcctgaatgtaccactttgcaggtgacctaggaaaggctcttaccttcctgagcctcagttttctcacccatgagatattggaagaaataactcccagaagcatgaggatgaaatgaaaaggggcaaaaagatgtgaacgtgctttgtaaacttgaatgcagagyacacaatgtgccattgttgattgaatggtcagaataggtggataccgttcctggaacaggtaaggcctcagaagagaaaagctctagcagagaagtctgagtgcaagcaaatttctcaggccttgaaagctgggagaatgattgaatgctgccctaagattgggttgggctcttcctgctggccttccaggcatctgccactcagtccagacactggactgaggaatcagggattctccctggagatgacctggaggaggaaaaagaatgtgtttcccagatagcaaggctggggtgatgggtccccttctccaatatcccacagggcaccctgcctcagcttgtaaagaattcctaaacccttgggaggccaaggcaggcggattgctggatctcaggagtttgagacctgcctaggcaatatgacaagaccctgtctctaccaaaaayacaaaacactagccaggcatggtggtgtgcacctgtggtcccatctacttgggaggctgaggtgggaggatcatttgagcctggagtggggtggaggttgcagtgagccgagatcgcaccactgcattccaacctgggtgacagagcgagaccctgtctgaaaaaatgtaattaatataatataatacaatataattcctagcataatttctaaacccactcccttgatccagtgtcacacagctattaagtggccaggataataagcacaaaatagaagttgttggtattattattatctttggggtcaacctagaggaaagctaagatagagagtggcatttccaaatggctgtctagtttctttagtcaatctcaaataattcatcttgattaacccattcagtgtttcccaatctttagtcattcaccagtatcttgaccacatatgacttgtctgtttatsaactgtactattcttaattttctttaaatagatatgactcttttcaaaggttcatacatttatttctaaaggaaacgatacagtacagtaaatggaaaattagcctcttttgccataaatagatggttctagtaaaagtaaaaatagaaaaacaaaactatgattaaagtttagatgtagattctgttgcaagctgaaggctctgagctccaggcttgcttcatgggggaaagaaaaaagtgagataatcatttttcaagacatactagcactaagctgagacttttactttgatgtgttctcagcactgcaagagaagtggaaagggagtattttttcctaagggactgggraaagggaggatattggtttcccttgggacaagactggggctcgctgcggggaggcacggaggggccggccctcatccctcctctctctggtctctgcagtgcccggaaacgccccatcccctactatcggcccagcccctcctcatccggcagcctcagcagcacctcctcctggtacagcagcagcagtagccgctcggccagccgcagctactcccggagccggagtcggagccggagccggagacggagccggacccgcacgagcagcagctctagctcccgcagccctagtccgggctcccgcagccggagccggagcaggagccggagccggagccggagcaggagccagagccggagctacagctcagcagacagctactccagcacgaggcgctaagtgcccctgagccagctgcccgtgggggccccttcgcgctgccagcctcccccaaccacctgccctccccgccttcttggtgacaaatagtgagggctcctataccttgtccttcctgcttgcctaggggaagaggagaagagggtaagggggcttcactctctagatcagcctgctaggagcctctaccagcatcatcctggggcccagctcaggcctgggcatatggaaagaaccatcatcttgtggcacaaaaaaagaagaaagaaaagaaaacttcaaggttttgtgagaagcaatgggtctgtgactcaaaaattgagccctggccaggaaaatgtggagacagttcttctcctccactgctcacaggaggcccgtggtaattctccccacctccccggatgccccactagtccaacttcatggctgcacgtggatggacccccatgtctgagaggggtgaaagaggagaccaatggcagttcaggttcaagataacggggtcaggcctttaacttcctcaaacaggcccaagcaaaggctggaagacatttgggtcctagaagaagggatatccttgaataccagatggggacgtttgacttggtgggaggtgtcaggagataggagttggttaagatgatagatagaaaaacggaagggttcagctgctgctcccaatacctcagcatggtaaggggacagagcccagcagatcccagctgtgaagaggccactgcatggctgacacaaaacacctcttggccattcacaggggccctgcaacctcacgagaaaggagatagtggaagagtcaggacaggttggtctccagccccacttcccaaatatgcctcagccccactagctggcaccaacttaattccacgggaccatctgctgaacattccccagtgccatggccagttgccaggccccagcgccagccagtctggccttaccctccggttggcgcctgccagccccctcccctctgcccaggctgccacgccctggatgccacccagtgcagcctggcacctacccacccacccttcagcttaagccactccccttgcctctcaggaattttgccaggatggggcacagcagctcaggtttgggggaaaagacccgaatccagagtgcaggggagaggggcttggatatgccatgtcttgggctcctgctggcttctgaggtttcttgtcagcttgggaaagacccacctttatttttgccctcaccccaagtcccccctggctggggctgggcagagagggtaagctgatctccgatccacaaataccaccagctgcttcatccacagaaggcgctaagaacggggaggtgaggaataagatccttaaaataaactcttgggcatccccctcaccagctgactggctttccggaggcttgtgggtgagtttcaagtttgtggtggcaacagcagcaggacagggcacggagggagcgagggagagaggaccggtcccagcttttggatattttgggttatggggaagcaagggccaaacattctttatccctcccaccccagggaaaacatttggaaaatagtcctttttcttggaagcagtgacgtctccctacccaatctttcccatcctatcaacccatggggctagagactgccatgcaaccaccaccacgacagcccttcctccatcagaagacaggagtgagggccccgggcagcagtggacgacccagcctccccataccgggcctctggcccagacctaagccctgcccacaaagactaatggatgccagtgctgtcactgcagaaggccagatggcaggtgcctgggacaggggcaggtgccccggggagggcaagtacagccactgtaaataaccctcgtccctgcccaggaacccagactggacttcagtctccctccatggagacaaaggcttcccagagccaccaaaaaccttcttagcaggacagctgtgagaggcatcagaacctcacgttcggactgccttcatcaagacaactctaggggaccattttgcctggggctcctagcaaacctttttatttattttatttatttatctatttatttatttgatgactgtctctctttctcgccattagcagtattgaattatttatttatacagaggttttgtgtgtgtgtgtgtgtgtgtgtgtgtgtgtgtgtgtgtgtgtgtgtgtgttggggggatctcctaaattatttctgtgcatctcctttttttttctgctgttttttatggatgggatttgagaggccaaaggtgagtgggctattggccttctccctgaaggctctaagcctggaacaccctggggttggcccagaaggaggcacatcagtcccaaaattcatcacttaacccagcgtccaggagggtcaggcctgtaccccagcctcctgtcccccaggaacctcacaggggtatcaaaaagatgtaaacagcccagaggcttatgagctacagtgatgaattgacacagtggagttgcaacttaggtgggggttggagtcgaaagttggcaaatggggccaaggctgcacaaagtcgaaatcccttgtgaatgtcccttagggaggcaccagattggagacagatgtgctatctcctaacagagtgatgaggcttcagttgagtacttgctgaagtagttgccttgtattttgagggccatggtggatgaaaatgatgtctggtttagtactggaattgcacttggggttgacaaggtgctcacaccatgagaatggaggcaggaattgagctgactgagggaagatgcaccttgatctcaccctcactccaaggcacatagcaggatcactccctagcttctctgagcacacctagttggtttcatgtatgttacacatgcttccactccacagtacctaatttctctctgtcccctgagatctgaaggctaccttgggaagaggcatcagccatcttgcttgagaaccaccaagccaaaagcaaaagcttttatctatgatctcttgctgtttcatcaggggaaagcacaaagctatttctgaaattaggaaaaaaaaaaaaaaggtggaaggagcagccagatgttccacaggaccccaccaagaaggtcatttccaaacccatcctggaagggcccaggatccaaaggtcatcagtcctgcttatctgaccaactggcagtgtcttctggctgctggccggagacagctcttgccctttccaaagtcactgtccactgccttgcaattgccagcttgtctggtccagctttgggtttggtgagacttttgcaacatccctggttgtttccctggcaatgtgactatccagccctaacccaaagcaagggagtgcccctttcctgggtgaagtttacaagaaggctgcttaaatgcctgcttcggggaaatctctgcctctctctctctctgtctctctctctgtctctctctctgtctctctctctctctctctctctctctctctctcagtgtatttctctactttcttttacatttcctttttttctatccaaaaacaatgtgcttgttgaggcactggtaaccctgattaaccagaacctcccattcccagtatcgctgttcctacgcccatttcaccctcattaccttctgcttccaaggaatatgacagatcaccaggatgctgctcgtcgtgaggatttatctcaaaaaccaacatccaaaatgggagggagatgtggcttgaggtcaagcgccatgcatcccaagcctttgaccttcccgctatggaagtgcactggatgacagaaactgaatacattgctccctttccctagggcaaagttcgacctctgttaagtggagggatttgtgagataaaaattcaaaatgttggcctgaggcctgagagtgtcaccaaagacagagggagcttcactgagactcagagggaaaaggaaaagagcctcaaacatttttaggaggttgtccatcatgaaagtaaaaacgaaaagcaagatttgatctcccttcagttaattaggcaaggctaagtaactcaaagccccctattagtaacattctggttcactgaggtttgatcatattcctatctgcattccttcccttctttgaaggacagctgatctttcagaagcagaataaaattaagatgttagaacaaaggtctcagtctcagagaaccgcatcacttcatttgctcagacccatcctcttttgcaaaagggtctgcttggagaggccaaaattcagggtgctctcaaaggcaaagaaagcacattgttttccttctccagtccaactttcatcttttcttctgctgttttcttttcccctcttctttttcacaaatgttcaaaatggtctcatgcgcatgtgtcttgccccactttcccctttagctgaacagaaaattttgtctcagtaaaacgaagtcaaaaaacaggattcctccaaacatgcctcctcccgcactggccagccgagtccagctgagaaacttatgctagattcaatgtcattgagcaatgctttattgaagtctcgttcttctcacttctgcaccagtgagccaatgatactgacagaaatgtcatctctcttctatctgtggttgctgtttttggagtaaaagtttctgtgtgtgtttttttagttcttttgatggctgttgttttgcattgtaaataccatgatgggggacccccatcagaacatggcttatttaataatttatttcgtatttattgagtaatattgggaaaagagaaggaccacctctttccctgaattgctattgagaattggtccatctcccagctccaggtgctgctgtctgcagcaagggcattactgcccaggtaaggagtgctagaatcaccaagcaaattgaaattggcagaaatggaggcttcagtcacacaaattagactcaaatggaactaaaacactggttatctccaggaaaacctcatttagatggaaattaatggaagaataaaatgcctacacatgaaccaacttctattaaaaagtcacaactccttgaaaaaaaaaataaagaaaaattgtaaactcttttttttttctggccaaggaaagctatgcctcatcttctaacgagccaagccaaaaagactgcaatggtattcctatgtgtttctttggcctgtgtatcagtctgaatgaaatggaatgggtctctagcctcagtcttgtcatctgtaaaatggggcttgtcctatatattatctgcaagacgtgggaaatgggggctcaagccctgatgctatggactccatactgttggatatattgtctcttgtgtcttctgctgactgcagattaaagggtgtcaaccaaggaaggaaacaaaaaagtagggcctggacttcatttgcagaatgaggtcayagtcgttgagtcccacagtcatatatgggagacctcaagttgctgtcaccttgataactcttgtatcctgggttaaagccctctgtatttagtttgaacttctctctaagccccgtggtccaaagtcatcacgggagagaccaagatgggcttaccttgccctgctctggatttaaccattgttcattgtcaggctatatttttgtacaatcattcaaataacccagtgacataggtcatattgccacttttcagaggagaaaactgaggctcaggagggggagttgacatgcccaagctcccttgagctcagatcagcttgactcaatgtccaacattcccttggtagctttttctccggggtcctgtgctataagaacttctctctgcactgtatttttttttctcccaattcttagctatttcctcaagcaatgattggccaaggacctagcataatccaccacattggccaaggggacgtggtgcaccccaaggccatttctctgcattggaggctgcgaatctcctctggaaaattcccaacccgaggacccaccatgagcccagctcagcctgaccagacagcctctgcctggagcattcacatcagatggaaagaagctgctgtgtcctccagcatcctgggaccctgtcctctgcccagtgacacagcagccatggctagcttgatttctggtctccaaagctaagcataaccttcccggggtttctggtttttcagcctgtacgaaacatgtctctgttctaattaaagttcccatggtatggtgttctcatatatggctcagtgttctctgtttatatggggtactcagaattaaaaaatggggagggaaacaaggagctagagaagacttaagtagcacctgctgcgtgtcatacatgttcacactactcagctcacatctttaatcttccaaacaaacctgtatgtattttgggtttttggttatatatacagcatatataccaaatatatacatgttatatatatatatatatatatgtgtgtgtgtgtgtgtgtgtgtgtgtgttagtagcagctatggagtgccttaggcaacctttttggaagcattttatatgtgttatcttagtattcagcaacaaccaaccctatgaagta

SEQ ID NO: 10713 - DNA, 36106 bp, Homo sapiens
  misc_feature (1)...(36106): n = A,T,C or G, or insertion/deletion polymorphism (see Tables 1-2)
agcaagaaagatctacaactccagggcggaaactctgtaaaggcagggacattctgtatagtttatgcactgcataattccggcacccggcccagaaggtattcagtcaatatttgctggatgagtgcatgtaacatgaacatcaacagcccagcctgctctgcctcgccctgccagcttcatctcatcattcccctcaacttagatgacttttctaagttctttcttagaagacattcacttgtaattctcacttgtaaaattgtacttgttgaaatgctgttttacgtaacaatcgcatgtgtcctgtcttctgaactaaactatacacactatgagagaaggaaccacatcctctgaggtgtggttttgtggcctgggagacaacagcagttgtcagtgctcacgagtgggctatggatgagcagaggccgcttgggtggatggacggatgaacgatgggcatgggagggaaggatggagggatggatgctccctggacccagtcctgctgtgtatccctacaaagctcacctaactccacaggcccccaccgatcacagcagggcggggcccctcctcaccatttgcccacaacacaatcctgcagcatccttgtagtttcttcgcatcgtcccctagccatctggaaactcacggaggcactgctcctaaagggttaaaatggaagcttaacattgcctattgttcctgggaatctagaaacacaggacaggaggtacctgtttagacaagatagggaaagtcagcatctccctttaggcaagaaacacagcaggagagcaggtttttattcattgggccttgaggaacagggcaggtggaacaacttcaacaactatctgaagaaagcgtgactcgatcggggcaaaatccactggtcccacacacagcccttcccaatattgccaatgagatcccacgacccacaactgtgtcacacagtttaatgtgacgtgcattcactcctaaatgtaatgtgatttaaataattttgttctgagatttggagttggttggttggtttgagacagggtcttactctgttgcccaggctgaagtgcagtggtgtgacagcaccaccacacccagctaattttttaaaaatatatattttttaggccggagcagtggctcatgcctataatcccagcactgtgggaggctgaggtgggtggatcacctgaggccaggagttcgagaccagcctggccaacatggtaaaaccctgtctctactaaaagtacaaaaattagccaggcatggtggcacacacctgtagtcccagctacttgggaggctgaggcaggagaattgcttgaacccgggaggcagaggttgcagtgagccaagatcgcgccactgcactccagcctgggcaacagaggaagactccatctcaaaaaaaaaaaaaaaaaaaaaaaaaatttgtcttagatgtggtgtcttgccgtgttgcccaggctggtctcaaacgtttggtcttcaagcaatcctcctgccttcatgccaaaagcactaggattatcacactcagcctgggtttgttttctaggacttttgcaacaggcttgagataatttatagaagcctcccggaggctatgttctctatttttttttttaatttttaagcagtaataaatggcaaaactacaggagcagtcaactatgaagactgagaagcctaggaatgaaattcagtactgatcaagtaaaagttacttcagagttaatgacagacaccaacgatacatcgatactgcaccaaatggtaacaggtatgacagaaatcaatcatcggccgcccacacacacgagtgggaaggtgacctcactgtccccaaatacagaatggcctcacctacctcctaccttcttctcatgctgttcacctctcccttggctcagcaccccttgccagttctcccaaggtcctctctgccagttgaaggcttccctgatcgccatcctcctcaatcccccaggactcacaggttgaaagagtcgcagccaagagttagggaacctgaccatgagccaatcccagtgctaagccccttgcacgtgttaattcagttaacttagcaactgtactaagccatgcacacaactctgtagtattattattatcatcgtcatcactatctgtgcctcagaaccccttggcaaatctttaaattctcccagaagtgtgtgtttcccagtttgaagggccctgccttcctacaaactgtgaaatttggcggggtgctgcgggggaggaacccaaatcacaaaataaacctagcagaactacctgtaccatcggttcactgttgctagatggcagagtgtgtgaagttcctggccaattggagaagcagatattaaagttttaaagcaagaaattgcttcagtggcatacaagtcacttgcccagaacacaagcccctgggtgggagcatggtgggtggaacagagactggaagaggaagaatggaagggtgggtgggccatcgaagcctcccatggaagcccccttcacatattctccccctttgatggctgccctgaagagtcagcccccaaaagcaggcttgcgggaccctcttcccagaggtccagaccagattcctttcagtctacttacccaagttgaagttctcacaggctggtaaatgcagtgagcttatttgcaagccagggtcatatctgcctagcaacccaacacgaagacttgaaggactataaacgtggacagagaacaggcaggccaactttacacaaaggaatctgttctcatgcaaatgaccctatgcaagagggctaaaagagggagccttggggacagctctgaagagccaactttttccccaagaagatgttgggggtcttcttaagggcatcatgatggtcttgcccactgtaaaggaaagccgagagggggctctgcctgccacttgggatcaggcagacacaacaggagaggctaagaggggagctgagcccttcacttgatttcctgatttttctggtcctgtactccagactccaaaggttcttttgttcttatttagaactaaacagagttagttttgtttgggggcaagggggcgttgattagcatggcaatgcagtgctttctctggagaagttaaaaaagcaggggttttcacgcttggtctcactaggattgagggaacaaggtgaagccagcctctaactagggtgggcaaaagtcatgttgcgtgacttttttgtgactagcaaggctgtgcgtaggttgggtttccagctacctctccattattcaaacacagatggcaaatgtcatctttggatgagctctagtggtaaaaagtgctagtgtgtatctataaacatggtgtaaccttaggtcaatccctccagtgctcagtgcctccactttcctcatctgtaaaatgggaataatgagtgtcaactacagaaggttactgatgcggttaacattgcattacatgtatggcacttaatgcagtgttgaggacaaagcaaacatttaaaaaagattaatattaataaaatataagaatagtaacacattagtaacaaaaatctattattattattattattattattagaatcatgctccccaaaagccaggtttcacttgctcaaacattcagatgtgatttttccaatcattcattcactcctgaggatttaggtataatttgagtcattttttaaatcaagagactgaagtacagagattttatgtgacttgcttcgagtcactcaggtataaatggctggctgcacctttaggttcctaagacatacagaatatgctgtcatattgcacatgatatttccatatagagtacagtaacaggtcctaagtattaaagtgtaagatcctaaatatcaaagattatcttacaggcagccctgcattagcatgaagtgttcaaatcagtttctaaatatcattatatatggatcctttgaagaacaactcaaaaaagggctctctctcacagggagtgtgttggagtcagcaattaattggccttggtaaagcataaatcgtaacagcagcaagagctaatgggtactgaggccttaccaaatgccagtcactgcgatccgcactttacaagtaccataaattaaaccctccaattctgggaataccacctccatccccattttacagatctggagaaattcacgctctacgaggttaaattacgcctacaaggttgcaaagctgctcagcggccccttggctgtacactactggccatacaaggcaccctgtaccaacgaatcttctccccacttacacaaccagaacttgtcaacggcaaaggatggcatttaactcaggagagcctatcccaaaatggtgagagaactcagcgagcaaggaaggatttttattaaaattcagatcgccgactcctcccggtggcgaccctccgtgcatgcactcccaaactaggctctcttgagtttctgacatcagaaccacattctccgaaccccaatgaaggcagcagccggcgccaaagtctgcatacgaatgcaaataacatggcctttgcttccgagcagtttccaaatttgccctcgggatgtgaggtagagaccaagaagctaagtttgcgcccccgcaggctctgaaatgtctaggatctgacacatgctttgtccccatgaggagctcctgagatttcgcgtgcatcatccgcttagttcacggtgaccttggggtcggggactacgggatgaggggcacggactgtctaaacctccaggtcccttacagagggctccccgcgggtatgggagccatgcacctgtgccgacgccgccactgcctggagggtgcgcgcgcgccccgggccggggatgctgactcagcccggctgctcacattcctttcgcgcaacgcggatgctgttgctgccgctgctgccggtgcagcaaagtgggggaagcaaggcacccgcagcggcccggccgctcgctccctggggcccactgcgacactccctccccactgccggaaggggaactgtgggggtgcgcgagttgacgaaactgggggaagtgggcgctgcaggaggaactcaggcgccgcgcgcgcagctcacacccaaactggaaggaacctgttctgcccggggcgggcgcgaagccgccgcagccgcgagcgccgcgcgggatcagccccggcgcgcgcgtgttccccctcgccgctaaatccctaaatcctcagggcgcgggcgggactgggcggtgggcgcgccgggaaggcgcccgggggtggggacggggacccgcgcgctcgcgcctggccgaggtgctccgagacaggatgcaggcacccccaacaccctgcacgctcgcgctcctactagcgttgcagcaaagctccggggtctgggcgggtcacgcgcgcagaggcgcacccgggttgggagatcggggcgttgtgccaaggaccccggcggcgctggcgggggcggcccggccccggaccgcgacgcggttacctttcgtgacccccagcccaggcggcaggctggcgggcgcgcgaccggcgcggctcaggtccacgtgggacggcgcgcgcgcgccaggcaggccccctccttggctgcgctcagcgctcgcagcacatggtcggcggcggcgcgcccccgaggccggcggagaccggctgcagccggtataggataagagctaggcagcgacgcggggccggggcgcgggcggcagcacgcacggcccgggtcgcaggcggccggggtggggggcggggggagggtgtggctcgggtgcccgagtcgcgggagtgggtggagggcccgggcgctcgggcctcaccagcccgagccaacttgcgctagagtcgggcccgccccctaaggggttaatccttttctcatgttaccgagcggcttataaggagggggaggccaagcctccgccttattgggagcctttgggggtttattctcttcccttctaacttggtgagttggtttattattttacatgtttaaaagtttgattgtgggatgtgggttgttttttaaaaaatatgtgttggggcctttttttgmgatgggaggcggaggagaccactgaacatcttcacattttggagaggttattcccaaaaatattcgctctgacagttaggaatgcccagggccaccgggatgacgcgctcgcgccggtgtgggtagctgagagttgaatgtccgtgaccctggtacagttgggtcccggaagatacctaaaggcacgcctggcctttgagtgccccctgccccgggttgggggctccgggacgtcggaagagtcgggggctccaggctcagcccctccgcggattttccgcatgaagttgcctgcgcgtcgcaggagcgaaatgtcagaggtaccttcctaccccaggctggcgcgcgcacgcaggccgggcactgaggcagcgcgagggaaagtggggctccctgcctcccccgacccccaaacacagcactccctgcggcggccaccgtttgtccccagcgggaagccggggatttcccggcagagcgcgggtcctccacctggactgtcagaactgtcagcggctgacggccggtcccgcgcaacttcaaggttcccgggctgccaaccgcaggaaagcgctggtgtcgccaagcagttccgtagcaagggaagatggttttgcagaggaaatgggttatttccttctaggttgttgtcgtcttttctttttattccccccaccctagcaagacaggtcatagaagtttgttaggtggcgtatataaaatgtcaccaaacatggggggcgtcagtcttagaaaaagctccccggagccaactggggaagagcaattacaacttgtcaacctggaagccggttttgtttgcacggttagacactccgtgccagctccttctcgcaggagatggtttctaccccgggaatgagatttctcagtgatctgattgtttttgcaaatcatggtaagataggtgtcttgcttgtwaaaaagatgccaagtgcttatgctgaaatctctaaaccatgcatctccccatgtcccaagcaccgttatgtggcatttttggggtcaacaatacatccggccagatgatataatagaaacccctcttctcataattaagggaagagtgtccaaaataggaacttacagtgtgtaaataaacaatgcagccaagtggaaaagctccttccagtgtaatgagtaccactaaccctgagttttccttctgtggtttccgaaaaaggactttcctcagtggaactcctgaggaggacacttaaattaggggctcaggtttcaacaccatagtcttgtaaaatggtgactcggttgtagccagtgattcaacatcgtgaggcagctatccaggttaggtttggaaattttttttaaatagagaatgcagatgaactttagccaaatacagactggttttgacaacttgggccagaaacaacttgtcaaagctgttctccgggctacgcctttaagaagaagagaaatccgcagtgcttttgctcgaggtctgcctacaacagtagccaccccatttccatccagagcctgcgttttgaaacttgctcttagctgaccctggaataacactctgatggtctacaataatacaatttttttcatgccctcgggccaaatcttctctcgacaaattaaatcacagtgaaactcccaaggatagcggatttccaagcctttggcaagatacctacttatttatttgtttagaggcagggtctcactcccatcatgggagtgcagtagcgtgatctctgctcattgcagcctcgacctcccgggctcaagcgatcctcccacctcattttttaatttttttgtagagacacagcctcactatgttgcccgggttggtctcaaactcctgggctcaagtaatctgcctgcttcggcctccctaattgctgggattataggcatgagctaccgcacccggccaatactcatttatttaaggggacacttaaccacatgctactaggaaatcctccaaactgcccgtggattgtgtcattgtacttcctccagaagaacactagggtgaagggaagatggctgccgggaacccccattcagaattgtcgagttttgtaagttggaaaaggcttgagagactcccctgacaacccatgctttacagatgatagaagttctagaagttcaggattctgtggtttccataactgtgcagccagttaatggtacacagaaattaacaaatatggcctaagagctttaagaagaccaactcttcggccttgccttcaaagggcttagaaggattaaagcaagtgacggtcaaaggctgtcatagaagtatagactattagggcaggaagagatctaanctcatcagagtctagttcaactcccttttttacatttaccttgattttacattgacattgaaaatggggaagtgaagtgatttgcctaaattccatcatccgtaaagcaggggttgatgggcaggatgactcagctcgcctcaccagttagatccctacncagctgaaaaatatccctacccgtcagataaattcacatggccacagaccaaagtggacagataaacttttatattctggaacttacagaggcttctgcataaatgagttcaaaattcaggcctcagttgctttgtttgcagagacagaaggtttggccttctgctgaaggaatggaaaaaaagaaaaggagaaggccgggcacagtggctcacgcctgtaatcccagcactttgggaggctgaggcgggcggatcacaaggtcaggagtttgagaccagtctgaccaacatggtgaaaccctgtctctactaaaaatacaaaaaaaaaatcagccgggcgtggtggcatgcgcctttaatcccaactactcaggaggctgaggcaggagagtcgcttgaacccgggaggcagagcttgcagtgggctgagatcgcaccactgtgctccagcctgggagacagactgagactccatccccaacccccaaaaaaaaaaaaaaaagaaaggagggagggagggggagagagagagagagagaaagagagagagaagagaagaagagaagagaaaagaaaaaagggagaagagtccaggaagggttttattctgcaaccaagcactttctccccttatgactcggttttttaaggaaagacctgtgcatgactttacttaaatacaggcattatcacccaggaaggttcagaaaccaggttatcctgttattactttatattgtggtcttatcttcaaagctaaatttaataggacataggatgctttaggatgataaaggcataaaccttgggggtaggacggggttcagggtgtcatctttccttgatggagatctcagttataaaaagaaaagaaagcttctgtccaaaaacccaagaatgcaggtgaaagttatatgtggctctagctagagtagaatagctcagacataaagcagagttttttaaaaaaactaaggaattaacttcccagcagtggctcagaaaggaaatagaaatgaatagtccaccatctggctaggtgaggtggctcacacgtttaatactatcactttgggaggccgaggtgggaggatcgcttgagtccgggagttccagaccagcctaggcaacatagggagaccctgtctctattaaaaaaaaaaagaagaagaagaaggctgggcatgctggctcacgcgtgtaatcccagcactatcgtttagatactatctaacgtttaatactatcactttgggaggccaaagcaggcagatcacctgaggttaggagttcaagaccagcctgaccaacatggtgaaactccatctctactaaaacaaaattagccgggcatggtggcgcatgcctgtaatcccagcttcttgggaggctaaggcaggagaatcacttgaacccgggaggtggaggttgcagtgagctgagatygtgccatggcactccagcctaggcaacaagagcgaaactccatctccaaaaacaaaaacaaaaagtccaccatcttctaaacagctgtcatagaatagatctaagcaatgaccagctagctactttacacccatgtttgcaagaaccatctagcatttacactttctccgagctcagtttccttgggccaccaggcttcgcttaagccatcagttgattaatagaattcagtactaaattcaaaagtatcagctgtttctcacacctgtaatcccacactttgggaggccaaggcgggcagatcacttgaggtcaggagttcgagaccagcctagctaacatactgaaacctcatctctactaaaaatacaaaaatcaaccgggcatgatggtgggtgcctgtaatcccagctactcgggaggctgaggcagragaatcgcttgaacccgggaggctaaggttgcagtgagccaagatcgtgccactgcacttcagcctaggtgacatagcaagactccatctcaaaaaaattaaatacaataaaatgctctcctgtaggcttgtacagcaggagccctggaaggcaggagattcagtattgggctatttcagtcaagtcccttcacctcttggggatcagtttcccgattttacaaaatgagtaagattttacaaaaaggaattgaaaaagataacctcaattttccccttcagctttaacattcaataattctaactctattcaggggttacagattcatcctagccccatcccttttgcaagtgtaaacatctgatgatacaggcaagggaagagaggaaaggggcagctggcaccagaacttcagtgctggccagacagagccttctcatgatggcaggtaatctcagctcatacaaaaactgcaatctggtcccactcatctaaatgcaacccacagcccggtccacatggtgagaccctgtctctacaaaaaataaaaattatgccaggcgcggtggctcacatctgtaatcccagcactttgggaggccraggtgggtggatcacgaggtcaggagttccagaccggcctggccaacatggtgaaaccctgtctctactaaaaatacaacaaattagctgggcatggtggygggcgtctgtaatcccagctacttgggaggctgacgcaaagaattgcttgaacctgggggatggaggtggcagtgagccgaaatcatgccactgcattccagcctggactccatctcaaaacataaattaaaaaaaaaaaaaattggctgggcatggtagcacatacctatagtcctagccacttgagaggctgagtagggtcacttgagcccaggagtttttttgtttttgttttttgagacggagtctcgttcttgtcackcaggctggagcgcagcggcacaatctcagctcactgcaacctctgcctcctgggttcaagcagttctcccaccgcagcctcccgagtagctggaagcacaggtgcgcaccaccacaccaggctaatttttgtaattttagtagagacggggtttcaccatgttggccaggctgatctcgaaacctgacctaaggcaatccacccacctcggcctcccaaagtgctgggattacaggtgtgagccaccgtgccctgcacgagcccaggagttttgaggctgcagtgagctatgatcgtgccactgcactccacgtctctctagggtctttatcaaattttatcactatatgttttgtttcaaggtggtcctgagcccyccattaaaactcttaagaccttctgggcacatttctgggttagaacaactgtgccaatttgaccttggtcttagtagctactgagtcctgactgcttgtcagaaatgtgctgaactctggcaagatgtggttgaatcatttacataggatgcatttcagatgcattcattttccttagcatcatcatcagcaaatattttagtccatggaggcagagaccatctcttggtcttttcactgtagtgcccctatagtgaaagcgaggacctggcacctgataggtattttgttgmaaaaataaatacaagctgtgtacaaggtacaggcagggtccggggacatggggttgtacaaagagaaatagacctcagattttgtgagcatataatttatgacatatcaacacacatcaaaatgcaaaggcctttgctgcaaagagcatactcatcttacagcatcttatgccttattttaatcaaccaaatatttagccgtaatagtgtataaagtgaatatatagtccttcccaagtactaggctacagtgggaatggcgctatcagtaggatgaatgatactaagttagatcagatttgctgctttttaagatttgtagagtaaattcagaacattagattttaaaaatagaaaaccagcaagtctgttggatagatgaggttgtgtcctgttatttttcagttgccttctactttcaataaaacctttgccttagtaactttgacccaacaacttatggctaggaaaaggatataaaggatataatgcaccctgaccctgaaaattcacctgtatacaattgtataattgtaaagaattttctttttacattttatttattattttatttatttattttagacagagtcttgctctgtcacccagactggagtgcagtggcacgatcttggctcattgcaacctctgcctcccgggttcaagtgaacctcagcctcctgagcagctgggactacaggcacgtgccaccacacctggctagtttttgcatttttagcagacaccgggtttcaccatgttggctaggctggtctcaaactcctgacctcaagtgatccacctaccttggcctcccaaaggattacaggcatgagccactgcgcccagcttttttttttttttttttttttgagacagagtctcactctattgctctattgctcactctaggctggagtgcagtggtgtgacctcggctcactgcaacctccgactcctaggttcaagtgattctcgtgcctcagcctcctgggtagctgggataacaggctcgtgctactactaatttttgtatttttagtagagacagtgttttgctatgttggccaggctggkcttttttttttttttttttttttgagacggagttttgctctttttgcccaggctggagtgcaatagcacgatctcggctcaccacaacctctgccttccaggttcaagtgattctcctgcytcagcctcccgtgtagctgggattacaggcgtgcgccaccacacccggctaattttgtatttttttttagtagagacagggtttcaagactatactttcagggatcatttctgtagtttgttagtagagacagcgtttctccatgttggtcaggctggtttcaaactcccaacctcaggtgatccacccgcctcagcttcccaaagtgtgctgggattacaggcgtgagccgccgtgcccagccttttttttttttttctgatacggagtctcactctgtcgcccaggctggagtgcagtggcgcgatctcggctcaatgcaagctccgcctcccgggttcacgccattctcctgcctcagcctccggagtagctgggactacaggcgcccgccaccacgcctggctaatttttttgtatttttagtagagacggggtttcatcgtgtttgccagaatggtcttgatctcctgacctcgtgattcgcctgcctcggcctcccaaagtgttaggattacaggcgtgagccactgcgcccggcccagtctggtcttgaattcctgacctcaagtgacccatccacctcgacctcctaaagtgataggattatgggtgtgagccaccacgccagccaacttaaaaaaaaattttttttagacagggtcttgctctgtcattcaggcaagagtggtagtgtgatcacttcttactgccgcctcaagcttccagcctcaactcaagcaatcctcccacctcagccacccaagtggctgggactacaggtatgtgtcaccacaccccgctaattttctttcttttttttttttttttgagacagagtcttgcactgtcacccgggctggagtgcagtggcacaatctcagctcactgcaacctccacctccggggttcaagcaattctcctgcctcagcctcccaagtagctggggttacaggcacccaccagcacacctggcctttttttttttttttttttttttttagtagagatggggtttcactatgttggccagactgctctcaaactcctgacctcatgatccacccatctcggcctcccaaagttctgggattacaggcatgagccaccatgcccggcactgctaatttcttcttatacttttttgtagagacagcgtctccctatattacccaggctgttctcaaactgcagggctcaagcaatcctccagcctcagtttcccaaagtgctgggattacaggcgtgagccactgcgcctggtcctatgtgtagtttttttttttttaagttctagggtacatgtgcacaacgtgcagatttgttacatatgtatagatgtgccatgttggtgtgctgcacccattaactcgtcatttaacattaggtatatctcctaatgctatccctcccccttcccccaaccccacgacaggccccggtgtgtgatgttccccttcctgtgtccaagtgttctcattgttcaattcccacctatgagtgagaacatgtggtgtttgttttttttgtccttgcgatagtttgctgagaatgatggtttccagcttcatccatgtccctaccaaggacatgaactcatccttttttatggctgcatagtattccatggtatatatgtgccacattttcttaatccagtctatcattgatggacatttggattggttccaagtctttgctgttgtgaatagtgccgcaataaacatacgtgtgcatgtgtctttatagcagcatgatttataatcctttgggtatatacccagtaatgggatggctgggtcaaatggtatttccagttctagatccttgaggaattgccacactgtcttccaccatggttgaactagtttacagtcccaccagcagtgtaaaagtgttcctatatttgtagttttttgaggaagctccatactgttctccttattggccgtactagtttacattcccaccgacagtgtataagagttcttttctccgcatccttgccagcatttgttatttttttgtcttctgatcatagccatcccaaatgaggtaagatgatacctcactgtggttttgatttggatttccgtaatgatttgtgatgttgagcattttttcatatatttgttggccatatgtatgtcttttgagaaatgtctgctcagattattcacccattttatttatttatttatttatttgagacagagtctcgctgtgtcaccaggctggagtacagtggcacgatctcggctcactgcaacctccacctcccrggttcaagtgagtctcctgcctcagcctcgcgagtagctgggactacaggtgtagaggtgcatgccaccacgcccagctaatttttgtatttttagtagagacgggatttcactatgttggccaggatggtctcgatctcttgacctcatgatccaccyrcctcaggctcccaaagtgctgggattacaggcgtgagccaccgccaccagcctgttcacccatttttaagccagattgttggggagtttttttgctgttaagatgtttgagttccttgtatattctggctattaatcccctgtcagatgaatagtttgcaaatattgtctacccttctgtgggttgtcttttcattctttttttttttttttggaggcagagtctccttctgtcacccaggctagagtgaagtggcatgatctcagctcactgcaacctccacctcctggattcaagcaatcctcgtccctcagcctcccaagcagctgggactacaggtgtgtgccaccaggcccagytaatttttcgtattttcagtaaggatggcatctcaccatgttgcccaggctggtctcaaacgccttagctcaggtaatccacccaccttggcatcccgaagtgctgggattatagcgtgacacactacatctggcctcactctgttgatatgtttcctttgctgcgcagaatctgtttagcttaatataatcccatgtttatttctgcttttgttgtgtgtgctcttccagtcttatccataaaaatctttcctcagacaaatgtcctaaagtgtttcccctatgttttcttctagtagttttatagttttaggtcttacatttaagtctttgatccatttttagttgattgttgtatagggtgaaaggtggggatttagtttcattgtttgtattgatatccagttttcaaagtgccatttattgaagagactgaactttctccaatgaatgtctttggcacctttgccaaaaatcagttgggtgtagacatgtggattaatttcagggttctctcttctgttccattggtcagtgtgtctgtttttatgccagtaccatgctgttttgattactgttgtgttgtcatatattttgaggtctgttmgtgtgatgcctccagctttgttctttttttcaggatggctttggctattcatgatcttttgtggttccatacaaattttaggatttttttcttctatttctgtgaagaatgtcattggtattttgataggaatccactctgtagattgctttgggtcatatataaataattctttttttttttttttttttttgagacagagttgctctattgcccaggctggagtgcagtggtgcagtctcagctcactgcaacctcctcctcccaggttcaagcaattctcctgcctcagcttcctgagtagctgggattacaggtgcctgccaccatgcccagctaatttttgtagttttagtagagacggggttttgccatgttggccaggctggtctcgaactcctgacctcaggtgatccacccgctttggcctcccaaagtgctgggattacaggtgtgagccaccgcgcccagccataaagaattcttaaacttgaagttggttgccattaagagcttgaagaccatggactcattgattattatagatatcattaatttttagttaggctaaaaatacacatgactgtttcaaagtatatgtaattacagaggctttgaaaaagacagtattcatgtgctagagcccaatccagaagacttaagttaaaccaatgtcaatgtcaatgtctccttagaagtgttaagacaggttggcttgttctgatgtttattgcagtttgaatggagaggcacagtgaggttaggggtaactcagttaactggtgtccagatggggccctacaggcttgtataatagtaccttatttagacaccatattctagagtatcatcatgtacttggaaattcaattgctaatatactaagtggtggtcaactttgaggaaattactcctgcttaacaaactcccagaagacagaatgccctcattttgatttatagtgacattgtgtctgtgtaggtacatccacatggaacaccaaatcataatcagaatattgcttactgagtagaaaatggcggggaagaagagttgactaggtgatcgcggtggccagggacatcaagcagagacgcttatggtatctcaaacacttactcggtggaaggtgctggatgcaccgccaatgtttgcttttcagcctccgttttctaggcttcatttctgatcaacattccttatggtcaattcagtctttttttgcctaagttgagtccttcaaggtcagcattaatacttggtctggtggccatttggtgtccttcaatatgcttctaaatattctgctctggttcttcatgtctgtttttcccatttaactttctttttgggaggccccatgtacaataccaagatttgtatatacatatatatgcataaaagtatccaaatactttatactgcttgtacatgatttaaatattcaacaatcagctgggtgtggtggctcatgcctataatcccagcattttgggaggtcaaggcgggtggatcccttgaggtcaggagtttgagcccagcctggccaacatggcaaaaccccatctctactaaaaatacaaaaattagccgggtgtgatggtgggcatctgtaatcccagctactcgggaggctgaggcaggagaatcacttgaacccgggaggcmgagatttcagtgagccaagatcacacaactacactgcagcctgggcaacagagtgagactctgtctcaaaaaaaaaaaaaaaaaaaaggaaaaagaaaaaacattagctggctgtggtggcacatgcctgtagtcccagctacttgggaggctgacgtaggagaattgcagaggttgcagtgagctgagatcatgccactgcactctagcctggatgacagagcaagactccatctcaataaataaataaataaataaatattcaacaacttaagaaatggggtaagtagttcttatctgttgtttgcttaagagtatgagaatcatcgatcctcatgctattgctgatctgaattgcttttaactttttctttcagattaagaatgacccaaaataaattaaagctttgttccaaagccaatgtgtatactgaagtgcctgatggaggatggggctgggcggtagctgtttcatttttcttcgttgaagtcttcacctacggcatcatcaagacatttggtgtcttctttaatgacttaatggacagttttaatgaatccaatagcaggatctcatggataatctcaatctgtgtgtttgtcttaacattttcaggttagtacatctttcggcctaaccatgacgtaagtatagggcccttttaatttggctaccttggtaatggtagtcgatgtgtttgtgatgctttcattcccttatacgcctgttggtccttcctagccctgactaacagggttttcagagcattgaggattggcaagaaacaaaaggcactgaagaaaaaaagccttatttgccagccatgacagccttcagtttaacacacatgtattaaacatctgctgtctgcacactcttaggattctgtagattcccttaaggagtgcagtcaacctccttttgtgaggatgtgaggatatagtcactgtctaagaagcaacatcaaaaagttgctgatggccgggcacagtggctcacacctgtaagcactttgagaggtcaaggtgggtggatcasttgaggtcaggagttcaagaccaggctggccaacatggcgaaaccccatctctactgaaaatagaaaaattagccaggcacagtgttttgcacttgtaatcctcagtacttgggaggctgaggcacgagaattgcttgaacccaggaggcggaggttgcagtgagctgagatcacaccactgcactccagcctgggcaacagagcgagacaccatctcaaaaaagaaaaaagttgcggccgggcgcggtggctcacgcctgtaatcccagcactttggaaagccgaggcaggtggatcacgaggtcaggaattcgagaccagcctgaccaacatagtgaaaccccctctctactaaaaatacaaaaaattaactgggcatggtggtatgtgcctgtaatcccagcactcaggaggctgaggtaggagaatcgtgtgaacctgggaggtggaggttgcagtaagcccagatcatgccattgcactccagcctgggcgacagtgtgagactccatctcaaaataataataataataattgctgacataccaggccccaatctcataattccaagtggaaacatgtaaatgtggatgcatgaagcaaaatgagatgtgtacaaggagataaggtgaaattacaaatattgttctgaggagaccttctgaattccaagcacctgtttccctaaaggacttcactgattcatcattacataatatactcccagacccaatcgcataaaataaaatggggcttcagtatcatttttaacatactaatcttcacttggtcctataaagggctattgaatatacatgccaggtctcatgagttcattggtctgtcagaaataattgccaagggttttctaagagaaaagggctgttgaactcacctcagaaagttaaccaagctgggcatggtggctcacgcctgtaatcccagcactctgggaggccaagatgaaaggattgcttgagccctagagtttgagactagcctgggcaacatagcaagactccatctctacaaaaaattaaaataaaaaattggccgggcatggtggtacacacctgtgatcccagctactcaggaggctgcagagcgagaattgcttgagcctgggaggtcaaggctgcagtgagccatgatcatgccattgcattccagcctgggcaacagagcaagaccccatctcaaaaaataaaaaaaataaagaaagttaaccaggctgaccttaaacttccctaagtttacacttacacactgtcatggaactgttatctctgaagttattgctgaaattaaagcccttctttaaatgtagtccatttttagccatagaatgtctttacaaggcagttctacatgtttttaccctttgggtaaggtagaaatttctcgttagccgggtgtggtggtgggcacctgtaatcccagctactcggaaggctgaggcaggagaatcacttgatcctgggaggcagaggttgcagtgagctgagattgtgccactgcactccagcctgggagacagagcaagactctgtctcaaaaaataaaaaaagagagagagagaaatttatcttgttagttctcatactatcccttacaagtttcatgaagtcattcctggttctattttaagtgagtatcaagataacttaattttttttttttttgagacggagtctcgctttgttgcctaggctggagtgcagtggtgcggtctcagctcactgcaacctccgcctcccaggttcaagtgattctcctgccttagcctcccgagtagctgggattacaggcacctgccaccacgcctggctaattttttgtatttttatagtagagacggggttttgctatgttggccaggctagtctctaactcctgaactcgtgatccacctgcttcggcctcccaaagtgctggatttacaggtgtaagccaccgcacccagccaagataacttcatttttaaattgtggaatgcttaattaccttcttagaaagataacaaatgaattaggactaaaatgttacatttggtaatctaaataaaaagaaaatcccaaagcttaagttttaggtcttttataactaaaaataaaaatgtagtcaacaagaaatttccacttaatactattataccagaagataattcttccaaatgctattattctagttgttaatgctttgagccaacatcctggctcaaaatgatgagagtggttttattatgagctacatccaagattactttgtattctaatagttaacatagtagatacatatagactaacccaaaaaaatggaatcctttttttcccacttccttttctagcatgttgttgttccttgacccaactctcaatggctcacttacgtcactgttgtcaagttaatattaagtaacctataactaggaaactaatttgccagatttaaatgtcctaggggatacagcttatagaagctaagcaaatgatgattcactttcaattatctatcccatagcaactctccttcaggagtgcataacttagaattcacattctttcatcctgtcaagaaactaactaggctgggcgcggtggctcacgcctgtaatcccaacactttgggaggccgaggtgggcggatcacctgaggtcagtagttcgagaccagcctgaccaacatggagaaaccccatctctactaaaaatacacaatcagccgggcatggtggcacatgcctgtaatcccagctacttgggaggctgaggcaggagaatcagttgaacccaggaggtggaggttgcagtgagccgagatcacaccactgcactccagcctagaaaacaagagcaaaactccatctcaaaaaaaaaaaaagaaagaaactaactagaatctgaccccaaatggagctttttaaaaagaatccaaagtagtgagtagagaaaaaataattcaagcaatcataggaaaaccaatttttattatagaataacataaattcaatacatatctaattttataggtgctcatggtgagtcagagtcatctaaaaatatagataaaagttttatactgttattctggctttctctttcaggagtctgacaaatcgtgttgaatttgaacaaatagtaaaataattcctgcactgactttgcatgaaatgtgttatggtttggttttgttttttcttgagacagggtctcactctgtcacccagtatggagtgcagtggtgcaatcttggctcactgcatcgtctgcctcccaggctcaaacaatcctcccatctctgcctgccaagtagctgggactacaggtgcacaccaccatgcctggctaatttttgtattttttgtagagacggggtttcaccatgttgcccgggctagtcttgaactcctgggctcaagcgatcctccgtcctcaacctcccaaagtgctgggattacaggcatgagccactgcgctcggccatatttatattcgacatcatctctccatgtgcaagacgtggaggaaggagtcttatggcagctaaccctgaagcctctgtgagttaaaatatcgttttgttctttcccggcagctcccctcgccacagtcctgagcaatcgtttcggacaccgtctggtagtgatgttgggggggctacttgtcagcaccgggatggtggccgcctccttctcacaagaggtttctcatatgtacgtcgccaycggcatcatctctggtaagtgttcctctttggctcagaagttgtctagacacttagtttgaagaacaaggaaggggaaggaggaaattaaagccaaactatatttctttctctttctttttttctttaacattaacagtgtctcagatcagtagttttgaactgagctatatggacttcaggggacctgggaatctgttctcaagtgcccaagggtttttgtttgatcttcaccaaagatgatgataatttctcttttgctgtatttgcagccaaaagatagcatttttacaaagtaagacgaatttctgtagccagtatttctcacatcagtgtctgaggatccagggctgtaggggaagtgcaacatgccagacttattcttgggggcctaagaaaacctttttccattcaaaaggagtagccagcatggtggctcatgcctgtaatcccagcacttcgggaggctgagacaggaggatcacgtgagcccagcagtttgagaccaactggggcaacatagggagactccatctctacaaaaaataaaaactagccaagcgtggtggtgcgtgcctgtggtcccagctgtaaccatcctatcactttggaggctgaggtgggaggatcacttgagcctgggaggtcaaggctccagtgagctgtgatcacaccactgcactccagcctgggcaacagagtgagaccctgtctgtttaaaaaaaaaaaaatgaaatgaacaataaaaggaggccatatattcctcatagatgatagatacacacacagttgttaagatttgcagactttaaatttttcctgtatttctgcacatatgaaatgacttatttctttctagatacaaatcttatataaaatttcatgcaataatagtttcatccattgtgaattatataaatttgaaaaaaagtgttgcaaagataaaaaaaaaaaaagttatatttttagtatcccaaacaaccactgaagtttatccagaccgttaatgaaacccatttttctttgcaacrtcacctttgtccagaatgaattacttggctcctagaacttaagattcaaaaagcaaaaccaaaaatcccagatcttttaatgcatccttccagtctcaagcagtatgtgggtctcattggcttttttgacttttctttcacaggtctgggatactgctttagttttctcccaactgtaaccatcctatcacaatattttggcaaaagacgttccatagtcactgcagttgcttccacaggagaatgtttcgctgtgtttgctttcgcaccaggtaggtggactacaacagcctaagtatgaatgtggatgagagacgtcactcaggtattcttgctacgctaacttttgccaacagtatggatgactttcagtgtatgtgtaatgagacgttatttacgtctcttctccagctcatttttaggatctgtcctccctaacccccactttaggtattcagaccaccttaataataggtttcaattcctaactgggcacatatgcagtggtagggctttcttgacacatgcattccagaataatctagtaatttgcaattattcacctgttatgtcctctcgtttttcaaaagasctacattcaatgtggatttagattatgctaataaacacagcattcttatctgtgtgtagatcatctcaaaacaaaatctgtaactgagcacggtggcttacacctgtaatcccagcactttgggaggctgaggtgggcggatcacctgaggtcaggtgatcgagaccagcctggccaacatggcaaaaacctgtctctacttaaaacacacamaaaaaggccaggtgcagtggctcatgcctgtaatcccagtactttgagaggccgaggcaggcagatcaggaggtcaggagatcgagaccatcctggccaacacagtgaaaccctgtctctactaaaaatacaaaaattggctggtcgtggtggcgcacgcctatagtcccagctactcaggaggctgaggcaggagaatcgcttgaacccgggaggtggaggttgcggtgagctgagatcaggccactgcactccagcctggtgacagagtgagactctgtctcaaaaagtaaataaataaagattgagtacattcatactgctgagtataataaatttccacagaacttataacaaaatctggatccatatttcttcttgatggcttctcctgggtcntgagtccattaytgaccttatattatttcttcttcactcctgcctattcaagcaatcatggctctgaaggagcgcattggctggagatacagcctcctcttcgtgggcctactrcagttaaacattgtcatcttcggagcactgctcagacccatcwttatcagaggaccagcgtcaccgaaaatagtcatccaggamaatcggaaagaagcgcagtatatgcttgaaaatgagaaaacacraacctcaatagactccattgactcaggagtagaactaactacctcacctaaaaatgtgcctactcacactaacctggaactggagccgaaggccgacatgcagcaggtcctggtgaagaccagccccaggccaagcgaaaagaaagccccgctattagacttctccattttgaaagagaaaagttttatttgttatgcattatttggtctctttgcaacactgggattctttgcaccttccttgtacatcattcctctgggcattagtctgggcattgaccaggaccgcgctgcttttttattatctacgatggccattgcagaagttttcggaaggatcggagctggttttgtcctcaacagggagcccattcgtaagatttacattgagctcatctgcgtcatcttattgactgtgtctctgtttgcctttacttttgctactgaattctggggtctaatgtcatgcagcatattttttgggtttatggttggaacaataggagggactcacattccactgcttgctgaggatgatgtcgtgggcattgagaagatgtcttctgcagctggggtctacatcttcattcagagcatagcaggactggctggaccgccccttgcaggtaatttaaatacacaaaatacaaacacttgtctactttcccttgtgaattgtgctagcttcctgttcaagccataaaaaaaacttactgccgttttatatttccattgaattttagagctgccagggattagagattacctgagccagccctcttgatttaaatatgaggaaactgaaggccaaagaattgaagctaaaggtcagatggtaaattagtggtcgattcaggactggaagctgtgtctrtagtccagattgaccctggccttttttttttttttttgagatggagtctcgctctatcacccaggctggagtgcagtggcgcagtctcagctcactgcaacctccacctcccagattcaagtgattctcctgcctcagcctcctgagtagctgggactacaggyacccaccaccacgcctggctaatttttgtatttttagtagagatggggtttcaccatgttggccaggatggtctcaatctcttgacctcrtgatccgcctgccttggcctcccaaagtactaggattacaggtgtgagccaccgcacccgccaacccaggctttttctgtcaccttgccttctctcatgctaggcaagaactcatggatttatcaccttcagagcccacctgacttttggaatgatagaactaatggacttctgtaagtcatcttcctttcttaggaaaggtatttgggaatggatagcagcactctgtaaatacctaactgatttgtacagaatatttccttgtaggagggacataggtatgtttcatatcttagatcccaaatgggtctttaaagtgtttgtgattagaaatcgtaccccctgtcaaaagatacctaaaacgggccgggcgcagtggctcatgcctctaatcccaacactttgggaggatgaggcgggcggatcatttgaggtcaggagttccagaccagcctggccaacatggcaaaaccccatctctactaaaaatacaaaagtagatgggcatggtggcagacacctctaatcccagctattcgggaggctgaggcaggagaatcgcttgaacctgggaggcagaggttgcagtgacctgagattgcaccatcgcactccacctggggcaacaagaataaaactctgtctaaaaaaaaaaaaaaaaaaaaaaaaaaamcctaaagtgaactcaagtgaaaataatacagttccttcctaccgaagaatattaccttttcaaagaagtatgcatcgaaatgtcccaggttttaggtcctctgctaggacaggcttagcccaagaagaacaagtatattgggtgtttgtctctttctcctctccagtctagtaaagatttctgcccttaacacccatttttctttagaaacacaaaagaaaacaaggaaggcagtgaaactgagaggcttctgaatgggatggtcgcctgggtgaggggcttatgtctaggaaggatgctgttaacggacgccatgctctcttccaggtttgttggtggaccaaagtaagatctacagcagggccttctactcctgcgcagctggcatggccctggctgctgtgtgcctcgccctggtgagaccgtgtaagatgggactgtgccagcrtcatcactcaggtgaaacaaaggtagtgagccatcgtgggaagactttacaggacatacctgaagactttctggaaatggatcttgcaaaaaatgagcacagagttcacgtgcaaatggagccggtatgacacactttcttacaacaacagccactgtgttggctggagagggatggggtgggcccaacggggacacaaggaggcagaggagctaacccctctactccactttcaaaactacattttaaagggaatgtgtatgtgaagagcactaccaacatcgcttttgttttgttttgttttgttttaagctttttttttttgcttgtttttaaagccaaaacaaaaaacaaccaagcactcttccatatataaatctggctgtattcagtagcaatacaagagatatgtagaaagactctttggttcacattccgatattaaaatagtgacatgaactggcaaagtggttttaaaagctttcacgtgggataaatgattttctttttttcttttctttcttcctatggtcttgtctgaataaactactctcctgaataaaacaacatccaacccaggtcattgaaatgaaattggccagtcaaaaaaaaaaagacttcaatcatttttaaaattyctaattttcagaaatatgaataaatagtttttgttaaaccctttgtaaaataccaaggttcccgttaacaaattacggcctctgcttgctggaaatgaaatatagtttaagaccaaacattttactaataaacaaattttaagtatatatatatatawaacttgaacttcataaatgtgaagatwaccacttctttttatggccagtccttatcagaagtgtttcagtacagaatatacaaaatggcatttaaaaatgtgtttcctgttgcttttagttatacagaaatatgtgactgtagtgtctttaatttaaaccgctatttattattaagttattctaggatgattaaagtaatcaaaagaaataaaatctgagacataagcagcatttttacctcctttctgcaatcctttaaatgcctcacagaatacgtcttatcttgtaaaaatactttcataaaaggccaagttgtcatgattcttccatttgattaggggcaacgtgtgctattaaaggggaaaaaataatggattgcaaatcgccttagctttcaaaactaatttgttttatcatttaagaatacttgaggaacttctttgatcagaattatatttcagagaattgttaaagcatttctgatttaaagaaaaaaccatctaattattgaagcatttctgtatttcacatgggggtaacagagacaattatgttatagcgagttacaagttgcaatttacatcttctataacacatgacttgattggtctaagttgccagaggtatcgggtaactggtcattgttttgttttgtttgttttattcttcctttttttttggagtcacactacatgtayagtattgctcacgttagcagttttctgtaaggagggcaagtgtcaggataataggtggactttttactcacctattttaccacaatctcaccctgcaggtgatggtcaatgcttgctgctccatctttattcatcgttaatgttaatttatgacaactcagggggaaaaacataacaagcctagtttggttacaggtacacacaagcttgaatatttctctgcactgaaatgaaagtggcatagttcatcaccacctgctacattttgtagagcatcttatcagccatagaaataggacaatctataaaactttggggagggtgggggaggaaatgacaaagtgtctgtcaaaaacaggcataatctaaaacaaggtggatgtagcaaatctctgtcactgcttgagaactttgagcttgtggcagttttgcagacttacatgacttcagcactttacgacatattttttactatgaatgttcaatacaatttaatatttataactgatttctgagggatctgctccatgtctattctgttatctgcatgaaaacaaaatgtatgccaatttcagtatgtcaataatcaaggttttaaatgtttgraagaaaatacaaacaagattgctgatctgttctgtattagtgacattctggtacttctagatttgcaataaatttatggattttttatttaaagagaccgattctcttctaagattttttattgactctcacagcattcagtgtttgaggcaattaaagttataaaaactcaccaaagattcactccaaataaataattttttaacgtttatcttctgcaaaaccttttaactctactagagacacataaagtttcccaagaagtttctactgaactttttatttacttatatttattattattattttttgagatggagtttcgctcttgttgcccaggctggagtgcaatggcacaatctcagctcactgcaacctccgcctcccaggttcaagtgattctcctgtctcaccctcccatgtagctaggattacaggtgcccgccaccatgcctggctaattttgtgtatttttactagagattgggtttcaccatgttggccaggctggcttcaaactcctgacctcaggtgatccacctgcttcggcctctcaaagtgctgggattacaggtgtgagccatcatgtgcagcctaaacttttttatgtctttttttttttgtatactttttatacaaaaaaaaagtatatatatacatatatatactttttatacaaaaaagtatatatatacatatatatactttttatacaaaaaaagtatatatatacatatatatacatatatatactttgatcattgaaaacaggacgattttattttatgttgagtttcatacgaactattttaaagcaccttagaaaaagactaaataattcaagggaagtattaagtaatgaataacagaagagggaaataaaaattaaacaatataatcaaatgaagaagcatattttcatctaagaattgaaataagaatgaaagcatcaatggaatttaattattaatcaaaaatacatgaatgaaatgatatcatggtagccagagtaagcctatcaaaagtcataaaggcaaatagttaaagaccacaaccagttacagagtcattccaagaactgttgcaacctgtaagtaaacagcacagactctacatgccaggggttggcaaactttttctgtaaaggtccagatagtaaatatttaaagctttgcaggccatgaggcctctgtctagtcaactctgccattgagggtcaaaagcagccacagacaatatataaatgaatgaacgtggccatgtttcaatggaattttatttacggatactgaaatgtgaatttcacaagattttcacacaggaaatatattttttttcaatcacataaaaatgttaaaaaaaaaaaaacaacacacactattagctctcaggctgaaaaaaaaaaaaaacagtggactggatttggcctgtggaccacagtttccagccccttcaccacacatctgtaacaccggcacaggtcagtaccgccagaagcaaagctctgagaactaacatcctgacccatgggaaaggattcattgtggtcaaagtaattcttagatcataactgccccaaaataggaaagatcaagcagctaacactttttcattgttgttgttgttttgagacagagtcttgctctgtcgcccagactggagtgcagtggcacaaccttggctcactgcaacctccacctccagagttcaagcaattctcctgcgtcagcctcccaagtagctgggattacaggcgtgcaccaccacacccagctagtttttgtatttttagtggagacaggattttgccatgttggccaggctggtctcgaactcctgacctcaagtgatctgcccactatggccttccaaagtgctgggattacaggcatgagtcaccgtgcccgacattatagctaacacatttgttaattacgttttcttttttcttttttttttttttttctgagatggagtttcacccttgttgcccaggctggagtgcagtggcgtgatctccgctcactgcaacctccacctcctgggttcaagtgattctccttcctcagcctccaaagtagctgggattacaggcatgtgccaccacgcccagctaatttttgtatttttagtagagacagggtttcgccatcttggccaggctggtctcaaactcctgatctcaggtgatccacccacctcggcctcccaaagtgttgggattacaggcgtgagccaccacaccaggccgctaattatgttttcatttcccctgattaaaaagattctgctttaagcttgttgacttcaagaggtttcagtataaaccttatgtagactttctctacccaaaagtaaaattattctacttataaaaatgagttgggccaggtgcagtggctcacgcctgtaatcccagctctttgggaggccaaggcgggtggatcacctgaggttgggagttcgagaccagcctgaccaacatggaaaaaccccatctctactaaaaatacaaaattagacaggcatggtgctgcatgcctataattccagctactcgggaggctgacaggagaatcacttgaatccaggagatggaggttgtggtgagccaagattgcgccattgtaccccagcctgggcaacaagagcgaaactccaactcaaaaaaaaaagagttgagaccatgtactcttttaagacctatgtatccgtaactaatacaaaatgtgtccaaaccttttaacaaagttatacattttatactccaataatatgtaatgtagcttttcagcatttatttgcctttccctttgcttaatatctggtgataaaacagaaaatggattctatgtcagcattcttgtggcgcagattcaaatcaccaggtggtatttattacatttagatttccatactccaattcaactattgtaaatcagaaatcatcatgatccttcagctgggcgtggtggcgcacacctgtaatcccacccagcactttgagaagccgaggcgggtggctcacttgaggtcaggagttcgagaccagcctagccaacatggtgaaatcctgtctctactaaaaatacaaaaattagccggacatgttggtgcgtgcctgtaatcccagctactcggggggctgaggcaggagaagcacttgaacctgggaggtggaggttgcagtgagtcgagatcacgccactgcaccctagcctgggcgacagagcaagattccatctcaaaaaataaaaattaagaaaaaataaaaaagaaatcatgatccttagtttcacaagtttgcaaatatggggctcaccaatagggaactagagtttagaagccattgtctttaattctttaaaccgtggccaggtgttgtggctcatccctgtaatcccagcacttcaggaagccacggtgagtgaattgcttgagcccaggagttcaagaccagcctgggccacatggcgaaaccaaaattagccaggtgtggtggctcatgcctgtggtcccagctactcaggaggctgaggtagaaagagcacttgagcccagaaggcagaggttgcagtgagtccagatggcatcactgcacacagccttggcaaagagtgagaccctgtctcataaaagaaaaatagtaatggttatgcacattacttaaaatgacctatttaaggaattcagacatgttacacgcaaaaatgatcactgctataagtatacattgcattgataaaagagaagctgcccttgttttcagatttgtgtttatattgcatgtgtcctaagtgagggcgatcgtagcgtacagctgggccagccgccgttgcataagtaaggaaactgggtccccctagtgttcagttctcgttaatgactctctaaaggtgcagaacaagaaaagtggcaagagaacttacaacttccctttccatgtaacaactcacccaaatcaaaactacttcaatgactatccatttcctacatggaaaattagacgggaaacctgatgcccagaacatttcaccaaatattattgagaaaatacagattgtggccatgtatttgtgtcatttatatgcctttccagcaactcaagaacaagcacgctaacttccctaacaacttatacaccctagaattcaaccaaaactttaagcaccctctctgcactggcacctcccattcttagtcccaactttgtccctgagctcctgatttatatctgcccgcatggcagggcatggatataaaactaggcatcttctacttaaagtgtcctcagcagaactctggatcatcctcctcaaacccactcctccacacatccaatcggctctcctttctaaatatatccaggagctgactgcttctgccaactgcaccaggacccttgatccaagccaatatcatcttagctggattattacagtagtcttctagctggcctgcctgcttccactcttggaacacgccacccccaccttaattttccatacagcagccacagtaatcctcttacagcacaagtctgaactaaatccttagcaatgggccctgcatgaactgcctgatggatactattacttttccctctgctcctgctacactagcctcactggctctttttctgggggggttgggggggcagtctcgctctgtcgcccaggttggagtgcagtggtgcaatcttggctcactgcaacctccgcctcccaggctcaagcaattctcctgcctcagcctcccgagtagctgggactacaggcgcccgccaccacacctggctaattttttgtatttttagtagacacggagtttcaccgtgttagccaggatggtctcgatctcctgacatcgtgatccgccgacctcagcctcccaaagtgctgggaattcaggcgtgagccactacgcccggccctttcttttttttgtttgtttgttttcgtttgagatggagttttgctcttgtcacccacgctggagtgcaatggcacaatctcgcctcactgcaacctccgcctccaggttcaagcaattctcctgcctgagcctcctgagtagctgagattacaggcacccgccaccacacccagctcattttttttttgtatttttagtagagatggggtttcgtcatgttggccaggctggtctcgaactcctgacctaggtgatctacctgcttcagcctcccaaagtgctgggattacaggtgtgagccaccacgcccagcctctcttactgtttctggaattgttcttactgttgcaagcttcaggccttagcatttgtggtttcctttgcttggtactcccttccctgagatgtgtatgcagtgtgacccttcaatttgatcacttccaaatgccacctccctagggaggcattcctgtctatcctattcaaaatggtacttgtttctatccatttactttgctgttattaggttataacagcatccactttgggaggctaaggtgggcagattgcttgagcctgggagtttgagactagcctggtcaacatggtaaaacccctctctacaaaaactacaaaaattagccaggcatggtggcacatgcctgtactcccagctacgtgggaagctgaggcgggaggaccacttgagcccaggaggcagaagatatagtgagccaagatcacaccactgcactctagcctgggtgacaggacaagactctgtctcaaaaaaataaataaaataaaataaagcatctgtttactccttgactctctgtctcatccactagtgtattagggtaggagttctttgttcactgctgtattcccaaggctttgagcagggcctggcacccagtaggcggtgctccatgaatattgttgaatgaaaaaatacatgaatgaatgaatgagttatagacttttttccctttagttacacaagagaaaaaaaatgttatctattgacagttacagttcaagagagtctgtgctgctacgaaacagctggataaccataggacactgaaagcactgtgctgagaacccaccggctcagcatctgaggatggatgggtctcagagtgcccagcagtagtgt

SEQ ID NO: 10714 - DNA, 99445 bp, Homo sapiens
aaaaatagcttagtggttgtcaggggctgggggaaggatgtcaatggcgagtgaatactaatgggaatggggtttcatactgggatgacaaacacattcctcaattaaacagtggtcataagcttatcaatacaaattctcctcaacttacaagggggttatgtcctgacaaacccttcattagttgaaaacaccatgtgtcaaaaatgcatttaagtacttaacctaccgaacatcatagcttagtctaacctaccttaaacatgctcagaacacttacgttaccctacagttaggcaaaatcagctaacacagagcctattttataatcaagttattgactatctcatgtaacttatatgaatattgtcctgaaagttaaaaaaagcatggttgtatggcactgaaaagtacaatttctactgaatgtgtatcactttcgcatcaaccatcaaaagttgggattcatctgtatactaaaggccactgaattgtataccttaaaataatgaatattacaataagtgaattttatctcaacaaaaacttgctaaaaaataaaaattcaactcacctgtcctttttgtggtgacaaacaatgaacaacttcatccaccattactggaatatgtaatttagccatagtttcaaaatctctatcttgagatctgtgtaactcctgggcttgagtttgatctgtttgctcccgggcttcatattctctatatttttctgctgtagtatgtattctgtttggccagacacctaaattaggtatgccagattccaaccaacatgaaaggcattctttatacattctacaaaaatatggataccgaagcattttgtaggtaaacaaatctagaaaaaaaaattaaaatatgattgttggatttttttaaaagaatgttctaatacttggggaaaatcaaattaatatgcaatatttagcacatcaaaaaaaagttaagactcatgatcctaacatcttaaacaagtaaaggtgacaaacccttcttatatatacaaagcaaggaacctaagaggacccagagacgtaatttaaacataatttaaatacaatttttaatgtagcctaatacattctaatatcattaacattttaaccattagggatatgaaaattgattattaggtcaacatttttatgaaacatacttttttgaattttaattaaggctaaaaagtagattcaatgaattaaaactgtttatttgaaaagtaatcaggatgactgaacggattaaaagtattacattttagattcagatggtcttctatttcaagctcttgtatttgtttttctcacaatgctaaattctcatcttcagagactatccctgggaaaagactacgcatgcacatccaaaaaataaaaaagataatcagtctatcagtccgattctctgacgagatcatctccctgtaccctgtatcagtggagtgtatatcagtttaaactatgactgtataaacactcaactgagcacacttcggtatttcatgtctacctttaattatctgtccccggcacccaaaaaacaaataattgatatattccttggatttaccataggtgctccattttcttcagcaatccataactctttaaaatgcagaagaaaaaaaggatttatgtacatatattaacaggagaccttttgaaaacaccatgcattttatacccagctggtttcaagcaaagtttttgatactaccacagtaaacaccgcttgatactacccagttaacactattctttccttacaggttattagttatttaagaatatgacccacaccttcgtatacacaaaataagatgcacatcagtgcttaataaatgttttctgaagaaaatgaatgaatggattaattccagactccacagaattagcattgttatcaatcctcactttgggaaatttcccctgcatgactgaccccaccaaaaaccatatgttctcaaaatactacaagaagcataaatcccacttaaatatgtctgtctttccttttgcaataaaaaaaattaaaaacgttgaaaagctgatcacacgtaataaaacacaaagaaatacaaatatgatgtaacatcaacaagatgttaccttgaggataatatgttaacttcaccaaagctataatctgcagaattgtgtggcaaatgtgacattgaaaaaatgtcggtgggggggggaatgagtgatctaagtagatttttggttgcttggcagcaatgaaatagccaaattattaattatgcctaaggtttctggaaagcgtacaaaagtaagctcaactaccctctgacttagtgtttctaacagtttacaaaataatagctaacatttatttagcacttactaagcaccacttactattataaccacactacatgcgctacctcattcaatccttaccacgactcttgaaatattattcccattttatagacagggaaaacagagaagtaatttgccaaaggccacatagctagagagccgtaaagctaaaattgtaacacagtctacccccagagcctgaactcaatctccatgctataaacattgcccactggaactatttaatccacttatgtaatttaatagtacttcaattaaattgactatatatctgtaatatctcatagattcattttattaaggaaccgacatccaatggcttggctctgttccacttaaaaataacagtatgctgcggggttcccagtaatgaacgtacaatgtatacgcctaaaaagtgaactctggaacaacctaccctatatgtccagattttgataactaaaaagaaaagtagtatcatcaattctaacataggaataagaactatacaggaaaacgcagagtagcgggggaaaaacaaacaaaaaacgctatcacttgcatttaatttttttctattgcattcagtctctatgtgtttattcaactatggtcaaggcacaaagcctgaatattttattatgaactaattgcctgccaacttgagtcaacctggagaaagggtgacaaatagttcatttgcctcttgtttcctgcaatacctccctaaaaaaatggaagctgggggtgtggcatgctctaaagaaaattatattcttctcttttggagcccagtttcctaccagacaacttggagctctcctgcagtctgctagtggccagctaccctaaatgatttaagattaagttccctctggtcataaggaagcagggagtcaggaaaactgcctctgtgatctcctagttaagtcatttaacttttctctacaagcaaagttcacttttggctgttgagagcataaaattgccagattactcttttaattgtgaaaacacacaggtgagtgatgcccatgaaggatactccctcaagggctctaacaattataatcattgcagtcaattttgtctggcagggaaatcctgtttgaaaatgtaatttttaaggacaaaaacgcgacgtggcggctggcacacgaacgctgagaaagtgaaagaggttctaaggaaagagaaaaatacacccttttgcctaagaattacgctctgacgaggaaaaactattcggaaacttccaaacccaggttgaaggcgtgttgaagagagggagagggtcaggggcgtatttttcttttgctccggacgaatccagcgacccctgtggagtacccccaaaggtttggtggtttccaaaacgagttcccgggactcggtccccttctcctcacctgaagcacgaagacttctcagctggcctctaactcgggccagcgactaccactacggtccaggagaacctgaatgcgccgcgcgtctaggtcctgcccctgggggaaacttgtaaggacggacagattgggtccacgtccgcccaagcaactgaggaccgtctgcctttggttccgctgtttccagcctcagctgccaaagggtcctgttggcctggggtttccaaacgactttcctgggggaaataaataagacctcactattgccatgtttaaattcacttttactttttccatttttattttttggtctgaaacaactttaaatctaacttttcatttatccttatctctgctctttggtttacaatgaaagtatattaaacttgtattctgataacacagcagttatactccaatttttaactaaaagtgggaatttctgtctcattagctctatgtttagaaactacaaggagcaaggtggcacagtagtgggattgattgtaatgtcaaaatctctctgctttaaccaaatgtacaattcctttaaaatatggacctcatcatctgaacactgttaaatggcaagtgtaacactgaatttgaaatctaaagtacttggattaggtgtgaaaacatctgtggcactgataaaccttatacaatgtgggtgtcaaaaaagacaaactttaaaacacttctattcttcaccaatgatccatgcaattttacaagcaactggcaaaatatgcatattttcagactggattaagatattctcttaatgtcacttaatccagaaagtatttcagagacaaatgactcaattctgaattgccttgcctgtatagttcaagacaaaattttgtgttaggaattttctgaaaacttcagttttctctcagaaaaatgaaaataatattacctacgtctcatgggctgttttgagaattaactgagagaccatatgtaaagggactaataaaatacctgggaagtcaaaacgtaaagtactatacaatgagttcttactggaaataaagacatctcgattttattaccaagaccagcagcacacaaataaccatttcattagctaagatacacgtaatacagccaaaaataagtagtagctttattgatcctctgtctagtgatcagaaacaataatataacatgcatcacatacagtacacaatactcccgattttcctcaacaggaaataaatgtccataatacagaggtttccatatattgttgcatttataatactctgcatgggtatgagtcatcctatttataaagtgatattgaatccacaaaatataagctccaagagggaagagtttgattccattgcatactattgtgtctaaaatctaaataattgctaaatggatacaataacagtaatatatagaacaatgaaattcagatactgttattaaaaacaccctgccaaataaagttattttagcaaacgtatttccgatttgttccaggtattttctctctttttaaagtgtctatgctgaaataatatctataacctgggacttaaaaaaaatcacttcacctaataataaaccaagccaaaatctttaaatttattttgttatgccatcattagacagagaatgtaaaaagtaaccaaacagaaaatagtttcacggtcagtactaatgggagtaggcctggaagtcctgagaaatgaagcctgaggcctcaacccaaaagatctccaattaattcaggtgaagagaccccacattttggcccatattaatgtgtctggaagaaacaggtccctacaacttcttggaggcctcactactcagagaaaagaaaataaacacccagaacccattaatccacacccaaactccacctctccccctagcagagggcataggccaacccctgcccgcagcagtctcactcacacccttaactctgggaccgggccctgcacccgccggtctacaggaggcctggtgatctcaagtggctgcctcccaccagcagctccggcctagccccgcccactttggccaccgcctccggaaacggccgcgcgcgttgccacggtgacgagcaagcaaagagcttcccctgcgcagccaggctgagcttcttggcgccaagctgccgcgagccgtgacagcgtccgacgtgatgacatcacgcgagcggcagccaatgaaacgaagcgctgaggaaagtggcttgggtttgaatattgtggttgagtctgaagcgctgggaggcggacattaaagtgaagtggttgcggtaacctggcctgggcctgaagtgagtgagaggcacatgaaggtaaaactggactctgggacgctccttttggtgacttgtattattgggaacggagggtcctgccgcttcaggtctagaagaccaggtgggcttcttgacaaacacagaagcgttgaggggtgggggatcagggtacctggggagaaagtgaaaggaaaaagggattcgagaacctgctaagagcacagctctgcttgaccgtaatcctcgactgctcagctggaagggcagggatctccttaagtcctgagaggaagtcttaagttttaaagggcatcttggcccctttcccagactggcagagaactttaactgcccagcaccttgtagtgtcagcttttttccggactccaaattgggagtgttttgtttcagactcacatataagcgtacccaggggcttacctatcaaacgaggagcttttgttcatcactgcataaaatttttgtctgaagagctttaactgttagtcttgcactggtcaatcgggaacccctcctgagccccagttgtaggtagcatcgagataaaagccgctctgactgcctaacgggattgccgaggatcagatgaggtacggaagagatactgtttggcaaatgctctgcagatgaaattaaactgtaaacatttagaatcagtcctatagtctgttcttggtttccgcaggacttttttttttttttaggagctcattagtcactcagttacagagaagccaagactgactgctgtttattatatgagaagagagtatttgaccagaatgaactgattttgtggtataatatatagtttagattatggataattaggtagaaatttaggcactctacagattttaatttttagtgtcattccaccacgtctagcctcctgtttcgtttttgtaaggtttttataaactttgatgctagagaatgtgatatccaatgactagatagtgcttcttattaagttcatagtttgtaagaactatttcaataaacaaagattatctacaaagcacaatcacaaagaaaaaaacttaaaagattatctgcctttaatagtagtaattaatctccttttctattatttattcatttatttgagacagagtctcgctctgtggtccaagctggagtgcagtgacgtgatcgctgctcactgcaacctccacctcccaggttcaagcaattctcgtgcctcagcctcccgagtagctgggattacaggcgtttgccaccacactcggctaatttttgtatctttggtagagacggggattcactgtgttggccaggctggtctcgaactcctgacctcaagccatctgcccgcctcggcctcctaaagtgcaggaattacaggtgtgaggcagggcacccagcccttcctcttctactattgaaaagtatttacaaatacataatatttttatattgaaagtgcatcttgtcccatcatagaaataccccaaatcaattaagagacacgataaaaatgatttttttttttttttttttttgctgacaactgtgaaaactaagaggaaaaaaaatagctcagctgtcagtgccggccttccctccagttgaaccttttattcttccctgatggttgtaagttggtgggagtagtgcccccaagactgatattccaaaaagagctttaagatggactgtagatgatagtgttgagtatcgttttcagtcctatacagtgtttgttgaatctgaatctaattcaggtttgagtttgtatttaatatatcataactgtcactctacttctgtatcattgtttggaagcattctcttctgattccagtagaacctagctgttaataacatggactttagatttgtacccgttaaggagtttgtgttttattcttctggtgagaagtcattggagactttagagcaggtgaatgccatgtgatgcatcacatgatctgaatgcttttgatgaacgtatcagtgaatacaatcaatgaattaaatttattatagtactttcataaaattaggggtgaatctttgactgaattgacttatatttgacatttggttgcccacttgttacgtcatcttggaaaagttacttatcctaaggctaagtctttgtttttgtaaaatggaaatactactacaacctaccttacgtgattattataaggattgaatgcaatgacgaatgtcaagtgtttactataatgcatgagacagagtgtacatactcaaatgaaaagcattgttgttcattattaataattatcaccatatcaacctaatctaagcattgttaaagcatacttattgagaatggccactctgtgatatctgacaagtacagagaaatcataatcagttttattttcacattcaagagctcctgtgccaggccctgaggtttctatcaaaagtaaggaaatataagagagtggtaccagaagctgagttttgggggaaatagggagattttggtcaaagggtacactttaagttataagataaataagttcatggcatttaatgtacagcatcaatggtgatagacgtattaatttaattgtggtaatcattccattgtgtataagaatatgagaccatcacattgtacatcttcgttttatacaatctttgccaattaaatgttttaaaatttctaaaaaagtaagcaatatatatatttttaacttctataagaaaatttctgagggttatatatttacatcagggagagtagtgattaagtatttggcctttagattcagtcagtctgagttcaaatcccatggcatgtgcttcctcagttgtgtgactttagccagttaatttctctgtattacactttctgccttaataaaataggaatgacagtacagggtttatgtcataggttgttatgacgatttagtaagagtatgtcaattgttagtacatttctatttgtgggatatgagctcaatagaaaatataacttattgttactaaattaaatgttgcgattaaggtaaattttaatagtggttttgttgttgttgtttgtctgttttgaaataaaaatacctagaccttgtttaaaatttaaatattacaaaagaatatgaaatggaaaataaacctgtctctcactcagaccttcatatttcccttctatagggaaagtggtattatcaatttcttgtgtacccttctgggaatgaccatgcatatacatatatatcttttaaaaatacaaatggtaacatgctataagtctattaaaactgtactggtttattcattcatttattcaacaagtatttattgggtcctaaatatttgacaagcagtgtcctaggtgctggtgtgcagatgaactccgtgctctcacagtgcttacattctagagggaaaacaagcaataaatatgtaaccagataacatatactttccaattagtgctaaactcaagaaagaaaaataaacctagtaagggattggagaagcaaaggcagggtgacactattttagatagattctttagggaaagcctctgtaaagtggcatttgaagagacctgaataatgaagtgagggattacaatttgcaaatatctggaggtaatgcctgccagtaagcaaaaataaaaaagccaggaggccaaaacaagactgaagtgttttaggaatgctaagaaagtcattgcagctgaagcagaataatgaaatggggagacagcagtagaagtcattgtcagagaggtaggcagggccatatgtggaatttataggccatggtaaggagtttgtattttattcttatgatgagaagtcattggatagtttggagcaggtaaatgacatgcaatacatatcatgatctgaatgcttttgaagaaagtatcagtgcatacaatcaatgaattaaataaaatttattgtacttgcatataattaggggtgaatctttaatctgggatgagcactagctayatatgttataagttaaaaattgacctgttcaacttggcttattaccatgcaagtattcaggataaatagattttaatacctcattaaacattgcagaggcatgagctgttctacataaatgaatcttccagaaaattgaatattagctttgctaagtaataaagtattttaaccacacttaatgatgaaaataaaacatgatcttgccatttctttaattttctaaacaagaaattgggaacattatttctttcttatttttttctttttgatgcctcagggttctcattgtgattgcctgttgttgtcaactattgtactctaatatgttgtttctcttggagatatacattttctttttccttctactctaagtgagtaaattgctttttggggtctgtgagcattttttatagtttattaattcattcattggtatatttgaaaatttactatatactagactctctatgagagaatagggatataaagtaaaagtctattaactgtcatttcttattctcttgtacccttttctaatcatgcataataatcataaaattttggagctagaaaaagactttccgtatcatataatctaacccttttgttttatacattagcaagtaaagcccctttccttagccccttcattcttcttttttgataccctactctctctagactagacaaatattcttcttcaggtttagtatctattatataaaatgcttggtaccagaagtttttttgaattttggaatttttttttttttttaatttttgcattgtgcttactggttgaggatctctaatctgaaaatccaaaatactctaatgagcatttcctttgagtgtcatgttggtgctcacaaagttttagattttagattttcaaatttggaatgctcaacctgattataatgaataatcacgttggaagtatttgtctttcatgttttagttccaccaatgaaatcctaccagtttgctcttttgattctgttcagtaaataccacttaggggtagataggacaaaattgatcagaggctataatactatcttctgaacagctgtctgaaaagaatttgtgaatccacacattcttgcgcagataacgatatttaggcttttcttttgctgcttcatattaaacatggttgaagaatttactctctctgtgccttattcagaatcaactaaatgctcatttcttttagtcagccatcctagaaaacaaagaaggcaccacataataatgtaggaacgatctcattaattccwgcagatgtaagtatatttgaacatagattaatttttacatttgatgattctgttgaccttaggcatttttattaagaaaattctatccacatatttgtttttaaaagatagggaaatacatgatactttaaaaattaacatccatgtctttgttaaaatatgcaactagttgtgaaacaaagttatatttgacattatacttaaaytctattgactgaaagagtcaaactctgtaaaatatttgaagagatttattctgagccaaatatgagtgaccatggcccatgactcagccctcaggaggtcctgagagcatgtgcccaaagtggtcagtgtacagcgtggttttttatattttagagaggcatgagacatcaatcaaatacatttaagaaatacgttggtttggttcagaaaggcgggacaactcaaagcgggggcttccaagctataggtaaatttaaacattttctggttgacaattggttgagtttgtctaaagacctgggattgatagaaaggaatgttcaggttaaaaataattgtggagaccaagttttattttgcagaggaagctctcagcaaatttcagagagagagagcaggttgtaaaatgtttctccgcagagctaaaagggtgcctggcttttagttgattatctactggatctgcaaagaaaagaggaaaacaaagagggaaggggattctctatagaacgtggacttttccaacaagaaactttgcagggcaatttcaaggcttggcaagtaaatctattttgggtgttaaatattttttctttgtctcataatgttatgccagagtcaattgaaaagcaagtcacaatatacggggtcaaataaaacgcatctaatgaaaatccatgatttatagggcgtgactccccagaccccttagataggaatttgggcaaaataaaaaatcagagtttagtcctcattcctttaggtaattgtccaaatttctccctggaatgttacttaaataatcccctcattatagtcttataaagcactgttaaccttttccctataatggcacttgtcacagttatacctttacatgtttgtgtcaatattttattaatatctgtttccctcactacactgtaaataataatagcaaacacttgtagttcatactctgtacaaagtattgttctaagtgtgtaatctttacaactttatgagataggtactgttgttagtcttactttacagatggggaagctgagccacaaggaggttaagtaacttatccactatcacagtcagtacgtcatagagctgagattttaacctaggctgcctggctccaacatgtaatagttgtcatgaattaattaactaattaattagggagggatatcctccagccttgagattctaaggtttattttgaaataatcacttagtattttatgtttactttgttaacaatttcatttatgtatatttaatctatcatttaaaaatagtatatctgttaaaatattgttgaatatttctaaaagcttttagaaatgtgtataggagatagtttttgttatcacaaggaatatgggacactgctggcctttaatagacaggggagagaaatgccaaacatcctctaatagggcagttctaaatgccctataacagggcagttctaagcaaggaagaattggcctacccaaagtgctagtcataagcccattgagaaaaactcaaaagatgaactcagtctctttggcaagaagaagcaggagtggggcagataggaagagaattggtatttactgaataccttaatacttaccccttttagcctttgcaacaaacattgaggtatkattatctcttttatacaaatagaaacctgagactcatggggttaagtaacttgtccaaggtcataaaagtgaggtgtaggtgctttgtgacacttggctagacggaagctcagggatgaaaaacaaagtagtaattcacctgggacctgacttagaatccaaatgaccatcccttccttttcagtattctatttttggccaaagacagagtcctaaaaaggcaaagatatgtctagcatctactgcttttagattcctttgaattctgtccttatttgaattctgtccgaaagtatatggctaagtggttttgtgacatatttcagcttgaatattgctatttctcccatttaaaaaaaaatacaaacaaaacatcttgacaccacccccccccttcactcacaccatttttctcctccctttgaaacagtcctttccatataccttgtctatggatcttctcctttcgggttttttccccactactgccccaaaattgcttttctcgatggcctctgtgttagtaaatcccatggttaattctcagtaagtacttgacctattagcagtatttaacacaatagatcgctgtttcctccttcatttaggatttcccgaaagtttttaaagcttaatactgcattaagactgaggacagcctttattttcttattttcttaacttccacctgccctgacatttccacctggatgtctgtcaaaactctgagacttaagctatccaaaactgaactgatctgaccctgcctcccaccacttcccgccctgctgaaaaaagccctgcttcttatttccatctcagttggtgactactttatccttctaattctcaagccaaaaaccttggagttattcttcaatcctgtctctctctttcactctacatctacctgtcagtaaattctgtcacctttaccctcagaatacacccataatctgaccacttrccacctctgctgccactaccctattctgagctgacagagttgtctcttgtctacattacttcaatagactagtctattatattatccacatagcagtgagagtgatagattatgtcactcctgtgctcaaaacgacttccagttgttctttgtcttactcagagtacaagccaaagttcttttaatggcctccatttctcctctcatgtcttactacactcccctttgctcactccattctggccaacataaagtagcaccctgggtccttctctctatggggaaaagcttcctacaatacctgtatgactaactccctcacctccttcaagtccttacttaaatgttgttttgggtgaatttattatttttgtctcttttattttaacttacaaatgacaaaaaaaatgtgtaagtttataggatacaatgtaatgttttgatacatgtgtacacagtggaatgagcatatcaggctaattaattaacatatccatcacctcacataccatttttttgttgtgagaacatttaaaatgtactcttagcaattaaccatggtcaccttgctgtgcaatagatcaccaaaactattcctcttgtataactgaaactttgtaccctttgaccaacatttccccttttaccacccaccccaccctcctcagcctctggtaaccattactctacttctctgtgttcatatttttagattctgcataaaagtgagatcatgtgatatttgtctttttgtacctggcttattttacttagcataatgccccctagattcattcatgtcgtcataaatgacagaattttagtcttttttaaggctgaatagtatttcattgagtgcatataccacattttttcgatctatttatctgttgataggcacttagattgtttatatatcttagttattgtgaataatgttgtagcgaacatggcagggcaaatatctcttcaacatactgattttaattcctttggatatatactcagaagtgggattgcaggatcgtcctaagtctcaccttttggtccttactcagatcttgttgttttggggtgttttattttgttttgtggtttggtttttttttgtctttttgttgttgttgttgtttgtttttttgttttggtttttgggtctgcagattctagagtattttctggatagttgagacttccaaattattgatctttgttactttacttttcttctttgcatgtgaaccagtcataaaatcagaccataatttttaaacctgctatcattgattccttaaacttgcacacaattagaaagcagagagtaggatcaatattcagagactaggtctctgaatacaccaaggagtctatgccatctctatcaccttcagacctgagctatctagttgaatgcatccttggaactatttttaaccctatgggcttctgagatacaggtagagaccagcctgggtgtatcactttccacggccaaggggcttgcagccaagatcacttttactaaaaatagttcacaagctaaggctctccaatcwtaccttgatatggttctgggagatccttttctattcattcccatgacctaagctgaaatagtgctggagggcttgtgaaaatcaaatctgggttttaggatagcatatctgtgattatatatggttcagctatagtatttgagtttaagccaaatatcctactaatatttcaggtaaagagatttttatcgtagttgtgtgtacgtatgtgccatttaattgtttgttttagggtacttaagtgcatatgtgtgtatgtgtgcatatatttgtgtgtgtgtgttgtgtgtgcctacgtatgtatgtatttttcccccagtgtttacytagtgagtgaaacagaattattaacatcttttttgaatgaatactacatgccagttgttttgcatgaaagtaaaaactgatattaaaactttattttcttttttaatttcagagaagtattcaagtatttatacagataggaatcaagataatcaacaatgtctgtcactgaggaagacctgtgccaccatatgaaagtagtagttcgtgtacgtccggaaaacactaaagaaaaagcagctggatttcataaagtggttcatgttgtggataaacatatcctagtttttgatcccaaacaagaagaagtcagttttttccatggaaagaaaactacaaatcaaaatgttataaagaaacaaaataaggatcttaaatttgtatttgatgctgtttttgatgaaacgtcaactcagtcagaagtttttgaacacactactaagccaattcttcgtagttttttgaatggatataattgcacaggtatttgtttcaatttgggatttaatttctctatccgatttcacttttgcaytaggacggacatctacttgacccttctaaatataatcaaatttaaggagcttgtatgctaaaaattcttaagaaattcaatagacttgaactgtaaatatagactttgaaattttagttatcatatataacttatacatcatttgtaaacctttctcttccagggccttactgtggcccctatagacatctgtcctttcagttgcctatgttattaaaccacatgcttattgcaattaacatcagttttctcataacctgtatttataacttttcctacagcttacctatgtaattatctattcctggagagtagtcagacatttctgaacatttgacagtttcttttcagcagtttttcttcatggcacattgaaataaaaatgtttaagttggcgaaggataggaggagactgaggatcaaaaaactacctatggggtactacactccttacctgagtgatgaaaaaatctgtacactaaaccccgcagcatgcaatttacccatgtaacaaacctgcactgtacccccaaacctaaaataaaaattggaaagggggtaaaagtgttaagatcccatgttaattatctcatgccctttagctcattgttagcccaagaagcatctttagtgctttttttggcctttcaagaaagccatgttgatttcctttttaaaaaaaaaaaaagagagagagagagagagatacccaagatgcaaaatggccagtttttcagtgcctaccaggcactaaacaccattattaatatcttatttttgtaattattagtatttatgatattttccccaagacagctcacaactataacatgtttcactgtcttttcctgattcatttcagttttatcatggaagacataccctcttgatcaagtaaggatggagtgtggtttattgattggtactactgtgattcccatttttaagaagatattcttttcctctttcatgaaacttcatatgtctctagagattttgaaatcttcttaactctaagaaaaaaagtagactctctatcaaactactattgaatttttggtttctttttggctttctttatattcttaccctgtctttaagacagcttaagaataagcttaagaataagccattttaaaccttccttatataccagcttacataaaatagaacaaagtaaaatatacaccatcttaattcatcctactgaaaagtatttttgtggtttgttaacatttggtttagcagacagattgaatttataaaaatattttcaaccaataatgatatgagaagttattgccttaactgattattgtattgggtgtttaccatatgtaattcacagagtggatttttttctttctctttgtcttttttttttttttttttttttttgatgaagtcttgctgtgttgcccaggctggagtgcgctggtgcaatcacagctcactgcaatgatatgagaagttattgccttaactgattattgtattgggtatttaccatatgtaattcacagagtggatttttttctttttctttgtcttttttttttttttgatgaagtcttgctgtgttgcccaggctggagtgcgctggtacaatcacagctcactgcagcctcaacctgctgggcttaagcaatcctcccatcttagcctcctgaatagctggactacaggaatgagccactgccctcagctaattttttgaaaatttttgtggatacagggtctcactgtgttgcccaggctggtctcaaactcctgggctcaagcagtcctcccaccttagctgtccaaagtactgggattgtagggatgagccaccgagcctggcccacagagtggattttttatacattggaagaaattcacatgactttcttgtactgaatagaatctaggaaacaaagtaattcacctaaaacaaaaacttaaaaaggaatcttataaatggcatctatctggtatttattcaagtacctgctttgtggcaagtgatttgttaggtgataaggatacatggcctctgccttggtggagcactcaattggaaatacagtgtgatacatgccagaagagagggatgtggatatgcagcatatactaagggctgaagtgaaagagtggatgtgtctgcctaggacaatgagggaaggcagagaaaaatgatatttgtgctgagcatttaraagcaggtggaagttttccagctggatcaagtagagggactcctcagaacaaagacagcagagtagaaaggagcagcaaatgctgagagtattgaataattaagtatccctagatcacagcaaggaagcagtaggctggcaaaataagcaggcaccctctgagtgctttataatattccaaagtgaggaatttgaacttatgtaaacctggaacaattaagaaggtttaacgtattccaatttctttttcataaagatgactacaaattgcaaaggataaagaagatggaagatgaagactaatctgtagggagattttaagattgctttgaaagagtagttgttagagtggggggccgggggtagtgataccatttatcagartaaagaacataggagtaagagtagatttgtggtaacattcccaggttttaaggataagactataattttggatttgtagggtttaaagatactgttcaggatatccagatggaactatccactagatagtagatataatagagttatatttcataacaaagagttttgatccctttcttaaaaaytcagtacttgcctatggtgccactggtgctgggaagacccacactatgctaggatcagctgatgaacctggagtgatgtatctaacaatgttacacctttacaaatgcatggatgagattaaagaagagaaaatatgtagtactgcagtttcatatctggaggtaagttgggaatttagattaatcaatagttttgggaaatcattgacatgattcatacaaatgattttattatataagagttttccggtgaatatataaaatcattaaaattccttgtcttgaatatttgttatgcatctttttctgttaattttttttttttttactttggcaaaatttcagacttatagagaagttgcaacaatagtacaaagaacttccagatacccttcatacagatcccccatatgttagcattttactgcatttgctttctatgtgtgtgtatacatttctttctttctgagctaggttgcagacttgtaaaaacaggactttttaaaaataactgctaaataggtaccaaaatcaggaaattagcaatgatacaatataattatctgtagatcttagtgagattttgctagttatttcattaataccctttattgtaaaagaaaattgtattcagttgttatatcttagtctccttaatctgtaattttttgtcttttataacactgccataaaaatccttagtttggatttatcatgattagattcagattatgcactgacagtaacacaagcaaagtgatgttcacttcttactgcatcaaaaaaggcttaagccgttgattagtccccatactgggaatgttaactttgatcagttttattatgctgtggtctgtagagtttctccactttgaagatacgttttaccatttataattagtaagtactatgtatgtagacaatgtaaatattccttactcctcaaacttttatctattgttattagtatccactgatgattggtgactgaatcaattactattatgatggtagatgatggtgatttttaaattccatcatttcttgtacatttctttattgactttctactataaggaagagttttccccttattatatcagcctcctgcatttttactttattgaatagattataatccctttctgtaatcattttttgtatgttcaaattgtgtaagatttggctagttgagacttcttcatgttgtctcttgtgtccttttgaaataccccatcattctttgaggccttctaccctcttaatagtcaacaaatggtaactaagtggcagacactctaactttgcattcaaatagtgtttcagawaccagtgcagaaacataaaaaccctgatttcattgcctatttatttctggtgccataaaatttctctcttattaacatcttgtagtttggtccctactgagaatttcttccaaagattgattaaaatcatatatgttgctaaaaatttcttcattagaacttatagataaaaaagaagtaaaactcattttctttggttggttaactatgaaaagaattgttctgaactcaattgggaaaagagggtgccagcattcattattttttccttagatcctttttataactgggagaattttgaagtttggttattttcacaatttttattttttcttttaatctactttcatattattaatgataaggcagtgtataatatggttttctactcaagctgtgcaccagaattgcctatagaactttttaaaaataggcctaggcctcacacttgggatattttaatttagtaggtctggggtgtggctgaggcatctgtgttttttaaatgctccttggtgagtgtcatacatagaccagcttgagaacaattattctaatttttgatttgttatgattgaagtgggtaaggggaagcaatagtaaagtgactgctgctcatcaaaaagatatgatttaaaaatatttcttcatattatcattttactacttttaagggtttattacattctaatgcctatcattcattgtagagaattgtaccagcaatgaattatcactatgagctacttattagaacacagaaggaaataacacaaaataattttttagagactaaattttgttattttttttcttaaatcttgtcagtaatagttgtaattgtcatttggttagcaagtaataaactttatacctttaataaattcataaaatcgggtcactagtactacatagaaatgtgtgttacttataaaaattactttttaaaaaatggccagagatataaactacagatatgtattcagtatgatgcagtagagtgaagctgtctaggctccagttcctactctgctaatacctttatgaccatggacaaatcatttaacctctcagagtcttagttccctcatcattcaaatgggtctccttttgaaatttattattagtaattatatgtcaaaattaatgtaattgaaggataaccgaaacaaataccacctgtccttggtatgggttttctgtaacatttaagctctaaaatttcaaaagtttggactacttggacattgtgaaataatagatatcttccacagtaagaaccatgccatctccatacaacctgcatttcccagagtttcccagtaccgtgtgttccatacatttcctgaaaataagaaaatgggctgggcgcggtggctcacgcctgtaatcccagcactttgggaggccgaggtgggcggatcacgaggtcagaagatcaagaccatcctggctaacatggtgaaaccctgtctccactaaaaatacaaaaaattagccaggcgtggtggcaggcgccagtagtcccagctactggggaggctgaggcagcagaatggtgagaacccgggaggcggagcttgcagtgagccgagattgcgccactgtactccagcctgggagacagcgagactccgtctcaaaaaaaaagaaaagaagaaaatgcacttcagctatcttacttatctctgtttcaccatagtcatcaaggcaggaattatgagtgaggggatgactccaactttaagtttcaatttcaaacctaggtaatcaaactcytcaattttctggaatgatagaaaattaatggcaacatgagatcgaaggtatgaggtgaataaaagtgaggtgctgcttgtctttaggataaaattctaataactttaaattagcagtgtatgtgtgatgtaatcaccattttttttttttacatcaatgctaaagcagttctttttattttaaggtatataatgaacagattcgtgatctcttagtaaattcagggccacttgctgtccgggaagatacccaaaaaggggtggtcgttcatggacttactttacaccaggtatgtatataaacatctttttccctgttagaatagcaaatgtgactattaagctattttcaccagccatgcacttactttccatcctgtttgagaaaaaaaactaatgaggtacagaatttaaatgattagggtatatttttagtcttattttgttttcttttaaaatagagtgaactttttaaaaacattttttaaattttatttttaaattttaatctacgtatgtatgtatgtatgtatgtatgtatgtatgtatgtatttatttatttatttatttattttgtgaccgggctatgagactggctaatttttgtatttttggtagaaagcgggagttcaccatgttattcaggctggtctcaaactctggggctcaagatctgcctgcctcagcctcccaatgagtgagcttttctttcaaaaatctgcttgaacatttaatgtcatattattctactcaatagactccactcctgagaaactagattttatcttttattcttcatataaacacacacaatactaagcagatgagacaaagttagtatttaataggattgaatttatagaaaacattttcttttacctttaaatctttttgttttttgaacatttattgaaaaatttaaagatatattgctgatttttaaattttgcttctacttaaacttctccagcccaaatcctcagaagaaattttacatttattggataatggaaacaaaaacaggacacaacatcccactgatatgaatgccacatcttctcgttctcatgctgttttccaagtaagaggccactagactatcactcttaaaattggatttaaaataaatgaagctaaattcatgaatcatcattttcatacatgtgaaaaaaatctgtctgtagacttcacttgtcagtactttcctttatagctttgaaaagtttctgtcaccaagagtatttataattgagatgcttaaaacaaaaatacaaaatttctacctttgtaaacatacaggaggataaagttgtagtaataaaagttttgtttttgctgaaaatatttaatctttccaataaataatcttatattcacagtaaaacttatctctataaatctagacttgtagaactaataatttgggaacatactgattcatctttaaaagatttcaccataaggaccatgtaaatagtcgcattccttaaggaagtatgattcagttggcacagtaagtcttaggaatacaattccagaaagagctaaagcataggttaatagctattatttcttatagtttctagtccttttaatacccaaatgataatataaagcttcttttagtattatgccatctgagatacatcttataagaaagaaattgttatagttgaaagaattgatattgaaggcaatcaaaccattcatatagtccctggtcaacaaaaatttcattaatcttttttgttcttaccactaactcttcggttattaatagtcttgagagaaatgtttctctgtgaaactgagatgtctctgaaatatcttagatcctgctttataaaacaatttaataaatgggtttataattaagtaatatcttactttcctcatcttttgtttgccacctaatgtagttcagataatccttacagagtagcttaaaatatttgaataaattatgctttactaggcagttgaaaatgacaagtagactttactgtatagtcatgtgccgcataacgacatttcagtcaacaacagtccacatatacaacagtggtcccataagattacaacagagctgaaaagttcctattcatctagtgatgtcatactcatcataatgtcgtggcgtaacacattactcaaatgtttgtggtgttgttggtgtaaacgaacctgcactgccagtcatatgaaaatatagtacatacaattatgtacagtacatgagacttggtaataaatgactgtgttactggtttatgtatttactttttattgttattttagagtatgctcctacttattaccccaaaagcagtctgctacattctgtttaccaagtctgtggattttatcattttctctcatgtttgatttatgatattttcacaatgaggaaatcacctaacagtgcatttctcagaaagtagctgtgttgttaagtgatgcaagactgtactatcttttttatatatgatattttaattatgaggacatatacaggtttgggggattagaataaatttactcttcagtttggatcaagattcgaattcagcttcccttgaggggcaatctctagatacatacaaggcattctaacgagtagctttggttttttcttaggaacgttatttctataggacctgtgtttctaaccatcacctctgataattccatgtcctggttcaaggggtaccagaatagaaatggaagttttgatcttctatcaagtcaagagttatttttcctctggtacacatatagaaagtcttttcatttttatatttttctcagctatagtgattacttatagtgctcttaaatatcaattagattataccttgttcagttgttttttaaaatgaaaataattttgattttgtgctctattaaagtatatatttcccttttaattttgttaaatcttatcctcatttttttctattttgtaatttcaaaaagatttacttgcgacaacaagacaaaacagcaagtatcaatcaaaatgtccgtattgccaagatgtcactcattgacctggcaggatctgagcgagcaagtacttccggtgctaaggggrcccgatttgtagaaggcacaaatattaatagatcacttttagctcttgggaatgtcatcaatgccttagcagattcaaaggtaggcattatatgtttatttgttaaatagtttgaaatattgaaatagataagaaagatactatttaatatgattttgttttaaaggtctgatatatatcacatttcaagggtatatcagtaatgttaatatatagatcaaagacctcagaaaacctagtgtattaaactgatttttatttcttttttaatttccagttttataatgagaattggttaaatagaaagtaatgaataccagattgatagttaatattttatggtacattctcatcacttattttgaacttggtttttaaagtgatcactacacagcaaacatgttaattaaattggcatgaagacaaactaaccatatttttaaaaactaaattctgttgtttagtattttatatattataaaatagggttaagtattaaagagtgttgatttttttttaaggggggtttaagttataaaatgtcatgaaatcacctaataagataatgtttactagatgcttctgggcatatttaaatatagtttacatataccatatgccagaagtgcttacctagaacacagtgtatttcacaacatagatatttgtaaaaatgacatcctttcaaaaaaattataatatggcaatttaagttaaaccatactcgaaagctttagcttgttaaactgttcgaaaagctcatcattagtcattagaaaaatgcaaatcaaaaccacaatgagataccatctcatgccagttagaatggcgatcattaaaaagtcaggaaacaacagatgctggagaggatgtggagaaataggaacacttttacactgttggtgggagtgtaaattagttgaaccattgtggaagacagtgtggcgattcctcaaggatctagaaccagaaataccatttgacccagccatcccattactgggtatatacgcccaaagaattataaatcattactagaaagacacatgcacacctatgtttattgcagcactattcacagtagcaaagacttgaaaccaacccaaatgcccatcaatgatagactagataaagaaaatgtggcacatatacaccatgcaatactatgcagccatgaaaaaggatgagttcatgtcctttacaggcacatggattaagctagaaaccatcattttcagcaaactaacacaggaacagaaaaccaaacactgcatagcaggttctcactcataagtgggagttgaacaatgagaacacatggacacagggaggggaacattacacgccaggcagggcctgtcagggggtgtgggggctaggggagggatagcattaggagaaatacctaatgtagattacaggttgatgggtgcagcaaaccaccatggcacatgtatacctatgtaagaaacctgcacgttctgcacatgtatcccagaacttaaaatataattaaaaaattaaatttaatttttttaaaaaagctttggcttgttaaactgttcaaaatgttacctttgatttagaataagtatattaaaataattggagcargttttttttttaaaaaaaggcaaattactgaaatcacatgaagattgcaaaagcaagatgtcttttatattctgagttaaaatctcaaacttgtaagcagacagcatgacacagagacggattttgtaaacttaagccattcataagatttttgccatatgaactaatctataattttttaataatgactcctattgagtcatttgtgagtcaatgtttaatatatgtcttgtacatgtaaaatcacttaaaatagcaccagcagtgcatatttcacactgtttgggaaagactgctatggtggaagcacattgctactgagaattgggggaactaggacctatttctggctctttgaactactagctttgtgaccctagtcaaatcatttcactttatgcttagcttcaatttcctgttttgcaatatgaaaggtatacattggataacattaggttgcttttagcttaacattgtaaagaatctgttcttatataaacattctactttctggaaaatttatttgttacttcaaaatcagaaacaaaacttaacaaaatttatttgttacttttacttttttctttttaggtaaaagaaaatcttgaagtattaggttcttttagaacactatagtgatttcaggagaaatgtctgtaacattgtaattataatttatttcatatcgatattagatggttatttaaggagaaaagtagctctaagccatgcagttattattcctctagtatatttgtataggacatctgtttacttttgtgttttaatttttttcaatgattggaaatatttttaaatagacattttcaaatagttttagatttacagaaaagttactaagatgatacagattttgttaaatatgctccacacctggttttccctattgttaattttttatattaatatggtacatatatcacaactaatgaaccaatattaatgtattattttattttgaactaaagttcatacttactcagatgcagatatttttaaatatgatatttgtttcatatattcactgaataatcctgtaagattctttgtcatcacctcaatcaccaattataagtctggataaaattgggtagcgcttaagttcttatagtgaagtgtagggtcaagccctacgggacttggcaggtgtcctccccgtgtgcggagacgagagattgtaataaataaagacacaagacaaagagataaagagaaaacagctgggccccaggggaccactaccatcaagacacggagaccggtagtggccccgaacagctgggcgcgctgatatttattgcatacaagacaagggggcagggtaaggagggtgaatcttctaagtgattgacaaggtgaggcaagtcacgtgatcataggacaggggacccttccctcttaggtagccgataacagagagagagatggcgcatacatccgtgttttcttctgtgcacttataagaaagatcaaagactttaagactttcactatttcttctgttgctgtctactgtgaacttcaaagaggaaccaggagtacaggaggaacatgaaagtggacaaggagcatgaccattgaagcacagcaccacagggaggggtttaggcctccggatgactgcgggcaggcctggataatatccagccttccacaggaagctggtggagcagagtgttccctgactcctccaaggaaaggagactccctttcgcggtcttctaagtaatgggtgtcttcccagacactggcattaccacttgaccaaggagccctcaagcggcgtttgtgccggcataacagaaggctcacctcttgccttctagatcacttctcacaatgtcccttcagcagctgaccccatacccgccggttattcctaggttatattcgtaatgcaacaaagagtaatattaaaagctaatgattaataatgtttataatagtgattgataattgtccatgatcatctctatatctaagttgtattatgactattcttattctagctatttttttcattatactgaaacagtttataccttcagtctcttgcctcggcacctaggtaatcctccccccacagtgaagtgctaaagtggtagcaggtttgcatttaaatgtggaaaatgacataagatctcttttttgtgctttcagagaaagaatcagcatatcccttacagaaatagtaagcttactcgcttgttaaaggattctcttggaggaaactgtcaaactataatgatagctgctgttagtycttcctctgtattctacgatgacacatataacactcttaagtatgctaaccgggcaaaggacattaaatcttctgtaagtctgtttactctgcctttgttgtgaaggtattgtctgcatatgatttttataattgtaatgaaagtattaattcaggttatgtttctacataatgagttaggcagctgagggttasaagggtctttgctaacctgcttagtcgarcattaatttagacggttaaaccataaagcatcttgattatatatatatatataatagatactattattcgatcttttgggtactatggtacttgagtggctttctccctaacctctttgatgtcatggcgtattgtatttggatggcatcttggagtaatcactcaaaacttgaacacatttgttgcagcccaggatgatgctctgctttagctgagaaccaaaactttcacctgaaaatcttggatatgttagttaagctttccaagcctattatttcatctgtaaaataggtataaagcttattttttaaaaagtcttttctacataatttatagtccacattcatgatgttgatgtaccaatctctgtatttctccagaaatataataataataattggttacattagtatttttgccaaagatgtgttgtacttaaaaacatgtatatcaaaatatgtatgtttaaattataatatatcggggttgaaaaaacctagagttaagctgttgtgatgactcctcctcttctccctttcccctctgccactctccttaagtgtctgaagatgagcatgttattgtcatcttaagaaaaatgttcccaggctcattatatarttaattgtaaaaggtcatactatatgggtgtacagaaaggtttgtaacacatgattttcatgtagcccttacactagccccttgaggaatgaattcttagctccactttacagatgagtaacccaaacatcaaacagttcgaattctaagtcaggttaagtgagaagtaggcaaggtctcaatatcaagtatttggatttatatgtttaatatcctctctactataccataaatgtcaaggggcccatactatgataaaaatgttaaaatatagtaagaactcagtgaaaaccaactgaattcctgaaagggtagcatgaaaaactatctctgcattacttagaagtcaaaggagtaagaaagtagggaattttattatattgcaattacatgcttataaataccttttctcaataaagtaatttctttataatttcatttacattattaatgtgctcagcagatcctcttgtcatagattttaaatgtgagcataattatcacaaattctgaattcatggaactcaatgaaaatgcaatgtcatgttattcatgtatttatctctgtgattattatctctctataaacaatcataatttctatctttcaacagttgaagagcaatgttcttaatgtcaataatcatataactcaatatgtaaagatctgtaatgagcagaaggcagaggtatgtctgtttatatttttatgctagtcttgcgcagttcttcatttatagaattttataatcttaattgtccaaaaatttaacatatttttctattaaaattaaaatctrgttaattcagttattttttacagctaaatttggctgtggccatgtaaatgacttcttttgtattttaactagtgatttctctctactagattttattgttaaaagaaaaactaaaagcctatgaagaacagaaagccttcactaatgaaaatgaccaagcaaagttaatgatttcaaaccctcaggaaaaagaaatcgaaaggtaaacattacattaagatctaattttgaggaatttattgttttaaaattttgttaagtattttatgttaattatcatttgttatgtcttttatatgtacatagatatgtatgtttataattttatatatacacacatacatacatacatacataacaggcttgactcagagatattgcagatttagttctccagaccactgcaataaatgaaatatcataataaaatgagtcacacaaatgttttggttttccggtgcatataaaaattatgtttacactacactatagtctattaagtgtgcaatagcattatatctgaaaagataatgccttgctttaattttagacatactttattgctaaaacatgctaatgataatctgaaccttcagcaagtcataatctttttgctggtggaggtcttccctcaatgtttatggcatctgactagtaagagtaatggttgctgcaagttggagtggctgtgacaatttctgaaaataaggcaacaatgaagtttactgcatagattgactcgtcctttcatgaaagatttatctgtagtgtgtgatgctctttgatagcattttacccacggtagaacttctttaaaaatttgagacaatcttttcaaaccttgccactgctctatcagctatatttatgtcatattctaaatcctttgttatttcaacgtagatagcatctttatagggagtaggtggtaaactttctcaagaaaccattttctttggttatccatagaagcagctcttcatttcttcaagtttaatcatgagattgcagcaattcagtcctgtcttcaggctccacttctaattctagttctctttcatgtccaccacatctgcagttagtttcttcactgaaatcttgaacccctcatagttatccatgaggattggaatctacttcctccaaattcctattaatgttgatattttgacctccttacacatatcacaaatgttcttaatggcatctacaatggcaaattcttttcagatgcttttcaatttattttgcctagatccgtcagagaagcatgatccatgaaagaaagtatctatagcagctatagccctacaaaatgtatttcctaaataagaagacacaaaagtcaaaattgcatgatccatgagctgcagactgggtgttgagttagcagacatgaaaacaacattaatcttctcgtccatctccatgagaactcctgagtgaccaggtgtattgtcagtgagcattagtattttgaaaggaatctttttttctgagcaataggtcttaacagtgggcttaaaattattaagtaaacggatgtgctgtcctctagactttgttgttctatttgtagagcacaagcagagttaaatttagcatatttcataagggccctaggatgtttgtaaatggtaaatgaacatcgacttcaacttaaagtcaccagctgcaaaagcccctgacaagagagtcagcctgttctttaaagctttgaaagtaggtatttacttctctctagatatgaaggtcctagatggcatattgttccaattaaaagctgatttgtctatcttgaaaatctgttgtttagtgtagccaccttcatcagtgatcttacctaaattttctcgataacttgctgcagcttctacatcagcacttgctgcttcacctagacttttatgttctagagaaggctttttttcttacacttttaaactttatgaaccaacacctgctagtttcagaattttcctctgcaacttcctcacctctctcagcctttgtagaattgaacagatttagaaggcttgctctggataaggctttgacttaaagaaatgtgatagctagtttaatctatccagaccattgaaactttttccatatcagcaataaggctgtttcactttcttagtgtgtgtgttcactggagtagcacttttaatttccttcaagaatttttcctttgcattcacaacttggctaaatgttttgtgcaagagacctagcttttcgcctatcttggctttctacaagccttccttagaagcttagtaatttccagcttttgatttaaaatgatagacatgcaactaactctttcacttgaacacttggaggccattttagggttattaatttgcccgatttcaacgtgtttcaaggaatagggagggctgaggagaggtagggaaacagccagtcagtggagccgtcagagcacacacaacacttgattaagtttactgtcttatatgggcacaatttgtgacactctaaagcaattacaatggtaacatcaaagatcattggtcacaaatcaccatgacagatatgtaataatgaaaaagtttacaatatttcaagaattgccaaaatgtgacactgaatgctcatgctgtaggaaaaatgatgcttatagacttgctcacagcaagattgccacaaaccttcagtttgtttaaaaaaaaaaaaaaaaaacagtgtctgcaaagcacaataaaacaaggtatgcctgtatatatattctcaactgaattcaagaagtcagtgatttctctttatatttcacactttgtagatcaagtaattttagtttttattttacatatattgaagagaaccagaacttaggtataagatagtggagacaaagccagttatgtcaccctgtagacttagtttaattttagtggcgctcatattgttcttttctgacataatcattatttgtatatttcatgtaaatctactctattcttcattttattaactctctatagcttaactaatctacttattgagcctgaatgggtaattatttgaatgaacatctgtcagtgatataaaccaatacagaattttgagaggtttctactaagcttcttagcaggtaaatttttaaaaagaaagcagttagtaatacagtatgcaaaagtactttttcctcaagcagctaagacagttttccaaattgacccattgagacactggatcaagatgttaatcttgagtacttctaggaggacaataaggaattcctgtattaaacaagtttggaaattactccataaggaatctaggaaacttccaaagtacatcagcttattaaagggaaaacctgtagtaaaggaatctgttcaactttcattaaaattgagtaaaggtaaacttatttgacattctgcagagccagttatctgttattagtatgagaaaccaactacaacttaaaccaatggttattcatactgttttggagctctagaattagtagaaagtgtctcagtatctataaggaaaacaagattatagtcaaaagtggctttcagacctgattcagctataattttttaaaattgcatttgtgtgttgaagttttacataaaatattttacagtatttcttaagaaataagtaaaaatgatttctggtttttcatctcatcaaagaaaacttttaactctgatatagtattattagttgttgttgttatttcattttgttagttaaatgtgggagcggtcctcatgtaattggatatctattagaattctccagcttctcaaatttagagtaactgattccataaaattgctcagcactgcttaaccaagtctactataccaattaaaaccttacagattagtaaacttttctggagttgatggctttaaataattgaacctttctttctggtaaggccctcctctcaggagggaagggcctgagctatgaaataagtatttatttggatgtttttcatatttcmacctgacttttgaccaacaataaaagctttgattttaattctggcaatatgttaagtaacttacttgtatttatgaagaagttaatgataaaaattatgtaccaaataacttttgttatttcccctaaaaattactgccttttgaaataaatgtatgaaatatcttttattttatccatcatactgttacatgggacttttttaatgccatgaattttcaaagtgtcttttgttataaaacttaaataacatttttatgaagtttaaacagataaaaggaagaatctgcagtattttctgtctatcagagctatttggaaaggtaattctcaaaaggaaatcataaaaagaaaacacaattgttcttttataaagagtaattataaaacttcacttatgactataccaagaaaattgtggagtttaatactcatgtattacctaaaaatattggtgcagatacttttaacttgaatgtttgcttagaactctttcagttttaaaacgatagctttttttggtgttgttaaggagctctctagaaacctttgataccaattcccttcctttcatcctaatcagtgaacaccaccacctaaaataagtctagatcacaaaattgacaaatattaactttgtccttgaataaaaagttatagaaaaactaagaaattatctctttaagtataacctaaagataacttatcaattcatttactggcattaccgttggtgtaatataatgcaatgaaatcacagtgtctgtacatatttcctatgaaatatttatcagtttgacaaaactgcagtaaagtcagtgttttgtggcttatattcattcccaatagagtttcattaagarctactgacgtaaattggcagtgtttttaccgctgatccttatgagtatatctaaaattctggccagtttagaacattttttttaaatgcatgtacttgattttactttattttaaagtcttcactgttatgaatgtttatactgttactgtagctcagagctgatctatgacttaaaaccatgaatatattttaaaaaattaaaatattactgtgaccagtgttctactgacccagaaggatacaggattgcaggttccatccagagttttcataaaatttaatcagcttgaagtctgtggccatttggaaatatgaatcaaactcctcatctttgatattctagacctacattgcccttaggaggaagcacactgcagcagcttttctaggtttaccacattataaacttggatgttttaagtcctggaagtgtcagttgattcttagccaggctgtagggggtacctaaccgtatggtctgttttcactataacaaattctgaagctaaaaactggctctgtcactttccctagggggccatggaggcaccatatgattatgcctcctactgcttattccttcacggtgagccaacaccgtaacaacacataatgctgtgttgctaatagggccttgtgaatttggatagtgcatgcccaggttatcatccttttccaacaaacaaaaattattttatttttgctaagcaataggattacatatagatgtaagcatagacaaaatgcagtatgttagcaataccagacaccttatgatgcccatatctttcagyaacatgatcttccttgggtgagaaagaaacctaatgtagtataagtaaagttaataactttttctaaacattttttataataggaaatagtcatttttacctatttgctgtttatcattgagtgtagttctgtgaattacatatattcctttgtttatgcatttctcttaagtaaactttgtatgatttgctacaaaattagtgagattctgtaatgtgttttaattttggtaggtttcaagaaatcctgaactgcttgttccagaatcgagaagaaattagacaagaatatctgaagttggaaatgttacttaaagaaaatgaacttaaatcattctaccaacarcagtgccataaacaaatagaaatgatgtgttctgaagacaaagtagaaaaggtaattaacaattttataattaaattttagaaagtataaaaacatgggggcttttttttttttttttttttcagaaggagtctcttcttctgttgcccaagctggagtgcagtggcacaacctcagctcactgcaacctctgccttccggattcaagcaattctcctgcctcagcctcccagctagctggtattacaagcgtgcaccactacgcccagctaatttttgtatttttagtagagatgatgtttcacaatgttggccatgctagtcttgaactcctgacttcaggtgatccatccgcctcagcctcccaaagtgctgggattacaggctgagccactgtgcccggcctggtggcggtggttctaactctggaaattttatagtcaaggctacttactcacccattctttacagacatctggaaatgttggagaaaatgtagcaaacattttttaaaatacatagttaagtgcacaagaaagaaattttaattcctggatgtcagtaacaaaaaggaaataaacaaaaacaacagaatctcagttacaactgttgtttttctgggcattttatggaacttttaacacgaagtttacccactcaggttagccagttactaaaggtagagcaatagaagcagtctatcctggatgcaggcagtagcttacaacttagaccaacaggagatttttgttgtcagagaagaattttatcactgaaattgttagatgtgccagggcaggggcctaatgaaaagcagaccaaacatttaatcagttttactattttttttaatacaataatatactgccctctcccttccaaacacagaccactcccactcttctaactttgattacatcactacttagataagagacccaaaggagacggtgagttagaaatgagagctcctatctaaagcctgaaatttcagtggcctatatcctttatactaggggtataccaggaaaaaaaaaattcttgccaaccatcactgttggcaaggatggttgcttttcttaccccaagtaaccatgcctggggtaagaaaaaaaagtcatttgaacactaccattataggcttgcttttcacaatgattgaggtttaaattgttacaacccatgtattttgtatagaaaacccctaaagttggtcaattacaatgcacattatcaaaccaatgataccactagaaaacctggcagaagcaatgcaaaaatcagcctcttaagagaaacagattctcaactctagccactaataaattcaactttcaaaattacaaaacagatggagaaataattcactctagacaagattcagtactcttagcaaatatgacagaactcccaaatctttagatactagagcaatctaatagaaaatataagaatgaacaaagataaaggaatcaaagataaagacaccacaaaaaaagaactttcaaatatgaggtaaaaaacacatgaaacttccagaaattaaaaatttattcattaaaattaaaaactcaccttattgatacaatatcagaaaatgttaaagcactttacatatattgactctttttaattctcagaaaaccccatgaaatatttagtaatattatcctaataatcaatgaggaaaccaaaatacaagtcattttgtccaaggtgacacagctcctaggtgctgagttctgatttgatctgyagcatgccagatctagagcctgtgctcttatgtttatgcttttttacatgagctgggagacagatttgagaaaattacaccaaatgcaggataaagataacacatgtggacaagatgttgtataaaggatagacttcatgtaacaagaagaaaagtcatacatgcatctaataggcatttcagaaggagatatttagtgaaaaagagcaatatgcaaaaatttgtggttgagaattatctaggactaataagatgtaaattcaagaagcatgagttctaagcagtataagataaatatatacctaaacgtgtgaaactacggagcaccaaagatcagaaaaataaatattttgaaaatactgacaattctccccagtttcgatattcattggtgatgagtttatttgtatttttatgtattttatgtaatttaattacatagacatatgatgttcaaatactacttattaaaaagctttatcttataagtaacaacccattcctctcaaactaccaccccaaacatgttttcttcttttcctactttcacagaagtaataattatatagaaaaattttgcatttcttaatgtccagaagctgtcagattttaaagagtgcttttcaaagctaacattttagatttttgttagcctatgaaatgggaaagatacgctgtaccggaaattaatcataaagcattcagtaatgtatcattgataccagtttgtcagtagctattaaacwatattatcaaaattagtaatatatttattgagtgtgtgctttttatgccttaatgaaatkttcttttcaattttgtgttttgagatgcatttaagatgttccttgcattcttttaaggcagaaaggaaacaatttatttcttcgaatttatatcttgctgctatatttgtactttcactttcatgaacttcaaattgttgccaatattctttgataaatgtaatgacttccaaataactatctcattggattaatttatcaatttgttgttgtgaacttctttcatatggttgctgaacagaattctggaatagtaccatattatataagaattatatattttatttcaaatttttaagatgtttttcttcttttctttattttttatgtttattttattttatttttggagataaggtctcactccacaactcacacaaacctcccaagtagctcagactcccaagtagctgagactacaggtgtccaccaccatgcctggtttatttcaattattagcacttatattacatagtaatcttcagtgggtaataattcttctcagttttgtgtagattatataagtgtcaattatttgaatgtgcagttatctaagatttactttttgacaaaaggcaagaaatgcagccataggaagctgatattgacttaacatctcaactttaacgaaactcttattgaacacttgtttacatgtaaaacccttgtgcttgacacaatggaggtaaagaaagagaagtgtttgtccttcaattatttacatactagttggagcaataaaaataataaaaatgataaggcactatatgcttgtcatataaatagtaataataaaaacagctgatattgaacgctatttgccagacatttttcaaagttttttgcatggattaattaatttagtatttataacaagcctatgagatagatctaatattatcaccatttgtgaggaacagaggcactgagaactcaagtaggttgtctggagttacttacctaattaatgtggctgaaccaatattaaaccccagctgtctggcttcagagcctgcactcttaatcactctgctatattctaagtaccgtgaatgctatagctattcagaaaagtaagcagtgacttcctatttttagtaagaaggcttcctggtggaaagatgagatttgtactgggccttgcatttctatacatattgtccaacaaatgtgacttgctctgctgagtttgaccagagcaggtcacatttgttggacaatacgtgtagaaatgcataactatactcaaaacttcgtgccaattcccactcccttacccacagcaaatttcactgatctgtggccataccttctctcagaatttgaaagtagccagaaccacaatgaatggactggagttggcacatgatgttaarcatatttgccatgttaggaattattaacaatagatwgggaaggtaggatattggtatagattgtgaaattgttggttgctaggagtctaaaatctatttttgtagccaaaatgcagtctttcaagcaagggagtagcattatcaaaactttgagttccattttttaaacacttgaatattattatttagtataattaatgagcttggactatgtaatcccaaagtaatttagataattgttattttactgtcttaattcctccattgaattttgaatgtggttatctagaaagattaagacatagartaatagaatgggtttgactggttttatggttttgttttttttttttctgttttcatccttatttttctgcacagtagcttagacttttttcaacccaattgccttttctgatctcttacttttggtcatttcaatcctcaggttcccaattatcatagctattcttatgagactaggtaagcagtggagataaaaactcttgagttattgggtgtagttaacccactgaaaaacataggaagacatctagaggttgattcgttttgtttttacacagaagtgtcaaactgtagtatgagtaaactgcttttctaaggcaaggaattttatgttttggattctctccaatagaggtttgttatcagaagtgctgaaagaatctcataacatcgattcagctataaatagttctggagtatggattttgaaattastattaaagggaagctcctgggtaatttcatgaccccataaaaataatctgtaagattgtttttaatgtaaaaatatgaatttaccatattagcaattattttacacaaagcagtagtaacaactaaaattgtagaattatgtttgttctctcgcaagacttttgtggtgtgcaggggattttgttaatgaaatatgtaaagcttttttaaaacttaatgggaaacatttcactctaatgtcagggtttaacatgcatattttagaatgtattcccaaacacttacttgccattttagagcaatgggtggtggtagtattctgatggaaaatgtcctctgagaaccatcacagaggatacatttgatggacattagaagtaaaaagtcataaatggactttttgaggtttcatttaggattttctgatattaaatattgctgccaccagacccacatgccctggtttctaagagtccctacgactgtaaatgctaaagcaaaataaagatgatttaattagctgcctgccttcagttaggtacaatattttcatcttcatttttcagacgaagtaactgaagacccactaaaatctgtttgcctaaatttttacatctgctgaatagcagagaaaagtcaataggtcacacctcccaccttctgttatagcagtggctctaaacttcaagtttcaggacccctttctgcttttaaaaattatttaggacttcaaagagcttttgtttatatgtattccctctaccaatatttctatattagaaattaaaacagatttataaaaatatatttatgcattgattcattttaaaataaataatattaaataatagcttaattgtaaataataaaaattatattaataaaatataataaatagcaataaattataaataattaaatgttaaataataattaaaataaaaattatgtgtggttacataaataattttattttctcaaaaatagtgaaaatagaagagtggcrttgttttacatgtttgcaaatttctttaatgcctggcttttcatatcagctctattctcataactgctgaattgttattctgttgtgatgttacacatcatttagcctctagaaaactactgtgcaactaactgtatgagcaaacaagaattttaaaagactaataacattttcctgatattataaaaatggttttgatagttttaaccttgtgaactctctgaaaggatctcaggaatccttaggggtccctgtaccatgcttgggtaacctttgcatgatagcattctttttttagtttttgctgtcagggtctcactttgttgcctaggctagagtgcagtggcacaatcatgcagtcatggctcactgcactgcagcctcaacctcccggactcaagtgatgctcccacatcagcccctccaccccaccaagtagctggaactacaggcacatgccacgaaaccagcctaaatttattttttaatttttgtgtggagacacggtctctctatgttgtccaggatggtcttgcacttctggcctcaagcagtcctcctgcctcagcctcccaaagtgctagaattactggcatgagccaccatcccagcctgcattgtagcattctgtcacaattctcatcctagcgctgtggtcagtttgatgggttacattttgttttgttttctcttcttgactatccaggtttttgtttctttgagacatttgttttgtttttgttactgtcttactgtgacagacagagactaggatattataattaaccagagaagccataaaaaagagtcaggaaccttagtgagaatgacggtggctatcaactatttttcccttatctatgactctagcctgaaatggaatctgcttctctctgactcttgtatttcccttgaggggaaggtaagtaaaattttatgaatatctaagatttggttatgacttcatgatagccacctttgcctgaccttaaatcatttataagctcatatcctctatccagatgaagataaccatatttttctattatatgcccaagtctcaatagtacatcttttgtcaaaattaagagatatttatctcccaaagagggggagttcttcgaccaaattcaaatctagtttctgctcttcttttttttgatttcctgcttccagaaccagctgcaaatgcttattttaacctttggggatccactgtttcaggtctacccatcctatctgataattattgactttagtgtctgtgggcaaataccccagagacgtcaagatgttctggcccattgttttcatgatagtgtgcaagacccttagggtaagaaatcaaagactaattttaatttcaatttgtgcctaggtaaaacaccaaaaatattttgaatactcattatggctcctgaaccaagctacaggcaagatcagatactgataagcactctgatataagctcttttttctgtgatttatatcagccaatttgaggccttataggcaaacacagaacaatagaacacattatttcttcacatcaaagacaagagcaatatatgcatctgctttgattttgagtaaggagatcatggaatgtatctgaccttgtatgaacttttcaaatgaaacatactgaagggactgtactttaacgccaaaaaaaaaaaaagttatagtctttgatttggtcgttgtatttcttaaagccataaactctcaacctgtaattttataaaaatgactcacagctcaatttcctattttcttgcaagcagtagtattctgagatttcaagggggaaatagctttaaatacaaaaatgtagcctaacttaatttactacaatagtacacataagaaaatatactagtttactaatatcatgtacatcaaatatcataaaaattagatttactgttaaatgaatcgtgtttcaggccactggaaaacgagatcatagacttgcaatgttgaaaactcgtcgctcctacctggagaaaaggagggaggaggaattgaagcaatttgatgagaatactaattggctccatcgtgtcgaaaaagaaatgggactcttaagtcaaaacggtcatattccaaaggtacaaatatctctgtatgttcagatttaatttgtaggaactgagctcctaaaatgtgttctttttcttattgagtaaatgtctttcataagacaactattattgcctcataactctgagatttmatttacttttaaatgttatttctaagtgattgcatccttttataaggtagcttttaggttaaaataaacaattctatttcaacctgcacttgaggattcattatgtaggtaatttgtttgaaatcttgatattttatgcaaaaatagtttaaatgaggtcaacattaaatgtgttatggttaaagaaagttgatttgaaagggggtgtgtgtgtgtaactgaagatattccaccttagaatggcaaaaggttttatttttgaagtgtagtgatgggtaatgacagtatcatattagaattatgttctgctacaaggttgcagtagtctaactttagtgccttaactagtgtgggctgtcttttgttctcttaacrataagtcttggaagtatgcagttcatttctaatgcagtacctttaaaatgtcattatcgtgcttgtcgtttcatgattgtaatattactgtttcatatctagtctcaagtttacacacctaagccagaagaagaggaaagaaaggaggagggatgtctatatcaggagagcaaagatgtttccaaaaattcctaacagactaatgtattggctagaaatatgtcacatggctatctgtagatagaagacactctgaaaagattgtctttttttttttttgcataattactctgaacagtattggagctcccttttttttttttttaactttaagttctgggatacatatgcagaatgtgcaggtttgttacataggtatagatgtgctgtggtggtttgctgcacctatcaactcgtcatctatgttttaagcccggcatgcattaggtatttgtcctaatgctctccctycccttgccccctacccctgacagcctctggcatgtgatgttcccctccctgtgtccatgtgttctcattgttcaactcccacttgtgagtgagaacgtgcagtgtttagttttctgttcctgtgttagtttgctgagaatgatggcttccagcttcatccatgtccctgcaaaggacgtgaactcattcttttttatggctgcatagtattgcatggtatatatgtgcaatataccttttctttatccagcctatcattgatgggcatttgggttggtttcaagtctttgctattgtaaatagcactgcaataaacatatgtgtgcatgtgtctttatagtagaataatttataatcctttgagtatatacccagtaatgggattggagatctcttaataagaaagaagaagaaagtaaatgtgggctaagcaactaggagcaactgctatgaaataactaattttcacccaaatacttaatagtttaaaagaacaacttcttttcagtctttttctaaaagaaaaaatatctacagtctctactttggtgatgctcttctgaaattctataactctgtatcagctaattgatatggaaacttctaaaatctttgaattcctagaaaggcaccagacagaaaatacaggtgaaggaaaatatgaaatatttaccaacaaatgccagagatctttaaatgttcaaaagtactaatttttttataattcaaagatactagtcaatgcattatgactggggaatggattctctgatgggctagcaatggctgtaaatgattattctgttaatatggaagctcagacatgactggagagaaaagactagcagtagtagttaatgatgacagttcaaagtagtgaaaggagcaagcagcagatatcctgtttcctaagaaggaaaccaaagacagtatttccttattgtggatatttattgagccaacaatttaatctgcacctcaaaatatcttgataaaagcataccagtcagttagttaagtagattaggacattaaacatagaatacagcacattctagtaatattttgcaataatataacttagtttgtaaggcactttaaaatattccccacaaaaataatgtaaacattgggaaaaggatagactttggagttggagtgtttggtaattctggcatatagtagttgttttgaataacaactctaacaataattatatgactttggacagtgtgtttaacattgatgtcttaatttgtcatctgtaaatgtatttaagatattatgagcttaagtggagtgctacattcaaaacctagcaacacttaacaaataataatggatgataaataatagtttaatactattctaagcaacaatagcatagacatcaatatccaagcaagttgtacaaagaaaagtgtacatagttaacaacagagttaactgcatcatataatataatataatataatataatataatttctcttccagaacaatgattctgacctttttgggggtcatagatgcctttgagaatctgttcaaagctgtgtagattttcttccagctgggagattggggaggtcaaatttatacaattttgcatatttcctaagtcattgggtttcctaaagcccttccattgacacaagattaagaatatctacttcagaaggaaactatagcacgttttttttaaacgttgtgtccatcttaagatgatataatgactcaaaaggagtaagcaaaaaaagacaagattcattaataaactataatataagttagctaggatcagaggatataacttctgaaattccatataaagccatagaggctcatcatagaatgcaacaggctctatcacagtgcctgtaggaatactgaaatatggttatgttgttgataaaatcacttcaaagaaaacagctggataaccctggccaaatgagtgtttctcatttaatacacaagagttgattctcttggattggtagcaggtgtggaatgttgacagtacttttcagtttatttcacttattatttaatagtttatttggagactgtatatctaaagcagtcatattctcaagattatcattttctaaactacataaaactaagtcttttggttagtattaaactttgacctcatttaaaattaactactgaagcttccttaatttgtttgtttacttatggctgtgatattctcatagattatttaccccttatagttggcaaaaattttctcaagaagagtcttgaaacaattttttgtgtgtagtaaaatataaaataaaatttaccatcttaaccatgtgtacatatacagttcagtggcattaagtatattcattaaaaattttaaatatgtttgtgtatataagttttaaatgatattgctagagtattttcacctctcaagatcctaacttaatttacattatgcttgtattatatgtttgtccatgtaatcagcattccaactacagaagtactaagaacttatgaagtattaagcaggcaaaaaagtcgattgtagaaatttactagtttgccttttctatcccacattaccgtaagcttccaattttaaaaatggtatggtattgtttctgatatcattattatcgctattttgtgtttgcttttttgtctacttagtagtgtttatgaagttaatcaatattgtctggatttttaataaattaaaactttttcaatatggtcaaatctaatttttctagcaatctgtcttctagatttctcttacgaagaacttttgtacacctgaatgtgaacctggaattgatttttgtatctttgatttttatgcattttatcacaaataacttgagcaaataaaattaaaaccattttcattgccatcacccaaatctaaccctcaattcttttttgtgcagatatttatagctgaaaaaatagctgagaaaattatctagttataagccattattttttacataagcaaattgagacataactttacgataaagggacttatccaaggtcacacaactctggacagatacccagaacttctgactttcaaattggtgctgttttctctgtactctcctgcattatttactcttcaatattctgaatctatccacttctctttatgcccctctgctgctatcctaatgcagactcctatgccccattattggactgctacgtttggtccttctgctttcgttcatgttctactgcaattcattctctccactgcaaccaaagcragtttttaaaacgcaaaactgatcttgttgttcttcactgccttctccctagaataaattctccattgtgatttaccaagcctagcatggtctggcacctgaatacttctcaaggcttgtatatcacctttcattatactctatactttagccattactggcctacttatagttctcaaaataagccatgttcttccaatcagatttagtcattagtatgtcaagaaagacttaaattgtaaacttgattttccaaagttaacaggctagccaaagacccattattactaatacaattatacaatcaagtcttgtctctttaaaagaatgactcaagaagataaaggaataagattatcagaggatgtatataaaggagggattgttttttctttatactttaagttttagggtacatgagcacaacatgtaggtttgttacataggtatacatgtaccatattggtttgctgcacccatcaattcatcatttacattaggtatttctcctaatgctataaggagagatttttttaaaggaaaaaagatgcaatatgtggcaaacatgttcacactattatgatcatccaattttctaactagtaatagaaagaactgaagagatcatctgatccagctcttaaattttagtcaagtaaactgatctccataaagggcatatatttggcttaaggtgacatttgtttcaaggctaagcccgtctctaaaatcacatgactctagccgtatcgtcctgcctccataaagataaatttttttctaaaacatttgctatatttcttgaagtataatgaattatataaataactcctaactttaatatataaatatactatatttcttgaagtataatgaattatataaataactcctaaatttaatatatcctaactttaatatatataaataactcctaactttaatatataaataggatgagtgacattgttctctgtcatagtctcaataactggcattggaagtactttctaaaaaggagaaaaataactttgacattttagaaaattattggtcaactgcagattggaaaggagttttattaaatttgatttattaaaattattttattaaaattgatttaatcttaatattctttaaaagaatctgaagaatactttgcattgtttccactcgctaaagctaagatggattatgagaattgtccctaggaggaagtttccagtttccaggcatagctcccctgcatatggggttcctgtcttagccattcaaaatgtccaaagaatttaaatttttttcattgtattgtttgaaatttttccaataaaatttctgagaatgttactagattatcaccatttatactttggtgtaatcccttcgctgatatattctgtagataaggtttagtaggtttaaggaaagacaagtaactttaggtggtagattacaggacacctggccctagacagatgaggcttaggaaaatggagcctgcaaaaaaacattttcacacttttgcctaggatggagctaatatcaagagtgggtctcaagtcttgtctctttaaaagaagaaagattcaagaagataaaggagattatgagaggatgtatataaaggatatttttcttttaaaggagaacagacgtaatatttggcaaacatgttcacactattaggatcatttaattttctaactggaaaggactgaagagatcatctgatccagctcttaaattttagtccagtaaactgatctccataaaggctgtatattcaacttaaggtagcatttgtttcaaggccttataagcccatctctaaaatcacatgactcataggccagtgctctaaccatgtcatccaaccaaaggtgatatcaaccatatgatcttttgtttcatgcaaaaacagaaatttttattgcacacaactcaagactttgtacactggggctttaacactgaactaacctgactcggtgcctgtcctggtggtaaactatatgttctggtgtgaacagagaaattataaataaatgaatacatcaatgaaattgttactcatcaatagagtaaatgctatgacaatattgaggggtggagagtgtctatccaaatacaatgctcaaggaaagcctttctgaggaagtgacatttaagcaaaaactggtcatatttatgtatttttacaacattgtgaacaagttggatagaccaagaagctgtcatcatagtaaaatttcttctgaattcctaacattcagtttctgaggaaacatgaaaacttatcttgcttgtaaattatagaccaccttttccagaactcttatttttcaaattgtttctaaacatattatttaatatctaaaaagaattaaaactattggcaacaatataaaattattaaactgatttaatttcaatattcttagagtgatctgaagtacattttgtattgtttgccctaggaactcaagaaagatcttcattgtcaccatttgcacctccagaacaaagatttgaaagcacaaattagacatatgatggatctagcttgtcttcaggaacagcaacacaggcagactgaagcgtgagtacatacatttacctattttccaattttaacactatatctgaagcacagaagttcaattttccactgccagaaagttgagttttatgtgttacaggatacattatttttaagtgtctgtctgaaccagaaaacattaagagagttatttccttccaacaaagtttttacattggtttataaatttgaaagtgtttttctttaaaagtatgttacttttacttaatatatgctatgtaatacaaaatttcataagtacctacacacattgaaaagaaatctgccttctacctctatcttctagccatccatttctccacttagaagcaattgctgttaacatcacttgaatttttaagtaggcaattgttaattattcataattccagaattttttgctgtcattacagtgaagttgctaaatatcaggtgtcctgatttttatgtgatgctataacagaccttttatgttctctcttctagctcagtagtaacattagtcatttagtttttaaaacataataataaaaagtatggcttaatcttttttttgtcacattggatacgtcagtcaactccttaggcatcactttgatgttccatgcaaatgggatatttatttctctaagtgctttctgctactctaagaatctattcatgttctactggtatgctcaaataactgataattatcttgatttagaggaaatcatattagtatagctttttttaaaaaagaaaaatgaaaaacttcagggagttactcttatgtggatggaagttcagactaatctctttatactttctgtgtctattcctagagcagatattgaatattcatttactaacactcaaaccacttacaagagctgaagtcatcaagaaacaataatttcttttaaccatattacatttgctatatcagaccccagatgaatatactatcttaagataaacatttaccttaaaatggggggaaaaagactaactcaacaatttagaaaactggtgaaccagaggatcacagaggaaatgtagcatagaagaaagaggatgagttttggaatcaatcttgaattctagcttatatgagcaatataaccttacgctgattatttagctttgctaagctatagttttcttatataaaaatagattataatacagttcatataaaggttatgaatagattataatacatttcatataaagtttttgaaaagattaaacataaaaataaataacatgatataattcctgtgttataggtgcctaggactactttcaggttcagtgattcattaggaggactcacaggactcatcagatagttgtattcttagctgtgctttatttcagcaagaggctacaaagcacattcggcaaagggaaaaggtacagggcgcaaagtctgcaggaaccctgacacagagtttcaagagtcttcctccagtggaatcacacagaatgtgcacaattcctccagcaaaaagttgtggcagcacatgtgaaatgttstctgctttggaagctcttttgagttccatgtcccaggtttttattgggagctggttgcataggcactttctgccaggatgtatcaaaattccagacttttcaaaaggagagaaggtgttttagcataaaccacattgtttgtgcaaacagtttaagcacagtgagccactcttgtcatatgagttctggaaatgctgggaaccctcctaaaatccatattttaaaataccagccaggtatcaaccttataaccaagcctttcttagcagtgtcagacctactatgataactttcctgcacagtacctgattagtgtagatgctaaataagtaattgtttaaatgactttgattaataactttttcttgtacttgttacctacttgacttaaatgcagcaccctccagccacccccaccaaaaggaaaaaggtcacaatttcttgtgctgctattgaaatatttaagacttgtaggttaaaaggtggtatttctttgtgtatgaaagtgaatgcccgattagtcttttcccactaccctatccatacttctaatggttctcttctcctcgatgttatgagtcaactggaacatcatctattgatggactcaggattccaggactgaatcatttcaagatcattcatgttgttagacatatttctttatagaaaatttgggaaccactgattgagtgtataaatttataactgtttagctgtgacatttcttcaatgaacacttacacagaggtctgatacacaaaaaattacattcggtgctgctgtaattgttgctaataagggagattttgagttaaagccgtgaatccagtgccctaacgattatttatactccccatccttatccacaacttttctccttaaaatccctttaagtgccattccaaaagccatttctttaggtcatttaacttaaaggagaggtaggttttgttattttgttatgtgtttgtgtgtgtgtgtgtgttttaatgttgtatacctaaaatatgtctcatcatttcacatagtatattaatttttcatttcaattttatgataattagtagcagtaacaacatctgtagtttggaaatcacattatgttttgcaaaaagcttttatgtacatttaattcatttagctagggacagtggctcatccctgtaatcccagcactttgggaggtggaggcaagaagatctcttgaggctargtgtttgagaccaacctggacaacatagcaagaccccatctctaccaaaaaataaaaaaattagtcagtgtagtggcacacatctgtggtcccagcaacttgggagcctaaggtgggaggatcaagtgaggccaggagttcgaggctgcaatgagatgatcatgccactacactccagcctgggccacagagtgagaccctgtctctaaaaaataaataaacaaatatacttaactcatttagtcctcaaagcaatctcctattataagtagtggctatttatctgtccctcacattacagaggaaaaacttcagtttttgccttgtccaaggtcatatggaagcaagtgaagacaatctgagactagaactcagttcatacatgggaaattattttaatgatatgctaatgctttgggtgttacataaaagaactaaaataatgtgtttaaaatgtcatatttatctctcctttcttctcatcttctgtatatagagtattgaatgctttacttccaaccctaagaaaacaatattgcacattaaaagaagccggcctgtcaaatgctgcttttgaatctgacttcaaagagatcgaacatttggtagagaggaaaaaagtggtagtttgggctgaccaaactgccgaacaaccaaagcaaaacgatctaccagggatttctgttcttatgacctttccacaacttggaccagttcagcctattccttgttgtaagtataactttcgttttaagtaaatagtaacattatttctaaagagaacctttgtatatcaatctatagaacagttaattttaataggtttgtctattttatgaaaattaatgggaaaattagctttatagtcatttcaattaaccagtatcttccaaagatctagaacaagtatgcattgatgttctatataactctagcagtaaaattcattttacaactcttttcttttttttttttttttttttttttttttttttggtgacagggtctcaccctgttgcccagcctggagtccagtggtgcaatcaaagcttgctgcagcctccacctcctgggctctagcaatccttccacttcagccccacaagtagctaggaattacaggcatgcaccaccactcctggctttttttttttttttttttttttttcctgtagaaacaaagtatcactgttacccaggctgacctcaaactcctgggctcaagcagttgtctcccctggcctcccaaattgctgagattataggcatgagctgctgtgcctaacccattttatctatttttgatggaacaattttgcttcccatccttytttaaaatgtaacctctattaagggcaggaaattataattaatcatatcatattttataataataatctgttcttaagatcaactaacagtgtagagtttactatttttctattgacaaatcacttgatatttctctttctctcataaaagtatgtgtgagacattttaattgcaaagctaacatataatcttagttaagaaaaaaattcagacaatgtagaagaaaagaagtagactgccaccttcaactcttctcagaacctcaattttatgccctatctcagagattaaatgctgttaaatatttatctttgcagtatgtgtgtaatacacatgtattacataaagctttttgttaggtttcacgtgaatgctagcacattacacatagtgacctgcaacttttttgtttagtttattatgtttattggttttatttgtttattatgaacatttttagggtgcatacatgaagaatctacctcatttttttattgtttttgagaatccagagaatagatgtaccataatttaattaaccttttttctattagtgaacagtacatcagagaacacatctgtgtattcacatttgtgcgtgcatagcagaatcctagaagctgatttgccaggttaaaggacatatcattttttttttaatgcatcatgttaaactgcttttcataatttttttctgtacttagtacccatgagagtaactgtttcatctttacctaaaccaaaaatagtaacaasagcaataataatgcatagtcttttttgttttgttttttttgttttgttttgttttgagaccgagtctcgctctatcacccaggctggagtgcagtggcgcgatctctgctcactgcaagctccgtctcctgggttcacaccattctcctgcctcagcctccaaagaagctgggactacaggtgcccgccatcatgcctggctaattttttgcatttttagtagagacagagtttcaccatgttagccaggatggtctcaatctcctgacctcgtgatccatccacctcggcctcccaaagtgctgggattacaggcgtgagccaccgcgcccagctgcatagtcttttaaaatgtgtaactctcagattatcgatgaggccaattcatcccctgtcaggtatcctttgctcattcacactagtggaaatttttgtttatttgttatgggtttgaggggctttttgtttgcttggttttttacttggcacttcgtatctaataactctttgttcatttggtgctgcttttttttatatatatgttgagcaataattgatcaatttattggacttttaacttttatatagtcaaatctgcctatattttccattatggggaattttcttgggatctggtgtttattagcccctcactcccaactagagtccatttccttatgtgagctaaatgtgtgctgggacatttggctcaaatgtgtcccagcacacatttagctcacctaagacaaatagacaaatagttgggagtgaagggctaatatgtaagaccttattcacagagaataatagtctgttgaagtcagattttatgttaagtgttgcccctctgaatacaatctgwcttctggcttattgaaatatttcctcagtctttggcttgtaatagttttattatgttatgcctagttgactttatttttacttctcttaagtgggttcctgactttctgaatttgtttctgcattatcttttgtttgttttggaaaattcttaaccattatctcctcacctattgcttttgtcacttttgctctctcctctacttctgggactccaattatattgcatggcactttcccattgtattgtctatgccctttactcttttgcttttaatgtttttttctcttcctggataattttgtttctcacattcttcagtttactttcttttttcagctttatcaaatgatccttaaatccataaaatttttaatttcagtcgctatatttccaattctggaatttccattttattcttttttatagtttcatatctttgcaaaaattgttattaagcacaaagggtataattatagtcagccatccatattccatgggttctgcatccatggattcaaccaactaatcaaaaaaaaaaaaaacatggatggtttcatctgtactgaacatatagactttttttggtcattattccctgaacaatgcatcataactatttacatagtatatatatatagtattaggtattgtaagtaatctagagattattaaagcatatgggaggattgtataggttgtgtgcaaatgctgtattattttatatataaaggatatgagcatccatgaattttagtatggtcatgcaacctatccctcacagatactgagagacaactataatttaaagtctgtgtctgagaattccaaagtctgtaaccactggatctgtttagactgattttcttgcatgtggtcttaattcctcatatgcatgcaaattttttgtgtgccagtcaggtatttgcaaaattatttgcagaatattttgatgcatctgatcatgatattaaatatctcagagaatatttacagttccttctttcatattctaggtagcattagcaattcagaatcacctcagtcctatttcagagactgaggtaatttgatactaaactgtagtttcctgaggtcctgcctatttctgatttgccctctacagtatagctgttcagagtcccaactcaaagcaaggaagatttacaaagatcctaaattccagttccagcaccctattcccccaaagctcttagcactgttgctatgcttttctgccagctcttccagcataagcaaacaacctcaaggggaaattagctgaaattgcagaaattactttcctgagcctccagcttcctcctgatactcacctgtaatttttcaccatcttattaataatccagtgccttcaaacagatgttttttatattttgtccagacttttagttgccttcagaagaaaggttggtctgagttatctccatctttattattagcagaagttccctatattatacctttacattaagaaaatacggaagttggatagattatcttaaaacatatatattgtatatacacatatgtattctttttcttttaataaagcattagacctgacctagttgtgatctctggaaagcaaaacttaagtttttttcagattctctcatacctttcgggcatgattcattttttataatgtactcaagatgttagaaaggaaataggattttaacaccaagattgagaaatactgaccacctgctatatgatgctcattattccttatttaaaaatctatatttcacatacagtataattgcacagactatacttgtcaacaataaaacaaaagaatttacttgactcttaattccttctcatgatatttttgaaggaaagacttgaagccatgttacattttataattaacgtgttttctcttgaacacatattagaaggtgagttttgtttttataatgttttgttcttggttcgttactttactatttcattcaaatgattttagagatcaactatttatttattatgtattttccatttcatgaattatgtatgttgtatacatgactaatagtgtcaaggaggaataataggaacggtgtttataagtgagttcaagtgccttagggacctttaaaagtatttactagattaactatattctttttacttaaatacacacacatgcagtgcttttaagaatctgggccagggacagtgkcttacgcctgcaatcccagtattttgggagactgacgcaggccgatcgcttgagtcaggagttcaagaccagcctgagcaacagggcgaaaccctgtctctacaaaaaatacaaaacttggcaaggcattgtggcccatgcctgtaatcctagctacttgggaggctgaactgggaggaacacttcagcttgggaagttgaggctgcagtgagccgagattgcaccattgcacttcagcctaggcaacaaagcaagactctgtctcaaaaaaaaaaaaaaaatctgatgagattawctataatgaatatagtctatattgttgggcatttgggttgtttaataaattttcactattattgccaataatgttttagtaagcaaatatgtatatttatctttgtgctcatatctgactatccctacaataaattcttagaagtaaaatttctggctcaagataaatgcccattatgcaaaatttgaaatatatattgccaagtaactctcctccttcaagtgatttaacccccatcaagcagtataaatgaaggagctttttttttttttttagcctcaccagcttttgatgttaaaatatttttaatttctacctttagtaaatcaattacaaacatgtatataagcacaaagaatactatgagtaccatgtgcccaacacctaactttaaaacttatcagctcatgtctagtcttgaaaacccatctgctttcctccaccccagctcttacactagattattttaaagtagatctcggagaacacatggacacaggaaggggaacatcatacactggggcctgttatggggtgggggaaggggggagggatagcattaggaggtatacctaatgttaaatgacaagttaatgggtgcagcacaccaacatggcacatgtatacatatgtaactaacctgcacgttgtgcacatgtaccctaaaacttaaagtataattaaaaaataaataaataataaaattaaaaaaagattaggattcatttagttgtagcttgcaggccaaagctgattcactatctgttttttatgtcccatgtgccaagattttttttttcacatttgtatatgactggaaaaaattagaaaaatattttgtgacacctgataattataaaacattcaaatttcagtgttaataaataaagttttatttcaaaaaacaaaacmaaaaaaagtagatctcagacagcacatcatttcttccatttacatcaagtgtgtataaaagaaaaatgtcatcaaatatctaatgtgtgcaaatttcccccattgtctcataaattatttgtttctatgatttgtttgaattaagatacaaacaaggttcatgcctatgcagtcttttttaatcttggacactctctcccacttttgtctttgctaatttttaggttagtgcagaagtaattgtggttttcatcattgaaagtaatggcaatgcttgttgatactttgccaatagtcataaatactatcttttttccatattcattactaatatagttgagtgtgttttttttaattgaagagtcttttttctgtgaattgcccagccatcctttgacatttttctgatatagtcatctttagtaacaatcgttacttttttacaagatcttaagtgtaggttttttttcattcattcaacagtgtttaacttacagcagtatttcaggcacttgtctgatgatagggatcaaagtatgaaacaaactccaccaccctcaaggagctcacttctagtagagaaagacaataatatagtaaataaattaaacagaatgctaggaggtactacatgctataagaaagaaataaagggagttcaggagtgtggccagggaggagagagattgctattttcagtagcatggtcagggaggatctcactgataaaacttgaaggacttcacaggactagctatatgaatatctgggagaagaaacttttttaggtagagggacacaatcacagtgcaaaatctctaacataggaatttgcctgacatattcaaaggctggtgaggatatataactggtacaaagaaaaagagaatgaaagtagtgaggagatcagagagataaagggaaggaaggcagatcacatagggccttgtaggttactatcaggacttaattagtcttttactctgaataaaacaaggagccatgacatggtctgagcagaaatgtaacatacctcaattgtgctcttaaaagatctctctgactgctgtggtgagaatagattatactatggcaagggctgaaacatgaggaggcactagaataacccaggcaaaagatggaggttattcagaccaggataatagcattggagctggtgagaagtggtcagattctaaaatgttttgaaggtagagccagcaagatttccaagaaaattagatttggaataggagagaaagaaatgcttaagactgaatctaaaattttggaacttagcatctaaaagaattgagtcaccttcagagagataaggaagacttcagatggagcaggtatacagggtggaggttgtagaaaattaggagttcagttctaggcatgttaaatttgtctaagatacatccaagtggagacatcatgtaggcagttaagaatctgaagttcaggagagaagtctaagctaaaacataaattcgagagttgttaacatttagatgatatttaaagccataggacaggatgaaatcactaagggatattaactttttcctgtaatatacatagtataactatacccttcaagatttgccacttattcttgcttttgtttgaggtttcctttttaatgctgaaagttaaaacatttatgtagtaaaatagcttttttctctctcttactgccttcgggatctttcctcaaaaggcctttccattcataagcttttaaatttttgtttccactttctcctaatttatgttggtgttaaatgataggcaagaatctaaatttattttttccaaggagactagcattcttatatagatatattggcaatgcatccttaacagccactgtgttttttgtacagtaagtagtcatatataattctgtttactcaatttctactctattgtttcacctgtttgtctgtcttagggccagtagctattattttaatatgtgatactttatagttttttttatatagtatgctagcccttcttcattattctttgtctgaaaaatattctttgctttgtctaggaaatgaatatcagaataatttccagtttcaaggaaatgaaatttttttaattcataaattgacttcacatatttccaatatcaaatcttcgtactctagaatagtttgtctccctgtatgcatatctttttgtatgttcctcagcaaagtttcagagttttcttcgtaagtgttttataaatttgactgaatagatccctagatacaatattttgtatttttgtgacatagactactttttacttttcttaaattaataagcctaaattcttattttggaagaaactaattttgtaaattttatgaattttaattattttctaataaatagacttgatttttgaatagatatttatttgacgtgaaatctttaccttcaaactacaagtgtattgactaagagtaaaatatgtacctattttggggtctggaaaatagatagcacactcactaagtgtagtgcaagacgggggtgctgacagcaaaatttatttatggaactgataaaatttctgacattaaatgaaaagtcaagatttcctcattatccatctggaaactcacatttggtaatacttctgtctgtaacctttccttttttaaaattttgcacccaatgtcagtgattttatcttaaagtacaataaaagatactaggagaaccagtctcttaacatagtaccaatattctgattgaatatagagttcacacataagtttaagtttcccctaaaattacttgaatacaaggaaatttcatttgaaagataggaaatctctatactaatttctcatataacaaatataaagcaggaaaatgttaataaaccaaatcttccatattttttccatttggcaacaaaatttaatcatgaaacaatggaaatcatgcttgtatccctaaatacattttgtttgacttatcatccccatgtacataagacagtatttagttattcatctatagctgcaaatattactgtgaattaaaaggttctttgtattgtcccttcttttccatctttggtaagtgtaaatactgagaaaatgaaactgagagagaaacatgatatctgctatttcccacagaaaaaatatcaaaaggttatgggttgatttattattcaaagtgctggattaatttaaaggactataatagttccctatgtattaggacaatagttccctatgtattagggaactattatacatccctaaccatgagagtgtctcataagtgtattataaaatgtttattagtttggttaatttagtggtaccttatcttatatttggttaatttaatggtactttatcttataagataagtttacgtatcttataaatagttaaaattcatttacctgtatcatttgcaactatgaattccatgagtcataaggctgttaaaaagaatccagatttatgatgagtacactaattgtatcaatcatttgtagcctagaagtttttattgaaatgtatacattaatatttgatttcactttagaactttgccaactaattttgatttagcacagtttcccagaatttctcctcacgtacatattaacaggagtgcttgcttgcaaaggaagaatccttgccatcgttttgtaccaaacctcaattagatctaatcccattcatcaatgtctccctgtcatgaaccctactttgcagcctatgactcatgtttgctaaataccgcattcttcctttacaataacatacagctctataaatctcttaacgtttacagtcttaaacttttgataaattacttcctctgggtaaaatcattcagaacacatgatatggcacatcaaaagatgaccccaaaagccctgcccatttttaagagagggattttaaacccattagtgataaattatctagtctctttattttatgtaaaggaaccatctgtgaaatatttccaaaagctgaaaaataaatataaagccccctctacttaagaaaccacatgaattgccatttagcaattatgttttagagatttatttaaaacaaagagagaaaaagatgtttcttaatttattttaaaatatttttagaaaatttggcataagaaatgaataatatagtgacatctaaactagttttaatttctcttgtctctttccactgcagtctacacttcacactgccaacaaagtgatcttcctaataaagtgtagacctctcagaagagtcttcaaaggctttccaagtccagtgtcaagctataggcatacttttgtccagcaccttgtatcccaaccttctgttatcatgatttctgtttctggcctctgcaatttccaagcttttccatcaatttcaaatgcttgttttctctacatccatcccacttcttggcctaaatctttctccacaatgagagtccaattcagatacttccttctttattaaatcttccttttaatggatcatctttcctttgcctgcatatattcatctgtattcccatggcttttaagttttttattcctttcactagtgttttaaccttgttactgtcttagcaataaatatttgtttattttaatttggaaaaaagtgaagccaaaagaaacaagatatactttattaacttatattagtatttagttttaatagcctactgaactttttttctaagcatacatttgtggtttgcttttttaaaacaagaacagtggaatctattatatatatatagttgataaccagcctctttttcactgaactacttgctgtagacacattttgctatcaacgaatatgaatttaagtcatttttaatagctgcatattatatttgcctaatctcctgctaattaacatttagtttgttttcactttattattacaagcgacaccccattaaatgtctgtgcatgtgtatttattttgcaacttgcctaattatttccttaggctaagcccttagaagaagaatagcttaatcaaacagtatgtatactttaaaggcattagatatgcattgtcagattccccacccccagaactattataagtgtagtctaccattgtaagtgggtaatgaaggtgaaggtgaacattttttcatgtgctttttgtctagttatagtttgttctgaattaactgcctcttcctttgccttattttgctcttatccattttgttttgtaagaattatttctctcagagacagaccagccaacctatatacacatgtatacatagacatacatacatacacatacacgagctctaaatcctttgccaaatgtgttacatgtatttttttctctcttattcatggttggttttgatttttatgtaacccaattttaagttatgaagatattcatattttatttgcctactttctcttttcagtaataataggaaatagcatttcattttgggagcaatgaagtagtatgttgcctcctattcatatttttgagtctgtgaagaaagttttatttttttaagtctccattatgtttattatatatgttattactctgtattacttgcattactttttacctgacttctacctggaaaataagaaacatgactccaactctggcaacaacaaatataattgctatcatgactttgagaatgtcattttcttgctgtgagcaacaaattataaaataatgaagtttaaataaacactaaaaccatctagtactaaattctggttgtttgtataagatgatccccattgtaactttcctggtggccagtagttaggaccactcttttaaagtagagattcagtgaaaaatagatatagattgctaaactatataattcccatgacatagaaatgtcatagttaaagtacgtaaggccttatcttgcttgagcctttcagtttttgctattaggaaacatttgtgtgtaagtttattccttttttcttgtagcgatggactaaaaccaagcatttggtttcaaattatttggatttgacttgtcattgacaactgttttaaggacatttccaacatttcttaaaactatccttaggaagatataaaattactggggatttttctgttttctattggaatatatgctggatgattatatataacaaacttacaatatttacaatatttctttctcttttttttttttttttttttttctgagacgaagtgttgctcttgttgcccaggctggactgcaatggcatgacctaggctcactgcaacctctgcatcccaggttcaagcgattctcctccctcagcctcccaaatagctgggattacaggcgcccaccaccaggcccggctaatttttttgtatttttagtagagaaggggtttcaccacatttaccaggctggtcttaaactcctgacctccggtgatccacctatctcagcctcccaaagtgctgggattacaggcatgagccaccacagccagacagtatttacaatatttcttttttttttttttcatttaatttcaatattttttttctttttttttttcttttattattatactttaagttttagggtacatgtgcacattgtgcaggttagttacatatgtatacatgtgccatgctggtgcgctgcacccactaactcgtcatctagcattaggtatatctcccaatgctatccctcccccctccccctaccccacaacagtccccagagtgtgatgttccccttcctgtgtccatgtgatctcattgttcaattcccacctatgagtgagaatatgcggtgtttggttttttgttcttgcaatagtttactgagaatgatgatttccaatttcatccatgtccctacaaaggacatgaactcatcattttttatggctgcatagtcttccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatatacccagtaatgggatggctgggtcaaatggtacttctagttctagatccctgaggaatcgccacactgacttccacaatggttgaactagttkacagtcccaccaacagtgtaaaagtgttcctatttctctacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcrcccactttttgatggggttgtttttttcttgtaaatttgtttgagttcattgtagattctggatattagccctttgtcagatgagtaggttgcaacctacaatatttctaaacagtatgctatactgctgtttcttgattcattagtgtttagatgttataacttctaatcatgagagatgaagaattagctcacttacaacaccgccaccttatttcttctctggttttgctaatgtattttagcaggatcaggtaagaagtgacatgtgtatgttatataatatatacataaagtatgcaatttcacattatatttatacatatgttaatatgtgtaacatttagagcctacttaaggaaatattttataattaaataaaatattatttaaaacatytattagaagtaagaatatactgacatttcttaaaactaattttagggaaacagacatgaagcatctctttttttttttcctttttttctgctttttactggaaacgtttcacagtcctcagccaaatctgtgagatagacttcctggagaattgaaatatttgaaagatgcaaatactgaagtagattgattgtccttataggtagacttaagtagcttaaagagcaataccaccaataaatacatttgtagatgtttctcttgaggtataggcagtcaatttatcaaacttttttcaagtcttttttatgtacttcatcagattatcctatgttttattgtcaaaatcaaaatgcccaatttattgcttttattacactaccattcatcaattatatgtcttaaaatcctacacatttgagagatagtgaatggcagatgaatatccaaactttgtttacttttttaaccacttaaccactcaccaaatatttatttataatttttataaccacttagcaaatgtagtttgtcatgcaaattaattatgttttcattatgatttcactgtttttgtttttatttttagctgtggttttattaatagcaaatttaatactctataatactaatgttaatatacttctgttgtaatccatgttacattgttttagaacctgggttattgatgaaaatatttgtatttcttctccatctaatccatgatttcagtgcatgcatttacagttaattttaaaagtggttttaatacttaaaagtcttttgagaggcttctaaaacttggcagtctcaacaaaatgtttttgtctaacttcctttttaagtctgtctttggacttacagtaaacaaactttttgaagcgggaatctctagccataatgcaggaacagatgaatagaacactcgccactttatcctgaaacgcatactttcagttttttataggatgccttaaagcatcatataaatattttaaaaatgtttgctaaactattaatgagtaactattacaaaactagggttggacttattaaacaaagctctgatttatagttatctccagaaaactagtcaatctgggggaacctacagatgtccatcttttttatttttatgtttcatttacaaagaactttttgattttccatttagggggtatatgggcctggctaccagtattacagagaagtgggagaaaaatcagcatatatttattattaagaaattatttaatgcacctagtgtcagctgtgcatgttggccccagtctacagcctatccagagagtaaaacttcatgtcttttaatagggtaacaaaggagcagttacctagcaatgtaggtgatggtaatggggtaagggagatctgggaatccaacttccttatacagacttccaagaattctcctgttttaactccaccctgtgctttcagagacaacctcatgccttcagttcctgagatcttcagaggtttgaaagagctgattttttattggcttcctacccaccaccccaaacattattcccccttttttttttggtcatttattattttacagagcaggattatatttattatataaaataatcaaatgtataaaaaggaaaataaaataattcattattttcccagtgagctataaacctgtgttaacattttgatgaattggattatatttccttctctgttttctattacttttccccccatttttgctcaggaggtttgtgcgctttgatttggtttttgtttttgtttttgttttgtcaaaattgggatcatactgtatactacctcattaatgaacatttttttatatcatcaaataatctataaaatatagttttaaatatcagtgtaattgtggatgttcatgttcatttagttatttagtcattgcctaagtgatttaattaacttctgtggtaggggctcagcattgtgtggtggtgaagaacttggcatctggattagcaaaaggtctgagtttgtatgccagttctgtcatttctttacattttctttttataggtccagtgagttttctgtttgcttattataattatgttttttcctgtaaaattaaggggaaaaaatatattcctgtccactgatccaacagcccagggaatgtagggaaggaaccagagccacaggtagtctcagctagaaatctgcccctttgcccaagagtatctcatccatgtgtgatatagccaacagtgatgggaacaagcctgataatatcgggtactttttaatattttttttctgcactgaaacaactgagccaggactgaattttagagcctcttagcgctacttttagtgttcagatgttgccattttactatattgcatagctgtgtctcactcattctccccaactcccaccttaccccatcatccctggttctaatttaaggccctttactgatatctgccagtgtcttttacttaactccttgggatagcactgaagggtaaaggatagggagtactataagtcattctcctccatgccttyccttaagagtctgagctatacaatactctttagaaagtcctctaatgttctggcactcagatgataatgttttcccattaccaacattaggtcaagtttaccctttttttaatgatgtgatcattttaaagggaatctgagtgggcgctagatgcctctattcaggttatcactttggttaaaattgtcttttgcagttaaccttcaaatgcctccttgtactatgggtatttctcaagtgtgccaaccaagtactgtttctagtgagaaattcttcaagcagccagtgtctttctaaattccttccctatcaaaaagaaaagattctaatatgtatattcttttatcaaaactcattcattacaagtttgcattttgcattttcaagcttccttaaacatggatcaaaatgcattggctcctttttaaagaactgaatgctatactaacaaaatattataagaggagcaattagaccttgtatctgaaaacatagtatgtctatgcctggaactgtctataaacctgttttaattgtttgggagtgtccagagatgaatatgcagagacagtagggtgcctaacctaaaaagagatgctgtttttaacatcattctaccaacttaaatcttacccattaattgcctttggtacaacttcctaggaggtgaacttcattttcaatactgtctctatctgctacttttgttctaggactgtttcctacttatccttactccttttctttcctttcccstacctcagcataataataacactcatcgtctctgaataagaaatcacagcctcaaaccccaaagagtttctactgcctcaagtctctatgagtgtccaaactagaaagggaaaaatgcagattccaggactcctacagttacatggatcagaactcctgaatagaggacaggatcccaagcttgatgagtgggagtagagggaaggggatgtcaaaaaaaaaagaatgccaaagttgagggaatgacatgcataaatggttcatggttttatggagcattgtcaatttctcttaatttacttatgtagaattaatatatactactttctgtgaactctttattataaggcagctaattacatatatagatattataatacccttctcacatctctccatcactgctcctaccactcttacccaagctgtcatttcttgcttaagctatagcaatagccttgttaccgatttttctgttttctctcttgaccattcttgacacagcaagcaaatcactctttttcctaaacatcaatcagatcacattatatccatatttgaaaccctccacagatctccctttacacttggaataaataaaaacccttgtcttgtccataaatcctaacataagttgccccttttgatctctctagcctcttattctgcctgtccctctaactcacagcacttcaatcaaactagcctcttttcctcgagctcaacaaattcattgttgccgttggatctctgcacatgctattttttctgccttttcccccagatcttcatagaactgcctccttagccattcaagtctcagatcacatattccatccttagaattgttattctagccatcatagttaaaacatcctatctcccatcactgtctattccatttctctgttttattgtctttacaattaatttatcatcctaatttattttatttgtttattgtcatctgccttctcccctcaaaaatgtaaattcttaactgtcttgtttaccactgtacctagcatggtatggtaggtacttaataaatattgggtgggatgaacagtgaattctttttatgcaggtgtactycttttagattgttgcttttgtaccatagctgactacaactttttttcataaataaaacatatgttgatcctggattcaaaatagtagtagtgatttttttcttttaaattttttgacattatgcttcctgttattatttgggcataaatttcaaaaagtcctattcacttacatcccatgggtcataatcattcaaggtaatagaaatggagcacacttacaatatgttgaggagttaaagtctcaagagatgttgtggaaatagcaaaattactcagaaaccataacatacattgctacccactacctcttatatttaagtatatgatacactggactagttccttagatagamcctagagatatgtcttcccaagtgactgccagtcttccctattccagtttgcaagagcgtgccttataacaatgcatttttaatttcctgttcccttctgtgtagcacccacgttgctagggtattttatgggctatcatcatctatatggtctcttgttctgcaaggcacagcctgcaactttgtgattcattttctcattttatggggcctttctgaaggaattataatctgcctccaagttccttcttatcacttctactctataagcacaagaattatggaatattgttagatagtgttttcccaagctgaatcaggggaaactacaactgtcccatgcctgctcttctggaaatttactgtacacccttttcctctaatggaaaagtacagcagatctcttttatagacatagacctaacatatccaacagttcttatagcctattgaactttctgatcccccaactcaacactctccacttgccatacccacataaagttctttattacctaacttagctaaaggataataattatttgttatgtaattgtatttatatattataaaaattgtattcagagtaaaatttagttgtttatgcttttagttttcattaagttgggtcattttccttttatgtttatagttacagaagattgacttaaatttttatttaaacctttaaattttgtttttgctctggttagctcctgaagctttctaagcaactaatcagcctaagtagttctgaattgaccatctgccttctgcccttttattttatctgaacttaataattgagagaatgaaaagaactctttagatttatatcatatacatgttgtgtgtctgtagcatctcttcttctaggcccagtaaaacaattgtatgtaaatccacattaactaccacatctccatgctattccttcagcttatactctgccaggagagcaggattatagctaaagatatatcactgtaacaccactattccttttactgacaaattgttagtcagtctgatcatactaaatttgatgtcgggtgtatgcttagattatcccagaggacacgtggatatttcttcagtgttctaccagaagactgtgatttttatcactctttactagcagtagggaaaatgtsgtccaccatgatgggaatttgcccagttgccactcccagagattatacctgctaagtatgtattttaaaaaataatgactctataattcttgtcccttgagatttcatgttccattgtattttaaagtttaaaatgttattataaggyctgcatttgcaaagaacatatatacctgtttcaataatacctgtggtttatattaatcatcagccttgataaactggatatctgataaactgaaagtgaagcactgtttgaaatatattgttttagagataacagtaagtttttgatgattggaaagtaaattacaactctccttgtaaaagttgtaatattaacagttgaaacatatttgcatttctagagcctttctttgaacccttatcatataatcctattcatatataaaaaggtaatatccgcttttttctaggggatattaatgcccacactgcttaagtgagttgcccaaggtcacttggtgagctgttggtggagccagaaatagaatccaagtctcctgactcccaattcagtcctctaccctccatgtagttttctatcccctatacccctgctgcctctcatgggaaaagaagttaatctgccagctattaatagccaccaaattggtggtagcagcacagtggagaaaagtaactgtctttactctgcagcattagtataaaaatatctggtaatggaaaatttgacaaatgtcatgttaaagggagtggaaaattattttaagatctggatctcatttatctagttctcagaaaagtaaaattcctcagtagaacagggatcatattkttcttctgtttttgaattttatttcctagagggtaattgtcaacctagccaaagcagagcatattgtcaactaatataataagaatagtgcttgtactgttgctgattgtttaagtgtattttctaacttggttgaaagtttgaattgctttattgaaatgcataacacttatcttattctgctttcaatgttctttaagttagtattatacagtaaagtaaatatcaactgggaattttacttcatgattagacaacgtgaatggaaatacacgtaatagtttcttccattgaccgtacactccaagcaaaggtatttcatgtcagacaccatgaagttcaccagaatgaagtaggtagagtagaaaaaagttaattgaaaaatataagataatcacactgaagttgatcaagtgtattgttacatatgtcattatttggggcattaataaaaggtgtttaccagatgtttgtgtttttaaatgttaaacattaaatactaaatctagtattgtggtaataaattctaatgaaacaatttgtttcttaattttggaccaaggaccaagaattacccaactaaaaatatcagcatattttgtttctatttaaagattactaaaaagtctttaatcagaaggatgacatgaacagaattatgttttaactataagcataaaaaagacagaattggtatacattggaaaatgcaagggaaaaggtagaaaaaaaaatctagtaatttggaacccaggtgacagagaaggtaatggtaagaggataattagaaatatgagaaactgtgtagaacaaggcaactagagggtcaagtacagctccttagggaaatgtgtacatttactagatggaagaagagaataacacagatgttagaatagtacagatataattttgaaaagctacaggaattatcagataaggctgagaaagatcatcagacttagtgacctcttgacatttgggagactgacttctccagagtgatgagggtgaaagtactctgaactctctgaattatttcatttatctttagtattaaatcttgtttttacaaacctatgagttatgtatgatacaggagacaaatcagttaactagaatgcttaattgactacagttttctctcaatatcctggggacaggcaagttgattccaggaaccctcccagataccaaaatccatggatactcaagtcccttacataaaatggcatagtatatagcctacatgtatccttctgtgtactttaaatcatctctagattacttataatacctaatacaatacaaatgccattaagtggttgttatattgtatatttttttaattgttttggtttatttgtttgtttgttttgtgaatattttcagtctctggttggttgaatccacagatgcagaatctgcagctactgagggtcaactctgtatacctgacactgtaacagaaacaatgctttcattcacccagaattttactggttattgccattcttgttcatttagactagacttccactcaattagtaataaactggtcactgacacccaaaccctagcatcacccagtatactcatataacaaacctgtacgtgtacccgcaaatctaaaaaacaaggcaaaacaaaagtaataaactggtaatattttacaatggaacaagtgttaacctctgtgcctataaaagtttaatactgttttcatcttaaacccaaatcaaacatgaaagctagaaattgtgaattttattggaattgattgataatttgtttcctaattacccaatatctcaagaaagctatacctataaattaatattgatattagcaatatattcttttgttatagaatttctttataatgagtttatctttatttaaagtttttagcagtaaaccgtgatattttcctttccaacttatatttttcagatttttatcaattggcataaaaataccttattattagggtttcttagttttaaaagtaatgggggttatttaaaaaactaggaaacattatcgagtgtctttttttatttttttgaataggctcatcttcaggtggaactaatctggttaagattcctacagaaaaaagaactcggagaaaactaatgccatctcccttgaaaggacagcatactctaaagtctccaccatctcaaagtgtgcagctcaatgattctcttagcaaagaacttcagcctattgtatatacaccagaagactgtagaaaagcttttcaaaatccgtctacagtaaccttaatgaaaccatcatcatttactacaagttttcaggctrtcagctcaaacataaacagtgataattgtctgaaaatgttgygtgaagtagctatccctcataatagaagaaaagaatgtggacaggaggacttggactctacatttactatatgtgaagacatcaagagctcgaagtgtaaattacccgaacaagaatcactaccaaatgataacaaagacattttacaacggtacaaaaaaataatatttgccaattctttttttttaacatagactttcaactattagttgaggtttatttcataaaccaagtgtgccattttgattataaaacagtctgttttattttcattaaattttaattatctttctctctgaatattaattcactaacaaaatattttaaagtcttaaatttgatatcttaagtcagttgaccgtcgttagtctaggagagaccttaagatatgtttagtttgttcttcttactctgaaggtggattatacaagctattgttggaggattatcatgtttattattcattaatattttcactgaaggaaatttcacactttctattgatgtttagcaaacctcaacttactctgaaatggtcatacccctaaagtatggttgaatgtgtgtcatccaagcaaacatatccttctcactttatctgcataatcatacccaatctaaatatggaaagaaaaataccttcactattctatgccactgggaatgcagaaatctcttgatagcaactttacctgtgttataaagagaaaagaataccccaggacaagcaagggaatctttacagtatagcagaatgtttttctttatatattaataccaaatggttttctaattatggacacatttgcttccttttctcttcatagttcaaatcaaaattattattttttatttgtcactattaatatacaggcttgatccttcttcattctcaactaagcattctatgcctgtaccaagcatggtgccatcctacatggcaatgactactgctgccaaaaggaaacggaaattaacaaggtatgattaaacataaactggtttggttctgtagttatataagataatctttatatattatatgctattgcttttttattttttataattagactctcaattcatgtttaagcatacttaggataaatttctctgaatggggtactggatttatattatcaaagggagatcttgaaaaactcaagtatttcacttgatattttataaaatatttcatattacagacttaaaaataaattgaaaagttttctgtcaaaaactacttaattttaacttttctggggtgacaatttttacttatttcgttatttctacttacttcattatcctttttaaacattaccaaatttcttccatcatagaattatgttattttaatggattaagatatatgactaaaatataatgagtgaagagacttttatttctgcctaagacagtgtagcttgtatcagaccaagctacctatcaagaacagttgtaaaaagtgcataaaatagaaccaacagctgcttgaaggcaatggagaacaaccatgatagccaggatggagagcctgagatcccagagaaaagagaaacatgctatagacagctagactttctctgcctctgttttttatttagcatttgccaatttatggcataaggcatagaggccgaacagaaaatggaaacttagagctatcagctgtcttactctgagctagggaaacaaaattattctgtacaggttttgtcctcaaggtattcgccaagttctcagctttgtggaatgagaggctaagatgcctagctgaaagtagctgctaagaggctaaagtattaagcagagttttgatgttcttatgaggctttcacagaaaaattggagttcagggaccaccatgaagaaaagaccctgttaaacacattaggattttatttgagatccctgaagggtgtttcactaggagtagggcaacctagaaataggccagttcttgaaagtctgaaacagaccttagaccaacttaattcttgattggatcaaggtgatttatctttgctctgcatcaatgtttggcacttaaacaaaaattacaaagtatgccaggagacaggaccaaatgactaaaaattaagagaaaaaaacatcatgggagcagtgattcatacgtgaggcagatattggaattatcagataggaatttaaaaattttaactgtaataatttcaacaaatagatacttccccaaagaaccagattctattaaaattaatcaagtggatattctagaactgmaaatatagaatttactgagatgaagaactcaataaatcaattcagcagattacatacagcagaagagagtattagtgaactgaaagatggatttgttttttactttttatttttgtgggtacgtagtaggtgtatatattagggggtgcatgggatattttgatacaagcatacaatgtgtaataatcacatcagtgtaaatggagtattcatccatttatcctttgtgttataaacaatctaattatactcttagttattttttaaatgtacaatacattattgttgactgtagttaccctgttgtgctatcaaatactagatcttattcgttatatttagattaagcatccccccattaaccatcctccccaatctcccgaaaaacccttcccagcctctggtaaccatcattctactctctatctccatgagttcaatttattttttagctccccaaaataagtgagaacatgccaagcttatctttctgtacctggcttatttcacttaacataattaccatcagttccatccaygctgttgcaaatgacagggtctcattcttgtttcatggctgaatggtactctattgtgtataggtactatattttctttttctattcatctgttgattggcacttaggttgcttccaaatcttggctattgtgagtagtgttgcaataaacatggtagtgcagatatctcttcagtatactgatttcctttcattttggcatgtatctagtaggggcattgctggatcgtatggtagcactatttttagttttttgaggactcttcaaacttttctttatagtggttgtactaatttacatccccatgaacagtatacaagtgttcccttttctccatatccttgccagtgtttgttgttgactgtcttttggaaaaaaagccattttaactggggtgagatgatatctcattgtagttttgatttacatttttctgataatcagtgatgttgagtaccttttcataagcttctttgccatttatgtcttcttttgagaaatgtctattcttttgcccattttaaaaatcagatcattagatttttttcctagagttgtttgagctccttatgtattatggttattaatcccttgtcagatagatagtttgcaggtattttctgtaattctgtgggttgtctcttcactttattgattgtttcctttgctttacagaagctttttaacttgatgtgatcccatttatccatttttgctttggttccctgtgtagggtattactcaagaaatctttgtccagtccagtgtcctggagagtttccccaatgttttcttttagcagtttcatagtttgaggtcttamatttaaatttttatccattttgatttcatttctgtatattgcaagagatagggatctagcttcattcttctgcatatggataaacagttttccagcactgtttattgaagagactatcttttttcccaatgtatgttcttggcagctttgtcaaaaataagtttattgtaaatatgtagatttattttggggctctctattctgttccactggtytgtgtgtctggttttatgccagtcccgtgcttttttggttactatagctctgtagtgtaatttgaagtcaggtaatgtgattcctccagttttgatctttttgctcaggatagctttggctattctgggtcttttgtgattccatataaattttaggattgttttttctatttctatgaagagtgtcattggtattttgatagggattgcattgattctgtagaccactgtgagtagtgtggacattttaacaatattgattcttccaatccatgaacatggaatatctttctatttttttgtatctgcttttcttacatcagtgttttatagttttcattatggagctcttttacttctttggttaactcctacttattttatttttagcttttgtaaaggggattactttttttttcaaattatttcagtgtttgtrtatagatatgctactgatttttgtatattgattttgtattctggaactctactgaatttgtttctaggttctcatagttttttgtggactctacgtttttccaaatatatgataagatcatgtcatctgcaaacaaggataatttcacttcttcctttccaatttggatgttctttctttcttttctttctcttgtctgattgctctacttaggacttccagtaatatgttaaataataaatactggtgaaagtgggcatccttgtcatgttccacaacttagagaaaagaatttcagattttctgcattcaggatagtaccagctgtgggtctgtcgtgtatggcttttatcgtgttgagatatgttccttctatacccagttttttgagagttgttttttttttttatgctttaagttccacggtacatgtgcataacgtgcaggtttgttacatatgtatacatgtgccatgttggtgtgctgcacccattaactcgttatttacatttggtatatctcctaatgctttccctctgcgctccccctaccccacaacaggccccggtgtgtgatgttcaccttcctgtgtccatgtgttctcattgttcagttcccacctatgagtgagaacatgcggtgtttggttttttgtccttgcgatagtttgctgagaatgatggttttcagcttcatcctgtccctacaaaggacatgaactcatccttttttatggctgcatagtcttccatggtgtatatgtgccacatcttcttaatccagtctatcattgatggacatttggattggktacaagtctttgctattgtgaatagtgccgcaataaacatacgtgtgcatgtgtctttatagcagcatgatttataatcctttgggtatatacccagtaacgacatggctgggtcaaatggtatttctagttctagatccttgagaaatcgccacactgtcttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatcatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattctgtaggttgcctgttcactctgatggtagtttcttttgctgtgcagaagctctttagtttaattagatcccatttgtcaattttggcttttgttgccattgcttttggtgttttagacatgaagtccttacccatgcctatgtcctgaatggtattgcctaggttttcttctggggtttttatggttttagctctaacatttaagtctttaatccatcttgaattaatttttgtataaggtgtaaggaagggatccagtttcagctttctacatatggctagccagttttcccagcaccatttattaaatggggaatcctttccccatttcttgtttttgtcagrtttgtcaaagatcagatggttgtagatgtatggtattatttctgagggctctgttctgttccattggtctatatctctgttttggtaccagtaccaggctgttttggttactgtagccttgtagtatagtttgaagtcaggtagcgtgatgcctccagttttgttcttttgccttaggattgtcttggcaatgcgggctgttttctggttccatatgaactttaaagtagtcttttccaattctgtgaagaaagtcattggtagcttgatggggatggcactgaatctataaattaccttgggcagtatggacattttcatgatattgattcttcctatccatgagcatggaatgttcttccatttgtttgtgtcctcttttatttcattgagcagtggtttgtagttctccttgaagaggtccttcacatcccttgtaagttggattcctaggtattttattctctttgaagcagttgtgaatgggagttcactcatgatttgtctctctgtttgtctgttattggtgtataagaatgcttgtgatttttgtatattgattttgtatcctgagactttgctgaagttgcttatcagcttaaggagattttgggctgagacgatggggttttctagatatacaatcatgtcatctgcaaacagggacaatttgacttcttcttttcctaattgaataccttttatttccttctcttgcctcattgccctggccagaacttcccacactatattgagtaggagtggtgagagagggcatccctgtcttgtgccagttttcaaagggaatgcttccagtttttgcacattcagtatgatattggctgtgggtttgtcatagatagctcttattattttgagatacgtcccatcaatacctaatttattgagagtttttagcatgaagggctgttgaattttgtcaaaggccttttctgcatctattgagataatcatgtggtttttgtctttggttctgtgtatatgctggattacatttattgatttgcgtatattgaaccagccttgcatcccagggatgaagcccacttgatcatggtggataagctttttgatgtgctgctggattgggcttgccagtagtttattgaggatttttgcatcaatgttcttcagggatattggtctaaaattctctttttttgttgtgtctctgccaggctttggtatcaggatgatgctggtctcataaaatgagttagggaggattccctctttttctatagattgaaatagtttcagaaggaatggtaccagctcctctttgtacctctggtagaattcagctgtgaatccgcccggtcctggacttttttcggttggtatgctattaattattgcctcaatttcagagcctattattggtctattcagagattcaacttcgtcctggtttagtcttgggagggtgtatgtgtccaggaatttatccatttcttctagattttctagtttatttgcatagaggtgtttgtagtattctctgatggtagtttgtatttctgtgggatcggtggtgatatcccctttatctttttttattgtgtctatttgattcttctctcttttcctctttcttagtcttgctagcagtctatcaattttgttgatcttttcaaaaaaccagctcctggattcattgattttttgaagggttttttgcgtctctatctccttcagttctgctctgatcttagttatttcttgccttctgctggctttttaatgtgtttgctcttgcttctctagttcttttaattgtgatgttagggtgtcaattttagatctttcctgctttctcttgtgggcatttactgctataaatttccctctacacactgctttaaatgtgtcccagagattctggtatgtcatgtctttgttctcgttggtttcaaagaacgtctttatttctgccttcatttcgttatgtacccagtagtcattcaggagcaggttgttcagtttccatgtagttgagtggttttgagtgagtgtcttaatcctgagttctagtttgattgcactgtattctgagagacagattgttctaatttctgttcttttatatttgctgaggagtgctttacttccaactatgtggtcaattttggaataagtgcagtgtggtgctgaaaagaatgtatattctgttgattgtgggtggagagttctgtagacgtctattaagtccgcttggtgagagtttttatcataaagggatgttgaattttatcaaatactttttcagcatctattgaaatgatcatatggtttttgttcttcattctwttgatacaatgtatcacattggttaatttgcatatgttgaaccatcttgcatccctgggataaatcccacttggccatgatgaatgatctttcaggtttgttattggattcagtttgctagtattttgttaaggatttgtgcatgtgttcatcagggatattggcctggagttttcttgttttgatgtgtccttgtctggttttggtatcagagtaatactggcctcatataatgattttggaagtattccttccgcctctgtttttcagaatagtttgagtaagattggtattggttcttttttaaatgtttggtaaaaatcagcagtgaagccatcaaattccaagcttttctttgctgggagactttattatgactttgattttgttacttattattcatttgttcaggttttggaattttttctgaaagatagactggtaggaaaatatccaaactgatgtgcagtatgataaaaatatgggaagaagtgaaagagacatgggacacaatttttaaaagtctagaaaatatgtattttgtgtctcagaagggagtgagagaaagaatagggaaaagtaatatttgagatgatggctaatacttattcaaaactaacaaaagacattaaaccatggatttgagtagcactgcaaaccaaaagccgggttaatataaagagaaacatacctaggtatatagtagtaaaacaactaaaaactaaagataaggaaaaatcttaaatatattgagttatatgactagaagttcatgatgcattctttatatcctataaattgaatgcaatgacaaatatactcaataaatataaaatggatctgacttcctctacctctttttctttgctatgtgattatggggagaaaagtttatagaagaccttaaaatgactctttttaaatgtattttccaccaggagcctgttatcatttaagtaacaggaagcgaatttacaagtagcctacttatttgtgctacatagagtatcttctcataagtgaatttaatatctgtccttgtccctcctaaacaaagtataacagagacttggaatgtgtaaatttaaaatttatggatttttcctaaatgtctcatctatgacatttaaaattttatatttgctaaggtacaaatttgatttgtacaattattctggtttatatacagaagtctgtcactttatgagtgagcctagctaaccacaatcatctgtttcgtctacttttatcactaatttgcatagtgtcagttttgtcatttgttccattaattaattttagtgagttttcttgtccttcactggtagtatgttgtgtttactaagatgtcacaaatgtttatagataagaataatttttaaatatgaacttagctattataaaatcaawtagtttttcaggaaatgtccaggtatgtgaattgtgtatttggagtgattttagataagttaaagggcttccacatgaacaactaatattgtgaaataatattaaaggacatgtaaagaaagtaacttgatttcttatagcctattaattgttctattacattccctctggtaccagtaattagatcctgccattaactaaggttaaaagagattaatgctagaaatgtacatgattactttttttaatcttctttttccccaattaaagttacatgcgcttcagagtaataaactgtggtattttccatttagcagctttatatacatatttagttgtgtatatattctaatatagtttttaaaataaagaaggggaagctctctatatatgtatttcatttattttgcataaaatggcattagagtttgaaagcactggatattccaaaacctacccaacagatttgtttaaataattgagtatattrgatttttaatcttaacaatttatttaatatttctctagcacactattttactaaattgattagcctatcaaatatttaaatataatgcatacataatgttagcttttacttctcaattatattaatcagagttttggattgtttgttttgtatttgtttggttgattggttttttgtttgtccacaatcttctgagcaccccaaagcagtttcatatttgccatacacttttattttgttttgaaagatgtctaattatttcaactagaaattatttcagataaaatagtagaagaggtattatgttgagtagaaacattctacctatataagggagcaaaaggttaattcttaactttatttatagttatgggaatatgttttgtgcacaactggaagtgtctttggatttttcagtatagcctttaacataatttgaacttgcgctcatcagttttaagtctttgtagtttatgacctacaacataaatgttaaacatttcatcagtggactatttaactaaatcgtaaacatgtttgggtatattttacttttatataaatacgcaatttattagggttggatttgatttctagaaatatgagttctaatcaaatggctttattcaaaagcctaattttcaagaaagaacatgctatgagtaaaaagtagggtcctggaactagccataatgcataatcgtactatgaaataataaagacaactttgggataaatttaagaaaaaacaatgttttatcaaaagtaactaataatattgatctttatatttgaaaaaataaaatcaccaaatgatcaaaaaagaatttctgccttggacagctgatatatacaaaagtgtgtttaatatgcaaaacagaatcatagtaatttatcaccatttaagaagtggggactactgtagttgatataatatttgtgcatacaaatttgtgattttatcttcttaaactgtgtcattttcattacttccactgagtagtcaccccttattcaagttttgctttctgtggtttcagttacccatggtcaaccgcagttcaaaaacaggcgattgtagaacaataagatattttaatagagagcgagaccacattcacataaccttataataattataattataattgctctattttattattattgttaatctcttactgtgcctaatttataatttaaactttatcatagatatgtgtaggagaatacatagtatatatccggtttgatactatcctcggttgcaggcatccactggcgatcttagaagatatcccccccgtcgataagggggattactatatagtatctttattagccagaatttccctaagcttaggttgtttgaatcagcgtggaaggatgttctttttccacccaaccccccccaatcctacctgttaaaaattgatcctctttaggactaggaaggattgctgtttttcaggacccagatcaaattcattgcatccacaaaatttccattattctttcttactctacactcaakaatctatagctccttgtattatggaaaccttggcactatatttttactttaccttatattatttcatgtatttatcttatttttttctcatctccactgtatgtctattctataagtttttaggacagggatttttgtgccttgtttacttgtatatcatgtaacacaaggccataataggtgtttactaatatggcaactcaaattgagtaagaaagttgaaccatcagcagtgtaagactgattaaatttttgaagctagagcaaatgaaaacaggtcattctttttatttcagtttctgtgattgtaataattagagatttttattgttaccctgctttcattttaaaacaaggtttttcaaacaatctcacttgtttatacctttcacattaggattcttggtccaaatttgtaacatgagcttagttttttttttttttttttttaacctcttgtgactatgtgctactgatctctacattttgaataatagtgcttacttatctgccagcaaagcaccctggaatattctgctacagaattgtaacatacacctacaatcataacattcaatttgaataaaaatataaaatatccaatttaaaatcacacacagctaaatttctctgtgggccaaaaatgtatttagtacctccacttctgtgagatttcacaacttaatatttttgtgttttatttctttaatcattgtcgcatgtacaatatgtattagaactttgaggtataaaaaaaatgcttaactaaattaaaaacttttcctctcaagttctacatcaaacagttcgttaactgcagaygtaaattctggatttgccaaacgtgttcgacaagataattcaagtgagaagcacttacaagaaaacaaaccaacaatgggtatgtctcagcttttaatttgatattyaatggtatgactctgtaacacacatatagtactttacgttttttattgtgttttcataagaatctccctttattcatcacctttactatgtggtagaacaagtatgattatccacatattatagataaggaaactttaaaacacaaaagcatttacccaagatcacacagatattatattggtagagccaaaactcaagaaccagatcttaaaactctactttctacacccttttagttatccctactgtctcataataattgaaataattggctaaatgtattacttaatgttactaattaagtgtattttgcagataaactatacccactttaaatttttctcttagcgtaatattttgaataatttggcctctaactcaatgtgtaactactacacagattccagtctgtatctagttacaatcatattgtaactcccattggcaagttggaaaagatactgatggatctttcccatcagtatgaaagatactacattccatcaaccgcatatgggagtgacatgagtttatggtaacaaaaccacttcagttaaactagtggtgtatcatgccagccagttttcaggccccaacatctagacctctgtctctgatactacagttcctaagacttcattcagaaactatttattcactaggcatttaccatgtcctgtgatgaatacagagagcagtaagacacagtttgattgttctctataggaactgataattatagcaaatgcaatttaaaggtgtctcatgatataatttttctaaggataacatgaaagctattgttagtttttttctgtcgatgccctttgattagagtaatataaaattcctcagtaactttgtcaamctatattggtaaatgcctgcttcctgtagtagccagtgtttaccttaagttcaatggaaattgaagcatcagacagcaaattgaaacatcagacagtaaggtagtaaagtacaaaatttaccttgatcatttggtttgacatgttgtatttaataatgcttaaaaatgtgtatctgtagttagtttaggtgtgtactgccccactgatcttcttaaaaagttcttcaagaatcataattctacagccaaataataaatttataaaaactctcaaattggccgggcgccgtggctcacgcctgtaatcccagcactttgggaggctgaggcgggtggatcacgaggtcaggagatcgagaccatcctggctaacatggtgaaaccccgtctctaccaaaaaaattttaaaaaattagccgggcatggtggcaggcggctgtagtcccagctactcgggaagctgaggcaggagaatggcgtgaacctgggaggcggagcttgcagtgagccgagatcgcaccactgcactccagcctgggcgactgagcaaaactccgtctcaaaaaaaaaaaaaactcaaatcatagaacttggctttttctaatatgcttattatctgaagatacaaattcatcaaatatttcatgtataaagagatgtgagtaaaaatatctactatggggaaaaaaaagtgggagatgataataaaccacaatgcttgccaaagaggtattagtttgtaaggaaagatattttatatacattataatgttcaagtgaaaaatgtattaaaccagttttctaactaacaatgtacaaataaagaaacataggaccatcagtagggaaaaaggcaactcctgttaacttagcagttagagaaataacagagagtgttaagggaatatgtccctctaaaactaaaacctaatatggccaacaaagtggataagcaattaaactaatcctgaaaaaagtcaatggcaccctgttgtaacaacactttgttgagtagaaaatgacggtgaaagctaatgaagaaccagaagaatgggcataaatagaacatacttgagaggtggcagtaaaagaaaaaagagctataggattaagatcagccctttaggaagtactagatgcaaatgataattttaaaattggaaaaatatggaagtttaaatccctggggaaatataatccaaggaatgagaaaaaatggtgatacaacaaagaaaatgaagaaatgcttgtagaaatggtcttttattagtcagaaagaaagaaaatgaacatagtatttaattcagcgacttcacccgatgtctgtgtatgtgcacgcactcactgaaactttagtttgcaatatgaatttgaacagcttttaaaccaaaggtattaatgtctctttgttgttgttatattttaaattatgttaactaacaactatgaatttcaagagtaaatttttctttctrtggtcataatttttataagttgaacgatgaaaactttttgaatgatatttatgccatatttatgcatctttttatttcttctctagaacataaaagaaacatctgtaaaataaatccaagcatggttagaaaatttggaagaaatatttcaaaaggaaatctaagataaatcacttcaaaaccaagcaaaatgaagttgatcaaatctgcttttcaaagtttatcaataccctttcaaaaatatatttaaaatctttgaaagaagacccatcttaaagctaagtttacccaagtactttcagcaagcagaaaaatgaaactctttgttttcttcttttgtgttctaaaaaaataaaatttcaaaagaaaaggttgtcttttaagttttttaaatatttgttgccttttaaaatccctgagtgtaagttaccatggtggcagcttagttttactatgccacaacaagttgactaggacattttagtaaatggtagtgagttaaattatctttattattttttaaaaataagaatttagaagtggtaaaattatggcccaagatgtatttggttctctattatgttttgatacattattttaatcatatatatgactttccttttcaaaaatactttaatgtacaagtgtaaatatatgtgcccataaaatcattgtaaatattatttagtcatcacaaataaaatattgtcccttgctacttgatatattaaagatgtagattttaaagtgtttcattttcttgtctcattactaccccttwcatactctaaaccagtggtccccaacctttttggcaccagggactggttttgtgaaagacaaaacctcagactgagagtagggggtggtttcaggatgattcaaacacattacatttattgtgcattttatttctattattattacattatatattacatatataattaaataattatataactcaccataatgtagaatcattgggagccctgagcttgttttcttgcagctagacggtcccatcttggggtaataggagacagtcacagatcatcaggcattacgttctcatagggagtgtacaacttagatccctcacatgcacagttcacaataggggtcacactcctatgagaatctaatgccactgctgatctgatacgtggcagagctcaggtggtaatgccagcaatgggagcggccacctaccactcgcttcctgctctgcagcctggttcctaacagaccacggttgggaacccctgttctaaactattattttatagaaaatgtgaattttgtagatttgtatttcaggtaagatcaagatatgtggcgccagagccaagtctgaaaataatccacaggcctcgtaatgataatgggaaaagatgtttcaatcattcttgctgctataggaagtacatggagctgcaacttaattatacactgtttacttgccttgcctgtcctgtttgtttgctgaatgtaacatatttggccaaatgcacttttaattttatgcagcacaggacccttcacaccaaagcaagcaagctgaaatattttaagcctttcagctaatcaagtttatccacttaaaatctggctgggagagtgtgagaataatctttgaggtccctttcagctctgacactggtgattccatatttatagagcatattcaggatgtgtcatacagaaaaccaccataaacacatttttttttggtcccttcgacatttggtttttggttgtgttgcctgtttaacaatcactttcacctctctattcctttcaattttaggtaaaagaaacctttttaccagatagtgacgagtggctaccatgattaataagtgactagacctcatggtcctcctcatactaaaaggtatgagcacgattttcttatataccatttttatcaggtagagatttggacttctataaaaattaataaaagggacttttgtcatataactatattaaggggaagttggggtaataaaccataatgaatgggaaaagacagctattaactatgtgaatttaaactaaaacaagaatgctatttgataagtcactgtgaaaacatttttaagtgagccttatgtaaaaagtagatcactcataagtgaatatgtaacagtgaattttcaaagtgaacatgcccacataaccagcactcaaatgatgaaatagaaaattatctgtacctcggaagactctcttacaccttctcccagtcatcacctccctcagtggtaacagctatcctaacttctaacaccacagtttaatttttaattctttcttaaaaaattaatatatgtacttttaattggcacataataattgtacatatatggggtacaatgtgatatgttgatatatgtatacaatgtgtaatgatcaagtcaggattttagcatatccatcacctcaaacctttatctttgtgttggtaacatcatagatctattttaactaaaataactaatttttatttttaaaaaaagtgttgttctaaaaaatgatacagaacagtacgaagtaaatgtgcttcctcctcactgcctactaatatcattcccacgtgtaaccactgttaatattaggttggtgcaaaagtaattgcggtttttgccattactttcaatggcaaaaaccgcaattgcttttgcaccaacctaatagtttaggtaccatgactagacatttacttttgttttttatatatatatataaaacaaataatatacttattatatatatttatataaaacaaataatatatttattatatatttatataaaacaaataatatatatatttatatataacaaatatatatatttatatataaaacaatatatttattatatatatttcaatatacctatattcttggatttttttatgaaaataggatcatacttgttatattgttttgcacttttcatttttattcacatttaaaaccatcatggacatatttgtaaaatttttaagtgtgaatttcataatactgctatgataatttttatatagtaaatatatcgagagaaacgtagataatggtctcttttgagctacactgttcagcatttctgagaatactttggagtagtcactgttatttctacattatgatgtgttaagcatgttccacagaacacaccaagtgtcataaacgacagcactgctataacatggcatatgtgttcataaaacacaaaatgctgtgcaaagttgtgcaatgaaaccacaaggtttatgggaaaaatggggttagtagcacaacactcaaaaggttagtcactgacacattaaaagaaagataggaacctaataaaaacagtggcctaattttacacgttaactggttaagaaatgtatgagtactatgacaaatatggcactttgccttgagaaggaaagtttgcttggaagttgatgtggaaggattgtagcttgtgagttactaggaaatgatggaaggagggtgatctgaattcagacaggaatttataatgccagatgtggatggctgtggcccactgtcatgaggtatattcattttgaatattctgatgtagcttgataccactgagtggagctttctgttcacctaatgtttcatccagatgaaagcttgtgtatccaggtacaaaactcacattaggcccaaatggttccctaatgtaccaatgccataggagcaaatctgtactttcaaaatagttacagcagaactgactatatatatatatatatagtatatatatttatacacacacatatatacagcaaaactgtacatttatatgtgtacatgtatacatatacaaaactacatttatatgtatacgtgtatacatatacaagcatctactacagaaaacatgctatatacatatacatgctgtatatatatatatagcagaactgactatacatatatacacgtgcatatgtatatataattgttaaaccgaagagggattcatatttataacaactgcattttgttttatattatgctttgactcatatttaaataacttggaaatatctacagtaactgctcaacaagagctttgatgttaatgaagttgcaaattctggaatcagataggataatctgaccttactctgagaacaacttccaaccacaagccttataaagtgtccctttatttgtaaaggggccctcagtccacatttgttaatgaacacgtaataatagtcatacttttttgagctcttatcatatgataaatgttttaaatgcatttttcacttattcctcaaacaagcttttaaagtagatgttacatttcatgttgaacatgataaatatgtataagttttatttatcaattaagtacattttttaaaaaagtaaatgttacagatctacaacttcttattcaattccaaaactccacagattttgaaaatcaggttttgtataatttttgtctgtaaaacctgacttctgctaatatgagtctattaattgtatttaccctacttagtataaacattcagaggctttgctgcagaaatgttaacattcagttatagagtattagcccagaccccaccagggtgagggtgttatgtataaatacagtatatgcactgtattgcatttctaaaacaaaaagaaaatactgaattataaaacaactacccatgaggatttcagatgatgatgtctagataacatatttagttttctaattgaaaaaggagaagatgcttggaaaattaagtaatttgccaaaaattccacagctgtacagtagcagaattgggatttttgaactaaagttgatataaaatacctctatctacagtgtggctaacactgcatatggatggctatacaaaaagcatctctcctacacaaaacaaatttgagtcacctgttcacttgtgactggtaattagctttaatttgtgggtgaagttcagtaaattatatccagatttgggattgattcagtgcattttataattataaacaaattatatctaactcaccttgtttatattaaaaacaaaaatgggctgggcacaatggctcacacctgtaatcccagcactttgggaggccaaagcagatggatcactttaggtcaggagttcaagaccagcctggccaacatggtgaaacctcgtctctactaaaaatataaaaattagccaggcatggtggcaggcacctgtaatcccagctacttgggaggctaaggcaggagaatcgcttgtacctaggaggcggaggttgcagtgagcggagattgagccactgtactccagcctgggcaacagagcgagattccatctcagaaaataaaaaaaaattaaacaaaaataaagtattgtgatttgtacatgtggaaaagtcattagtatcactgaaggcattcacaaatcctatggactgatttttcaaggatgttgtttctttacaatcaaaatttcacacatatattgctttttgcgtattcacaacttactcataagttgttaaccactcaaggtaagatatgttacaaaatcactcgtttacatcctcaatttttttgtgttaagactccatattcaaagtctaaaggcacaactgggacattaagacaaaatrtaaacatacgtttcaggaattagtacagggcaattgtttttgaaatgtatatgcagagcactaagcttgtcgcctcctatgacttcccccaaagagtagtaattgatagatagtccatacttatctgaatgaacatcatcttgacaaatcactcaatccttgcaaatggcaaattctacataacagccactatggggattagtccctcaagttaagaccttttggggaagtttagttctgaagtatttctgtcatttatatgtacatacagatgctcctcaggttatgtcctgataaacacataataagctgaaaatcttgtgagtcaaaaatgcatttaatgtatctaacttaccaaacatagcttaacccagcctaccttaaatatgctcagaatacttatattagcctacagttgagcaaaatcatctgacacaaaggctattttataagaaagtactgaatatctcatgtaatgtatttaacactgtactaaaagtgaaaaacagaatagttgtacggtttctctcacaatgctgggcagcagcagcaagccgtagctcccagtcagccacacagttcaacttaatgagactttgaatttacgatgggtttatcaggacataaccccattaaaagtagaggaatatctgtatgtgtgtgcccaagtgagatataagacaatttttttcagaagtcataatttaaatatatatatatgcattcttatacttttaactagatggaaggtgaaaggtacctgtataattaagaagagtagagacatgagaggaaaatagttctatgatcaggaccttggacacaaatactgtgtcttcagccttatttctcatccctgcagaataatcttcccctctgcaagccacttctcaaatatgaaatgctgaaaatcctttctaatatcaacacccttggcacacatccctttcccattatctccttcagtgtggttatttcagaatcattgtaagtctttt

SEQ ID NO: 10715 - DNA, 37821 bp, Homo sapiens
  misc_feature (1)...(37821): n = A,T,C or G, or insertion/deletion polymorphism (see Tables 1-2)
ttggtaacagacactagactgtattgcttcccactccttacacctagtcattgagaaaactgagggctatggaaatcattcaccctgtcctcagtgtcctctgctcagcttctcgtcccagtgctgtctccccttgatttcccacttcttctcttctttatctttatttcttgccccttgcttttctctttgcartttctgttccccttactctctctgccttatcattggtcacttctttcatttatttttacttttttagagacaggcaggctggtcttgaactcctagctcatgctcccaaagagctgggactacaggcggctggctaactttttttttttttttttttaagagatggggactctccctatgttactcaggctggtctggaactcctaggctcaagtgatcttgctgcctcagcctctggaggggctgggagagattacaggcacccagctgttcacccttttaaatttaactgtcctccagttttatttctcactttcctttgcaagcccctcactcccaaccacttttgctccccgggactatcctctgctctgacttcctggtttccctccctctgccctcactctgggcaccagccccttccatgttggcattcgactccacactttctgctttcctactttgagatttgcaatacacttcagccttattcacttactgctgttagcctaaccgattaataccatttttatgaaaaaatgtaattgtatctctttaaagagacacaaggaaatgagaggcatgaatgaactgaataatattcattatttactaagcatccactacattcctgtccttcatatacattgtctctattcttcacaacgcctttgaaagaagctgtcatttagtcccacgttatacttgaagaagtgatgctgagtgagattaggtgacctgtccaaggtcattcagaggtagaattttatctcacatctttctgattacatcatctaccctctgtccgctatatctccctgactcttaagtgaatgaaagtaccatgccttatcacatttctcctaaacagaaggaataagtgacaataagtctacatgtagagattttagattttctccatgcactgcctctcacatacacatctatacagacgccacctttaaatttaacaaaggagggaggcagaaagtgggaataaaacagtaaagacaccaaaggaaaactgctactctcctctccttgatgttatctgtgaatgactaagttcattaggaatcctagactcaggggtttttggagttgaaagtggtctcggaagatatccagaataactcctctgttttacaaatgagggagctgtaactcagagacataaaatcacttgcccaaaacatataaattaacatactgccccgacctgggtgggaggttatattgatattcatcaagtgcttatggacaaacaaaatgtacccaacctgtctacaagccctggaatgttctagcatcacagagtgagagtaattccaggctcgaagggtattcctgctggggcccaaaccttacccctccccttcaggggctcaagaggagtctactaagataatttagaattgggaatgagtgtgtttcaaatgaatgcatgaaaaacaaatccacaaggtatatggcactgacttgtaataggcccatagaaatattctgatggagtacaacttcacaggttgccaaatgacagaataaggcaactgtttttatagttataatttgcaaaaaaaattatagatatatatttatatatgaatggtgatgcaatggtgagaataactgttcattctgtaactattcctatcactctgtagctttcatgctaagtagattacaaatatcattggatttgcataagcattaagataaatgaaatgttagggaaaatggaaggaaaaagaacacagatatgctcttttaatatcttggtaccggcattaatgtcttctttaatgtgatgtaacaatacttggctcctgggcagttgttttttttagttaataccgtatcatcaggaattcagtttcttcccacctgattagcagcacgccacctcactggaatctaggaaggagctaatgtatactgaaaccaaatctgatgcttagaaaatccttgagctattgaaaggcacacctgcgttgcttggtaggtgtactgaatctcaagtaaggaatttctgcaaatctcctgtttagttggctaaactggttttcactcctattgaacaaccccagggtgggggggatcctctatttctctttaataaccataataagccaaagaaataattttcaatgctaattccagtgacttagacctcaaaagtagaaaggctcagaatatgtttgagggcattgtatgtcttcgggtcaaatttatagatcagttagtagttttcatattggaaaagatctatagctttttgtaaagactaaactattgttaactaagatgttactttgaataatttagaggaggcaaccttttttgatgtattcacttttatatttaaattaagaatagtctcttatgaaatttcagtgaactgaatcctaaagaaaataaggaagcatttatcagtcgaaagtactctgtaaatcggcttgcagattaactgcaaaggttatttgggaactgtataatcttaaagcaaaacaagacatttatccattacttcttttcaaaaatctctatttggtccatttttattttctggacattctttttttagattatatgctactccataatatctttagaattctcctgacaaaactagcttgagaagcataagatataagacattctaaaataaaaatgtttgattcattacataatattatctaggtattaaagaaagttaacatttttcattctttggtcaggaactcatggcctccaacatacagctttccacagtaactatgtagtacatcctagggaagataaagaaaagagtttagggttgtccaacctcatagaaaggagaaaggaaaattaaccaagtccacaggcatgacgaccctagtctgttttagctgccaaaggaactaataatgctgccatttaagttttaatttatggattgtttgtggtgtttcccatcccttttaagttgaaattgtgtgttgcaatctctacagtaatagaatatttcttttttcaaagtattcaacaatnagtttaatattctttcttcctgtgatgcataccaccatccgttatgctaaattaactgtttatacacacatacacagagctcaactggtcagagctgtggttctcagcctgagtccacattagaagttttggaaatactgctaccaaggccacccccagagattctggcttcactggtgtggcgatgcggcagagagaagagtgttccaagcaggaattcagaatttgtttcttccggatgctatgttgcaacggtaatctgggcttatggatttttgaagtataatgggtagagctacattatgtgttaaataaactttgcagactggtttaaaacaccaaaccattcttcaaagttctttctttaaaacaaacaatgtgcctttggatccaaacagtggacttcatagcaactaggtgataaattaggaagtgcttgagtcttaaaggtcacagcactacacttgttttgtggcaaaagtaagtcagggttttgtctagtaaaaacaaagaaataatcaatttagtgagtatctaccataggcgagccacggtaaacaaagggactatcgaacaaggccaggaaataaagtattaaatttgtgtaatttgtaattttagaaaaatcagtaagaaatgttatggttagtgggttttgtgtttttcaaatagtaattggatcagaaataggcagattgttcaggaaggaatatggcatagaaataatagtggaaatatgctggagggcaaaaaaacagatgataaaacactttaaaaaggcaagccatacaaaagaatagaggatgctttgtagtcattgctcaaaggtgactgatttgcatagcaaggaggatgagaaggaagaggttaggaagatacttttttttttttttttttttttttggatttttagtagagacgggatttcaccgtgttagccaggatagtctcgatctcctgacttcatgatccgcccgcctcggcctcccaaagtgctgggattacaggtgtgagccactgcgcccagccagggagatacttcttaaactcagtttttaagtttagtttaccagtgaacctaacatgatacatcaggacaagctggggttcagagcagaacagtagggtaaccatgtctgcattgtcacccttgtacccattcacgaaagccatgggaccattaagcacagagaagcccactacctgccagccgctgcacggctgcaacaagagtaggacttacttcgtgttctcagagcacagattacaacattcgggtagacattgaagagagacagatttggggctcaataggaagaaaagcttttttaaagggctgtcaaaacaacatgaagaaaaacagaatagatacgttgccatgcactgaactgctggtcctgaagggtggagcatgggctaaacattatctctagaaatagacaggaacattgttttgagtgtggagcgtgtcctgctggtctacagtgattcttccaatctaagttttgatgattctatgtccagcttcctctcttctccagtcaccttgtcgcctctaatttcactgggcacccatttggttaaaaaaaaaaagtgacaaagggaaattaagaaattcttcacattgaaccagagtgtttctacctaaagatagtgacacagagggttagcacgagatttatcacagcagactgattgataggttttagacctttccttacttttggcaacaagtgaaacctggaagctcataacaaaactgcaagaacctttaagtggacaaataataacccgtgtccttgttctctcatttatgcccagatttgtggcctcaggagccagaagtacaccttgatctttatgtttaccttgagacagcaatgaagggatgaaggaatgaatgagtttatatttcaattaggcgtgagagatggaggtggtttaaaaaaaaataaaagacaagatagcagttttgactgggataacagcatcctttcatagaatagcctctagacctggaagctggaagggacctacagggaaaatgtgttgaacaaatgccctctgcgtagtgcattagtatgagtacaccagcaagatcaagatcgtcaggatgccccatctgctgctatcttgactttaggcctgtgccacgcaccgttttgccatgactttccgcatagcaccaggccaaaaagaactgcagagttttgagggcaaggccggtttccagcccagaatctgcaatgatccctccttgacaagtcaaacagagtcacccaaacaagcgtggcacgcaaacctttagagttcagcaaaccgagggctgagttaccaaaccgtgtcctttcagggcatgcaaaaggcttttcctgctctgcttctacaaggtagtcaggaagccaagctatttgccttgggtagggctgggtgggggtggtgaggtgggggcgcagcaggttgtccacacccggttgccagtctgaacctgagccgctccaacaagcgagcccttctccgcggccctttggctcaggggagcgcaggccggccttcctcccgcacgcgggcgcgggccagctgcagatggagaacccggggggcgaccgcgagccctctgaggcccctcaagggacagggcatgggtgtgaggggtcgcgtgcgccccctggcgccgggtccgctgggcggggtggtgggcggggacggtgggcggaggcggaggcgggaggcggagccccggggttgggagtgcgggggtcgcggcgcagagtgggagccggagagcgagcgcggctgcagccggcggcatggctagcacggcttcggagatcatcgccttcatggtctccatctcaggctgggtactggtgtcctccacgctgcccaccgactactggaaggtgtctaccatcgacggcacggtcatcacaaccgccacctattgggccaacctgtggaaggcgtgcgttaccgactccacgggcgtctccaactgcaaggacttcccctccatgctggcgctggacggtctgcatccccgcggcccccgccctcagccctccttccttgatggccagcccgctaggcgccctctcgcccccaatacccccagcgggacccctagactggactcctctgaggcccgacccgtctctcccmacagggccttagggagccagggacgctcctggtgcccgccctctcctgatggctgtctcgcggggcgcctgttcgagcctgggaccccgggaggggggacacgcagacaggcccgggttggtgactcccaggcgtcgggggatggggaagctttgcggtcctgagagtcaaggaagcggctgccctcccccaccccccatatcttggggaccgctgggacccagagttcatgctgcaggggcttgtctcctccacctccctcccctacgttccccgaaggctgggttctgataaaaatggtgtcattgcaagccaaatccgtttgtcctgacctcccttgagccatttcgttggttcttttaaaagtaggcgggggtgggggttgagaggttggaagcgggaaaacatattgcagaatttgttgttgttattgtttccctttaaagagcttctacaaacttgtctgcctaggcaacactacaaacacttcctccgagttttaggaaaataatagcccttgcggtgccgcgatgagtccgcagagggtagggaatcttgggccgtgagagcgtggcgccgggagctgaccagttctgcatccgagtccccggtgcctgctgctgtcctgggttgttcctttgtggaggttcacctgcgttgctctggttagtcaggccttatgctggtagcagctggtggatattcacacagaactctggctctgttgagtttcaagacaacagccgatgtcagcccggtcccattgattgctcaagttctaggcccgttgcttccaggattttacagcaaacgaatcctggcagaaacttaagaggagttatttacattacatatttctagatttgaggtgtttttttcttttattaccgcacttgcaggttttgtttacatagctgggtaaatgaaagaaaatagttgattcctctaagatggggtttgccacgaagagcaaactgttgctcaacgtggtatttgatggaacctccgtataaggaatacgcatctagttttagaagggtggcgcccgggtccgtgtcctgttcggtaaaataagcagccggaacagtgtttattccccagcattaccgttgaatttcctgtggtttgtagagcacgcatccaggtagatgaacaggcattctcttgttcctgtgatttatagtcagcaatgtgttactgtcctctgaacactcttctgttgtaactctattgttctctgagatagtgtgccagataggtacgcttccttctgtaggacagttgggggacaagggagagaaggaaatgaatgctctatgaatattattaagtgcagaataataaagttttctcctacatgtctgcagtgagagtggaggtggtaccatacctgtttgggggcagatcgggccgggagtgaagaggaagtaggaatagttgtcctggttagctgggaggagaacagagaggagtgacatttttatgccatccagcttgcaaaatggccttcctgtgtgctcatgtgactaaaaaatgacttttaaaaacataaatggcatgacactacctactgttgtacaacactttaaaatcaatgtatttttccaagtcagtacttaatagaagtgacttgactctgtgtaactgctgcatggtatattcattagactgcataaaatggcttagttaaccatagatccattgtggacattggaccttttccagcttttctttgttggtggtgctttactgaaaatcttatattcacctctttgtatgtgtgtgtatttctgtagactccattccactgagaaatggtatcgtaagagcagtagaatacacgtgcattttaatattcagttcatactgtcaaattactttccactgacagtgtatgagaatacctgcttctccacattctcaccactctgtgttaatccagttttktttttttttttttttttgagacggagttttgctcttgttgcctaggctggagtgcagtggcacaatctcagccgactgcaacctccgcctcccaggtacaagtgattctcctgtctcagcctcccaagtagctgggattacaggcatgtgccaccatgcccggctaattttttttgcatttagtagagacagggtttcaccatgttaggctgrtcgcgaactcctgaactcaggtcatccaccctcctcggcctcccaaagtgccgggattacaggtgtgcgccaccgcgcccagccatcttatcattttagttggcatttcccttattgccgtggtcaaaatcactggttataaaaatggtcaaaactcactgaccgtttttttttctcttttgtgaattggcatccatatcttaggcccatggttctgttgtttctttgtggtttcgatgatttgtcagtccttgatttgttatgtaggttgcaatctcacaccattgttcatcttttaaatttatgatgccttttctcayacaggactttgaaatttgtaatagaatcatatttatcagcctgtttttttgatgactttccttctgtggcttaagatggcatttcttaccgcaaaacaaacttacttttctgtatctctcagaataacatcttggagggttaaatcatgcaactgtgttttcctgtggaggggagttgattcccccacctgcaagtggaagcttccagggtaggggccctctgtttgtcctctaccttgcattcccaggtcagccacatctggtgggtgctggtcctgacattgcctttggagaaagtggccatggtggcctgagtggaacagccctccccttaaacccaggtatgagctctagattgggaagagaatccaggaagggagagagaaggctcgtgactcttgcctatcttgtgttaggtagaagaactcttggagtcaaacgacgaggtcattattctgaatttcttttctttttttttttgagacaaagtttcactctgtcccccaggacagagtgccatggcatgatctctgctcactgcaacttccacctcccgggttcaagcaattctcctgcctcagcctcctgagtagctgggattacaggcacccactgccacacctggctgatttttgtatttttagtagagacaggktttcaccatgttggccaggctggtcttgaactcctgacctcaagtgatctgcccgcctctgcctctcaaagtgctgggattacaggcatgagccatgcgcccagccctaaatttcttatataaagaaatctctgattcccctcccctaggggtatcattgccacttgttttccttataagaaaaatgaggcctagcaaagctatatgtctagatttaacgttatgccatattaagaacccagctctaatttctgcttagaatccattgtagtattataatatgacgggatgctttgatgactttcttactgctcagcagacatccatattattcatcctgtgaaggaggtgctgccatccctgttttacagatgagagaactgagcctcaaagagattaggtcctataaccaagtacataccttgggtaaatagaagcaccagaggtgaaactcagagttcctgccctccccataccactgttctctcaaaggatttgcagaagtacacaaagctaccaggaaaagaaaagcacattcttttttcccccctaaatccatcaactagcacaggtgctattagcgaattgtctccaccaagtggatgttttcgttttttgctgatttgcaattgaaaataaagtacacataatttggaaaacacttaacttttaaggaacaccttgaagctttcctccaacagagttcattaatttaaagtcactgtattttactatttgaaaatttcacagctgaatgagcttgtgatttctgtttattgttaacccatactcctttcaaagtaccacttgaacttcagctgagtatgattttcagccagcttgtttttagtgtatgccatctatttttgctagtgggaatgcttgccatttctcccaggagaactaactataaattatacttcagagaacttctaaataaatatgttcatgcctcagcaccttaatgtgttaattagctattaacagtgtcagtaaattagacctgtcaaaaataatggcctccttgactaggtttttactaacacttctcctggtggtgttacttgtaagttttgccctcaggaactgttagaaagcaaggctgtagaggtctgctttgcaaaagatgaactctgaaagggtttgttggaatcatcttggctccaatctgtgggtgttgtaaggactggtagccttagaacactgagaatttacaaatctcaggcttacgagcaactccattacatttatggctggcaggggagtttatcccctgctctttgctctccatttcagaaaatctggccaatgatcgtccttgtaaattgccttctttgtgcatgcgcaaaattaacaagttatggctgctgttcatgctggagaaaggtacctcattttccaaatccgggttctggttggcacaaaagaaggacctgaccagatcagaatctgccctgcccacttctyctctcatgcttgtgtcaagagaccaaagtgggtcctgctgccaataccagggctgggacggggcatctcagagtgagaaactcgggaaaaatgttatcagtggtgattacataaagttcaaagactactgttattttccctgttgtattaagaatcgaatgggttggcctgggattctacccactgtttatcatctgggaaatgcattccgcgttctaaatgaccagattgtagaatttaacctttggtaaattcccgacaacttgcactttctgttaacaaagcatggaagtaactaaaggcaatgcaaattagggtacatgctaatgttttctgggagtatatataaatggatgagtcccccatttttttgtttatttaatgactgcagtcagagtcagctataaaacctcaaaaccatagattaaaatgaatttcacaaaaagagcgaaaccacactgtccgagtagccctggtggcaagtgatgaaccagtttgggttatcctcacaggctctcttcaaacttgcaagggactgacaggcttcccctctctgtcttgcctctacctgctgtctgggctctggctggggagctcgaggactgaagtttaaaatacagctggttcagcattyggcagcggagacccagatagccctgcagcacaatgattgctatgaaagaagccttcattatcctgttttgctaaaaataagtttgttttgctgtttttgatagccacgrtgttagtgaaattgttttctgtatggaaatatttcacactacacaatggaaggtcactgtccttgcagtctgcatttgtgggagtctaaagtgtttacaattaagtagagcagctcctgtttgctcttcaaaaatgggtccaaggaataggattaaaacttcaatttcattcttttccaaagaaacacagactggggccaggtgcagtggctcatgcctttaagcccagcattttgggaggccaaggcaagaggatcgcttgaggccaggaattcgagactaatctgggcattacagcgagacactgtctctataaaaatttaaaaattagccataggtgggggcaagcgcytatggtttcagctactcagaaggctaaggcaggaggatctcttgaacccaggaatttgaggctgcagtgagctatgattatgccacttccctccagcctgggtggcaaaagtgagatcctgtgttaaaaaaagaaaagaaaaaaagaaactgaactggaggccactagtatgtactccctaaattcatgattatcatggtctcggaattattatttatcatggctctgcttgaacaccaataataaatgacttatcatatattgacacataagaggttttttccagttaaaaagtttaattccaaacgtaaacctgatgtaggtatatatgtttatttgcttagcagatacttacttacacccggtatgtgctactatcactattttagatcgaaatatggcattgtttcaggctgaaatgaaaatggcttatgtggtaaaagcttattagtttaaaccctgttaatgtaaaaacctggacaaaagccacactgaagtttaccgtgtaccctggctgtgcaaataaaaatacatgactaagaacatgaatagcacaggaaggatgaacaaacgaactgacagaacatactcgttagggtactttaaaggcattcatttataaaagaacagttgacttaatcactataaattactcttctacaaaatagtgctttttaaaacccagttttattatatacaccctgaaaacaatagtacttcactaaagtattcccttagaccccccatggttcatgatgatattccagttagtctgctattaataagcgtccactaatattggaaggtttgaccctttggatctctttctgccacccagttataaatcttatcatttgataatgtcaaaaccattaaaacacccttttaaagtccaatgagcggaggagctacagagttgtgatggtggcagatgatgttttttcacagtgaaaggcacctttcactgtggaatttcactatatggaattngtagtctgatttgggatggaatccatgtctgccactttctaactcacctctggtaagtcacataacctttgtgtgcctcagtttcctcactggtgaatatggaaataacactcagatctatcctgaggattccccataaaccgcacttcacagtgtgtgacctagaatwggcactccctgtagattaacttgctttcctttcttgcttgtcttgccacatgttttcaccatcacagttatctttttggaaaacaaacatccagaatgacaacgtaaaatgaggatttctccctggacagccacatgctttatgtaacgtaaatgacctactctaattgcaggttatatmcaggcatgtagaggacttatgatcgctgctgtcagcctgggcttctttggttccatatttgcgctctttggaatgaagtgtaccaaagtcggaggctccgataaagccaaagctaaaattgcttgtttggctgggattgtattcatactgtcaggtaaatagtaactttcttccaaacaaggtacttgatgatgttaatgaaatcacactaaccatagtgctttccctctaatatttgttagggctgtgctcaatgactggatgttccctatatgcaaacaaaatcacaacggaattctttgatcctctctttgttgagcaaaagtaagtrctcttctcagtctgtttccagctcacaggaagtgtatataaattaatattctcaaccaagagacatgaatttcctatatgacttttgaaagtaagacatactgataaatggtaactgatgacatcattcaagattaaatgtgtcatatgccacatacgcaaaatatgcatttaattagtttgctagtgttgcagtgtcttgtctcgaaacagttcaaggcatcaaatttagaactataaacttcatcgtytgctgtacatcatgaaactgaggtcaagtagaggaaacgtgaaaggtgtcagacggagaggaaagaatgatgcggtgtgcgaatagaaaattaaaaccttgccttgattgttgcccactcaaaatgatatttgccagatgctagtttctgggtcttttaaatttgctgtattaactactgtcttaacaagctcctcctaataaacctttataaagaaactgtatacgatgcaaggtttttgaaaaatgctgtaggagcacggcacctttacccaaatgtggctggtcagtcttgcagatgaatgctttggaattaacagatcagtttgcttgttggtgttgtttttaaactatgggctgttgctttttatagtttccctaggcttatttctttggattgggaaaaccccagggataccaaatcagaattaatatattaaatattttgtcttacctaagaatgtatctacatccctctttaggaagcctcacgtacgtgtgtgtgtattgctatcaatgaggctggtaattttattttagacttcaggtcaaattttatagaatttttaagaagtatattactgaaatagctggtcagctgggctttactttttttctggtggttttaggaatcttcaggaaattgattttctagttctggcttaagtgtaccttacgcataaacagtaaatgcttatatcatgaaataaaatgaaaataatagctagcgcatgttgagtccccaccaggagccaagcagagcactgcaaatattattttattgtgttattttattttattcttacaaacaaccttataaagtaggtcctcttggtactctttttttaaattgaggaaagaggccaagtgatgtgttcaagggaacttggaccaaactagtaggctgattgaactgggattcaaaccaggcagttgaacttcagaacactggctcttaaaaagcatgatttctaatattccactattttgtaatttttgtgacaatatgctacatgtactgttcatcaagaggtttctttcgtcctttttttttttttttttaagagttagggcctctttctgtcactcaggctggagtgtggtggtgtgatcttagttgactgcagccttgcgcttctgcactcaagtgatcctcccacctcagccccccgagtagctgggacatatatgtgccaccacaaccagataattttttttttttttttgagatggagttttcgctcttgttgcccaagctggagtgcagtggtgcgatctcgactcactgcaacctccatctcccagggtcaagtgattctcttgcctcagcctccttagtagctgggattacaggcacgcaccaccatgcccagctaatttttttgtatttttagtagggacagggcttcaccattttggccaggctggtctcgaactcctgacctcaggtgatccacccgcctcagcctcccgaagtgctgggattacaggtgtgagccactgcgcccggccccggataatttttacattttttaacggagacaggtcttgctatgttgcccagagttgtctccagctcctgatcttcaatgatcctcctccctcagcctcccaaagcactgggattacaggcataagccaccatgcccagccttttctatacatttaaaaatagtttttattcagaaatgttattaaatgggaaagaaaaacaaattttattaaatgggttttagacctcaatataacttttttatcccctgcctataatacaaaaacatgtcctaatttattaattttctcctacttatctttcaaatgagatttgcacagatgtacatggcaggaaacattgaaataaaaaccaaggctgtatttctgaagcttagaaatattttaatgatatttaaaagaaatattgtatttaaatgatacatttttattttagggtttgatatcataaatatgcagcaaacctgtacttctcatggtttattttattaaacacatttctcactcttccgcattatcttttctatattactggttttattttcctgacaattattaaggatatctttgtctatatcttaaaaatcattggactctttcctcaaatggtcaaggctaatttgtgtacaaacaataacttaaacctatctttgcgtgactgttttctgtccttactatagctcagtcacctaattcagtgtagtgccattggaatttcttattctcttttcagattttgattaaactcagttcagtaattaggtgctatgagaggctttcctctttttcaacctcttggtgctacattggctattccattctcattagcttcttggaatttctctttctgtctctgcctacccactctctctctctctctctctctctctctctctctctctctgtctgtattctcatctgtaaaacaaagataataatagcatacctctcacagaattgctgtgagagttaagagaggagagagagagagagagagagagagatagatgtgattggcacagagcaaacaccttgtattagctcttattgtgttatattaattattattaagattgctttttaattctgtatagtatgtaagatgtggcttatctttatagatgcctttattagctcttttctgcagtggcttaaaaatataacacctacaattcaccaatttacctaatgtaattaaaagcacaagaaccaggggtcatgaaaaacagcagtgcttatccattggtaatatttacaaataacaggccctttgcatcaaggtctatagaaaatatagactataaaaaacctgatattgagaatgagttgacttcttgagattaggactttctctccttcatctctgttttccctgcagtgcctttcacaaagaaaggtcctccatgatttcaacaaaatccagttggatcaaggaattatcaaggcctgagaattgtagataccatcagattctaattacccacaatgatagaaaaggggcataaaaatgacatgacacccacaagaactcagacctcatttaaacaaaacacacttgtataaaaactaataaattaactaatatgacttcacttggtttccgtttatcaacaccttctagtagaggggataaaaactgggaagatgaataagctataaattggctatcagcacaaaatgaactgatttcctagctctcaaatgtcatctttaaagcaatattttattttggcttattctagggatagcacttctctggctagcatttgctggaatttgataattgatgcttctggttttgtttgtacatgaacttagagaggaatacgttgtagaatcaaagcttgtggcagggccagtcctagataggctgggatgtggaagatgccactataggaatgttctatgtctttggtgtcttaatcagctggcataagaattaagttccttgaggtcagaaaacgtctatgcaactgtatcttctttccctagcacagtacctagaagtgaaattcttatgtgtagacctagtcctttcagaattagcaaagaaaattgttgtctcagtggatagagggagcctcccagaggatggagcaagaaagctctcttcttcccattattatcttacattaatcttacaaaaactagctgccactaaataccatctctccctgcaggagcatgtgtgtttgggcccttaggaagcgcagtgagagacagcgacttgtcacatgttctagtttaaatttctggtgagcaaatacttgctctccaatacccaacccctaaggaaaagagtttagacctcagagcatggttttgttgttcttgctttgctgctgctcttgtttttccttcagatttgtatgccgtgttaattggatcttctttgtagatttccaggacaactctacataaggcacatcttggttgcccaagttaggaaaacacaactaagctcatgaaccaagttccctatacattcctgctatatgcaaggaactcaacaggagctttgttgatgaggaaaaaatgagtggcttctagcatggacttggagtaaagattgcagcaggcacatggcaggcagtattgcactttatgttcagtggctagttcctctaaaagtccttcctttcccaccacryatctgggaagatttttcttccgagctacaatcatttgacagaactgcaatctgtaaagagtttcatcgtgttctgctatttctctatttttcccttttgttttgctttttttcattcgagctatgactatgtttgatgactccagcatgagctcttgcagagccttgaaaactgtttttcaacttttccctttaggctgtgtcaaactaacttcctcctttttattaaaacaaaaactaacaaatctgaaaaaaaaaaaatctcctgcaagcttctagtaatgggtactccttagcatgattcaccataccaggatgttgaaatttaattacgttattcccaccattgttttgttatccaaaccactaactttctgaatgtccagctttgttttcttagataaaccattgcaagtaagaattgatcaacattaagaaacttcttttcaaatcatgcaaagttatacgacttaactgattgctctggttgaggaagtagaacagaattgttgtcttagacttattctttttttgtatatgacatttaccgttaatattttggcccagctatttttgtgttggggtcttatcatcctctaggcttatttccagacttttcaaaatcatgtcgcacttctcattcctggcatgtatttggtttctactttaggatttaagctttatataataaaatattttcaccattgtggctatttagtagttagaaataaacaactacctactttctttttttattattattatttaagttctagggtacatgtgccccacatgcaggtttgttacataggtatacatgtgccatgttggctggctgtacccatcaactcatcatttacattaggtatttctcctaatgctatccctcccccagccccccaccccctgacaggccccagtgtgtgatgttccccaccttgtgtccatgtgttctcattgttcagttcccacctatgagtgagaacatgtggtgtttggttttctgtccttgtgatagtttgctgagaatgatggtttccagcttcatccatatccctgccaaggacatgaactcatccttttttatggctgcatagtattccatggtgtatatgtgccacattttcttaatccagtccatcattgatggacatttgggtttgttccaactctttgctattgtgaatagtgccgcaataaacatacatgtgcatgtgtctttatagtagcatgatttataatcctttgggtatatacccagtaatgggatcactcagtcaaatgctatttctagttgtagatccttgaggaattgctacactgtcttccacaatgtttgaactaatttacactcccaccaacagtgtaaaagcattcctatttctccacatcctccccagaatctgttgtttcctgtctttttaatgatcgccattctaactggcatggatggtatctcattgtggttttgatttgcatttctctgatgagcagtgatgatgagcattttttcatgtgtctgttggctgcataaatgtcttcttttgagaagtgtctgttcatatcctttgcccactttttgatggggttgtttttttcttgtaaatttgtttgagttcattgtagattctggatattagccctttgtcagatgggtagattgcaaaaattttctcccattctgtaggttgcttgttcactctgatggcagtttcttttgctgtgcagaagctctttagtttaattagatctcatttgtctattttggcttttgttgccattgcttttggtgttttagtcaggaagtctttgcccatgcctatgtcctgaatggtattgcctaggttttcttctagggcttttatggttttatgtcttacatttaattctttaatccatcttgagttaatttttgtataaggtgtaaggaagggatccagtttcagcttttacatatggctagccagttttcccagcatcatttattaaatagggaattcattccccatttcttgtttttgtcaggtttgttaaagatcagatgsttgtagatgtgtggtgttatttctgaggcctctgttctgttccattggtctatatatctgttttgttattagtaccctgctgttttggttactgtagccttgtagtatagtttgaagtcaggtagcgtgatgcctccagctttgttctttttgcttaggattgtcttggctatgtgggctctcttttggtttcatatgaattttagagtagttttttccaatattgtgaagaaagtcaatggtagcttgatggggatggcactgaatctataaattaccttgggcagtatggccattttcacgatattgattcttcctatccatgagcatggagtgttcttccatttgttcatgtcctcttttattttgttgagcagtggtttgtagttctccttgaagaggtccttcacatcccttgtaagttggattcctagatattgtattctctttgaagcaattgtgaatgggagttcactcatgatttggctctctgtttgtctgttattgatgtataggaatgcttgtgatttttgcacattgattttgtatcctgaaacttggctgaagttgcttatcagcttaaggagatttggggctaagacgatggagttttctgaatatacaatcatgtcatctgcaaacagggacaatttgacttcctcttttcctaattgaataccctttatttctttctcttgcctgattgccctggccagaacttccaacactatgttgaataggagtggtgagagagggcatccttgtcttgtgccagttttcaaagggaatgcttccaggtttgcccattctgtatgatattggctgtgggtttgtcataagtagctcttattattttgagatgtgttccatcaatacgtagtttattgagagtttttagcatgaagggctgttgaattttgtcgaaggccttttttgcatctattgggataatcatgtggtttttgtcgttggttctgtttatgtgatggattacgtttattgatttgcatgtgaacaactacctactttcagtcaaattatctcattcttgttgtcaagttgaatggacactagacaatgtaagaagtaaatttctaggctatacagattttcctgggtgaggttgaaaagaatattgacctcatcaggtgaccttgtcaagatgtttaatttctctcttctatacttattataatttaatacattatggatgtttgtttatttaagtttactccattcatgagttatttggaggatgaactaatgttggtagtgatctcacatattctcagataggagattccagataagtgccaagtggtaagaacaaaatagagttcaactgttaaatattaagaaagtgttactcagtggtttcagtttgttcagaaatagtgcaggccacctcagatcaccagaattacttagatgcttttgttatgctagcatgacctaaaaatctgcttgggaactaaatatttggcgctctcttttgtttttgctgacyagtgcrtgacatcatgatttctgccagcgtgccctgctttctggtaattcagctcttacccccattgctcctctccttttcacatcctggctaacctctgatcagccttcagaacctgcattttgggyggggtgtccctgttttgggtgctccctttctacctcgtgcttccatcctaaccctactgggtggtttgcacctgcttatttattggttgttctcctaaacaagaccacaagcatctagaagtcgaaaccatgtgttactcactttggaatctcttgtagaggacccatgctccatgatccttacagcaaggatggtaaatctgcagtggtgtaggactgtctgtctgtctgcatatctcctrgaatggtaagacggagtgtgcttgtggtgatcgcttaaaggaacasggagaggcagcatggcacactgttcaagaataaggactctggatccaggctgcctgagagtaaaccctcgctctgccactttctagctgtgtaactttgaagaagttacttaccctttctgtgcccagtgcccttcatccgtagaatgaggataatacatactaggaggctgttgtcaggattaaatgagatagtatacttcaactgtttagaatcatgctagttcatagtaaacacttactaaatgctagctactatttttagggatactgaccctaatgcacagtatattaatgtatagtatattaccttatgtaatctattaaggttagccacagagaaatgtatgttgaaatgttggagacctagtagaagagacaattgttttaagacacttggctctcaagtagaaggcacgtttgaaggggacctagcatgaaactataaggcttggctgggtgcagtggctcatgcctgtaatcccagcactttgggaggccaacgtgggtggrtcatttgaggtcaggagttcaaggccagactggccaacaaggtgaaaccctgactctatgaaaaatacaaaaatgagctgggtgtggtggcaggtgcttgtagtcccagctactcaagaggctgaggcaggagaatcacttgaacctggggggtggaggttgcagtgagctgagatcgcaccactgcactccagcctgggcaacagagggagtgagactctgcctcaaaaaataaataaatagatataaaataaaataaataaggcttgtgtaatttaaaaattgttggtcacctctgtcatagcattgagttagagataagtaataatttaaagttgtcaactggatactcttggttcaattctaaaatgtgctcaggtaggttacttgaagactgaataaaatgtcagatacgccttttttttgagacggagtcttgctctgtcgcccaggctggagtgcagtggtgagatctcggctcactgcaagcaccgcctcctgggttcacgccattctcctgcctcagtctcccaagtagctgggactacaggcgcccgccaccgcgcccggctaattttttatatttttagtagagacggggtttcaccgtgttagccaggatggtctcgatctcctaatgtcagattcacttttgattgacccaagcttcttttgctgcaagtccatctgtatatttttacctcaacacaaagccacgtacacccacatccacacacggattcttgacccatgcttaccaatactggccatgccctaaggcagctcaggacagtatttgttattttaggaatttcccatcttgaagcacagccttctctgtgatgtcagtttattcagacttcaaagtctgcatgtaaacctgttattgtgcctactgtaactattatgactcggtgcctcatttctcacttacggccaagcaaaccccccaattatccacacacgaatggagatcaatggcatggatggtgctaagcaactgatttggttttgaattgaactatgtgacttttggaacatgagatgttccttttacattacagtttactttggctaacaaagattagccaacattagatttagtcctactgtggatggtttttaaatttctgtgaataattttcaagaattagtacttctgtgtagacactcactgatcactttacacactattagagaggcaggtggtggagaggagaagggtgaggttttggagtttgactcagctcagatcctggcccgggccagagtcctggcccttactctactgttatattaggtagattgcagttgtcttgactggataacagaggcaatatttcctgttctgaatgttaagaggattagagaagataacatattggggagatattggcccaaagatatgaaatttcagttagataggaggaataaaatatatacataatttaaaaatgtatatatatatacacacacacacacacacatatacgtgtgtatatatatatatatatatatatagaccagttttataactatttataaattcatttcagcattcctgattgcctaaatatgtttcctgaatttacctttggacaatttgtaacatattatgttggtgcaaaagtaattgcgtttttgtcattgcttttaatagcaaaaactgcaattacttttgcacagacctaatatatctgcttccctaattagttaatgagctaaataaaatccttgaaacatgttcattttagaaaatacaaagaaaacgtctagaaagcatccaccacagtgacacatggtaggtaatcaatcaatgttacctgttattaatatatacaatttatagaattctgaactaccctaatgaaaatcacagtgcatggaaggataatgggcatatgtctgttataatctagccacagaaaagcagtttttttgtttaggtaccccctcccaaatgtctttattttaggtttcctaaatgtaagaattctctatgaagtttccatatataagtagacacttataacttaaatttttccatcctactttagccaccatttgggaggcacctgtcactattttgcaagtcttgttggatgccttgggtaggaagtcctttggcatctgccaggcagtgggagagaacccagcagagggggaggctgagcgtctcataagagagactggaccatggcagcctcagagagatacgcaggatcagcgggcaccccacataactggggccccaaaagaatgaggcgtattttggggaaatgctgataattgctgtagaatacttatataaaaataaaatcaattcatgcagttatatagatcttagattatagattatatttaatataagacaatgcactgaagaaaaagttttatgttagaccaatagaattcaattttgaaatgttaactttgataatatatgagtgtactttctggattttaaactttgtaaaaaaacctatgtagttattttaaggtaattggaaaatgcattttggctgttactactcttgattaaaatgaggagcaggacaatatgtttgaaaaagacacaatattgaaggatgacaaaagacctggctcctagctctgtgaccttcagcaaggtcgcttcacttctctggggatcttaaaaggatgaggtgctttcgtttgttaaaaccgatcttgctttgttttgggagtggctgctctttcctttttcagctccaacatgccctgattttaattggtatcctcacctctttttgtgccggaagaaaaggcagcccgagggcattcagaaaaaaatcctgtgccctgaagctcttgagccactgagaacttaatgagccagggagagagacaactccgatctttctgaaatgacaactaaaaatatgttgcattgattgggttttttatagttataaaatcttttacttaaagtgtacataaaaggatgatggcatgacaattaagagcttcggtttgcaatcacagttatgggttttaaatcctgggtctaccatttacttggctgagacatgaaggaacaagtaatttaatctcccagagccttagtttcctcatttgtaaaatgaggatagtaatacctatctcccaggcttgtgatgaagattgaatatggtaatatttgtgaaaaaatcttagcacacaccgaaaagtcctagtacaatgagctgacagtaatagtagctattgttagctactatggacattgacttgaaccacatctgagcgtgtttgggagaaccacggtaatgtttactttgcaaaaacatgctctttttattgtttgatcacactttactgtaattatcagtttaatgtctgactatccccactagactatacaatctggatctgtgagccagggccatgtccctcttatctgccctgaacacctgattagcacaatacctggcatgtcatttctgtgtaggtaaccagaggaggttacaccagctccccatggatggcaaacctaaytcagaatagggatttgggtgccaggaagacaaaagcaggaggtgaaagtaagttgttcagcattccatttccttaggattactctaaatggctaaactacaagttgaagtatgaaatgcatcagaatcaaggtctccaggttggtgtagccctggccagctcaacatgaaatgagagccatgggcaacagcctacagcaccacatacagctgggtggagagtgacttcaccttagatctttatggtttcttctttgagaaaataataagtggttatctgtgttttaatttctgttagaagtaaatttgttccacattccttgtttctaaagccactcagtgactttattaatgtgtattgaagttatacgcgcagcttttgattagtccatcaccaagatcctctaaaaacaatgttttcctccataaatgaagttctgtcctcaacctgaaagtcatggatatggattggtccagtgtcatgtagatttgcaacctttcagaataatgaagaaactttggtattagtcataaagagggcacactctgagcaggaaggctggccgagggccaggaggatattgttcacaaaagacctgcaacagagaatctgaaatttggataatcttaccaaggtgttgaaatcagcttcttagtgttaccgaaaaggaagaaagatttccagacagagactaaataagtctcctaatcaatgtgaaagaatatgtgccttgggaacaaactggagtggatattatgttcatctctttctcaaccctgtctttcaataacacacgtcagttttttttgatatttttaaatttatttttatttttatttkgtgtgtgtgtgtgtgtgtgtgtacctctaagttctagggtacatgtgcacaacatgcaggtttgatacacaggtttacatgtgccatgttggtttgctgtacccatcaactcgtcatttacattaggtatttctcctaatgctatccctccctcctccccccacaacaggcccccgtgtgtgatgttccccaccctgtgtccaagtgatctcattgtttaattcccacttgtgagtgagaacatgtggtgtttggttttctgtccttgtgatagtttgctgagaataatgttttccagcttcatccatatccctgcaaaggacatraattcatacttttttatggctgtatagtattccatggtgtatatgtgccacattttcttaatccagtccatcattgatggacatttgggttggttccaagtctttgctattgtgaatagtgccgcaataaacatatgaacacatgtcaatttttgccagatacacacggagaggtgtgaattaaagtcactgttgagtaagtctgtgatatgtgtctttcaatagaaagaaggaaaagtctctgaaagaacaaacaagagccctcacatccaaattgttaaaaaaaaaatggggtagatgtatggtttctgaaatcatctccaaatggatactgtctattaaatgtttgtctccaacataattcacactgaaatgcaaatggaaatgattttttccttggaatagagtgaatatgtagtgacttagatatttttcaaaaagggccacgtgtggtggttcacacctgtaatctcagccctttaggaggctgaggtgggtggatcacctgaggtcaggagtgcgagaccagcttggccaacatggggaaaccctgtctctactgaaaatacaaaaattagctgggcatggtggcacacacctgtaatcccagctactcgggaggctgaggcaggagaatcgcttgaacccgggaggtggaggttgcagtgagctaagattgcaccactgcactccagcctgggtgacacagtgagattccatctcaaaaaagaaaaagatacataaaaaaggatatatttaaaaagatattaaatattaatataagccaaactcatgattcctaaatttctccagaaagtttcaatatggcttaacatagacccaattcctcatccgcctgggtaatttatcctgtgatttgtagcaatactgtgtctgtgtttgtaatgctcctttcagtgaactcattgtgccaagctatgcttatgatttctatcatcttcatcccccaactggccactattaataattagatatttatttatttgtaatcaaccatggtatctggcactggcattctattttagtgaagctcaatattttcagaaaaatctcagaccatgttttcagggcatatttacactaagagtaatattaaggtatagtttcaggagagaagatagcctaacctgtactgggaaaaaaacagagaaaaatagaaagcgttatacaattatagtcatcctataataatgtacttcatgcagaatttttcagttatgctcattcctttagttgtctgcagtaaaaagggtgccaacagacagatctgatgccatcttctaggatttccaggtgtttcaggggccaaatgacatgcacctccagtttggcaggcatgctgcttgttgtctgtgcataatctcattaaaacaacataaaagcagggctgattgcagaaatccggggcatctttttcaggtgtgtaacacaatatttaatgaaagtatcttttctgaaactcccggtcagcactcctgatttagccagctcttttttcacctgtggacttcgctgctcagttcgtgtgtgtgtgtagactgagggtgtttttcctcgcttatacaaaccctctgtctctgccattgccccttaagggaacccgctgaagtttctcagatgccaaagcacagttagtgctccagggcaggaggggcttccccctagttattctgttgcagctgttccttgccccatcagtcaccctgatgtcccaggaaaggcaacacaagagtgagtaaagaaagggtcacagagcagcatttcttgtgcacgtaactccatcccaaatgaaaatgcacaagtgggccccgtgtccctgatcaatgtgatatgtgtcttaaaatactgaggttcactaaaataggatgccagtgccaggtaccatgcatgcttgattaaaagcacgccctgcttcctgctcccctggctagtgatgggcccaccctattacaccaccctgcctgcgactcagaccacaccagaaagcctgcccatgtgcagagccagagttcagagatagtgacacttcaagtaggcaggggtgcagcaaggctcaggacgaacccaggcagcactgggtggccttgatctgataccgaagcctggcctcagctcttgaacttggctcccctgcacccygaggaaggaactaaccctgggccctgtcttgccttctcctggacctcttactttcttgcctcatctcccctatggattctgtgcaatcaaaacagaccctccgaccctggctttattttacactgaaaagcaccaagatttcttttgccttgcaatggaagtttatgggccccaaataagagttactctttataaaaacaaacaaacaaaaacctaaaatcaacctattcttctggagaaagctaaacaaacatgagaacacacatagtccctgaaattttggtgtacttttctcattccttgttctctgggtgaatatatctcccctgaaaggatttcctctagtccgctactgcaagtgatcttgttttttgtcctcagtagcactgttcatacctttgtttcgtggccttcccaggggaagtactgtcttgtttatctttgcatctgctcctgctgcggtcatcggcagagcactgtcacctgccatatgggagatccttaatagtaatttatcactaaatgatagctattgattcatttccccactagactgcagcgattagtgacgatttgcacatagcacgtgcttaataaacatttactaaattgaactaacatgaaagcaaaagcaaccttttgttttctaactaactacagtctgcctaaatgatttgcgctgcagaacagaacaaatagatggaaagcttggcaaggttaaggcagcgtgcagaggaaaggtgctggctgagtcaggagaccctggctgtgactacttttgctttgactttgcccccgtggatgccctcatctcctttcaggatgttgggatggtctaatggctataaaaacactttgggaagmgtttacagcattttacagacacaaggtgttattatttcctttacaattttcaatagcaaaaaaacataataagcatttagtaaatgttgactatcagtgttaaatactgtttactctccaaataagtgagctgtaatacttgtgtaatgctttctcacaggtatgaattaggagccgctctgtttattggatgggcaggagcctcactgtgcataattggtggtgtcatattttgcttttcaatatctgacaacaacaaaacacccaggtatgaaaaagagacaaaaatgacctgttaaaaagtagaatgctatcataaatcattacatgtggaacaaattacagatagttcatatgattcttagaaacttccaaaatccggaattggaaaaggttagcagtacagttaattttttaaagttttaccattactatattycaaagaaaattctaacgtagaaataagggtctgaatatgaggacatgttcttcacgttggcctcatcataattttcctctaggtaggcaggaatgttgatggcctctactaagtctcctagcttccaggagggtgagttttaaaacatggttttgtaagaggataactgaacaaatgaccaagtcatgagtttcttctgcagagattctccatcccactcagaaatgacactgaaaatacttcttggggcaagaggagagaagaaagctatctaagaaagaggaagatttacatttagatattggcagagacaggccgaaacagtttcttcccatttttgtttgccctatgtgtagaatagaatctaccaaactatgttttacctttcagatacacatacaacggggccacatctgtcatgtcttctcggacaaagtatcatggtggagaagattttaaaacaacaaacccttcaaaacagtttgataaaaatgcttatgtctaaaagagctcgckggcaagctgcctcttgagtttgttataaaagcgaactgttcacaaaatgatcccatcaaggccctcccataattaacactcaaaactatttttaaaatatgcatttgaagcatctgttgattgtatggatgtaagtgttcttacawagttagttatatactaatcattttctgttgtggctttctataaaaaataaacagtttatttacaggatttgtaaaatgttttctacatttatatagaacatgaaaagcatttagtaccaaaggttcaagaagtattcgtactctagcctttttaatcattcatagatagaagtctttgtacccactccttatgtttcttttcattcataaacaggtgtataaggaacaatgtcttataaacagcatgggggcaatctgagaatattcctcaaaaggtgtccaggttaaatagacatgttactggctgcacacaggcaaattctagtttgttttttttaagtattctacaacatttatttaaaaaggtaaatctttttgttgaagcagcaagttatctggtagaacttaacttctacaggatcagagaggatcttgctcattcatggccatatccacatgcccatggccactcagtagattgttgaaaaagcaaagccacaccattctctttgatgtatgcagagagttacgtagcaggggatgttctctgatttattccactggcaccattagtgaatatttagttgttttcataaacgatgctgtgatgaagactcatgtacatatttagcaaattttggtttcttacatgtgcctgtcatgactgtaattcattatgactgctccaggaagggctaatggggccaatatattattgcctgtcatgtggcacatccatgttaaggggctgaggcgtccctggcacggaatgcagagccctgagctagggcatcagcagaagctgagatagagatattggtcatggttgactgaggagccaattaaaacctgtttatgcctagtgttccattattggaacactaagcatgtgggagttatttatatcctactgctcaaggtcatcgccaaggtgtgattggaaaaattcaaaaaattgcaacctcaggcataaatgggttaaggacatcccaagcccaagtggtacgtgcctcactcagaactgacgggccgagttctatctaggtgtgtcttccagaacctgtttacggctaactggataactgagagacttgtcatttctaaagacatttaagttgctccagggatttctgaaaaaagacacaggcttcttcctagagccagccctatataacatgcccacaagggcaacagttatcacagttcatacacacctttcatgtcctgtctcactcactcctcacagccatcctaggagatacatattgttttcatcctgcatttacagaaaaagaaatgaaaacagagagcttaaataatttgccacagtaatgtcgaaactaggcctttgaaccaaggcagtctagggtaaaatatagtttcaaagtatgaataagaattggtatttgtgttatctttgagtaagaaactgtccgatatgaatcacaacgtgggtgaatgtagtattttcctgaagtgtgaaagacttaaaaaaaagaatcacattgttcagaggtgctcaatggaaagaaaaggaaatgaacaagtttgttaaaagataaaaaataaaaaaaattccataccttgataatccttgaaatatcttttgcagaaatacaaatcaactgaaagacatgaaggtagattaggtcctacaggccagtgtgggacagggttgtgtaggtgtgcatttcaaacacatttattattcagaagtggtgcagataacgcttagattacaccgaagaatttagggagggtgggggatgaaggtctgttagtaaccagaaacacattagttgggcatcagtaaggggcaacataaaggaatggttcccctcaaaaacgaacaaaccaaattttatacaaaaaaatgaaatgcagcagggcgcgatggctcacgcctataatcccagcactttgggaggacaagacagcggatcatttgaggtcaggagttcgagaccagtctggccaacatggtgaaacctcatctctactaaaaatacaaaaaattaagccaggcatggtggtgggcacctgtaatcccagctacttgggaggctgaggcaggagaatcgcttgaatctgggaggcggaggttgtagtgagccgagatggtgccactgcgctcaagcctgggcaacatagtgagactctgtctcaaaaaaaaaaaaaaaaaaagatacaactaaccatgtaagctaaaggaggggctcttaaaagacacagatatagtgacttaatttaaatactgcgtttacttagcaaaagttcatttccccaagctcttctgctcaggaatgaaaacatggcagacacaaaacatggaatagagacctggcttaaagtctccccttgacactttgtacttgtatggcttctggcaacttacttaataactctgtttctcacacctttaggatgaggattataacaataactacatcgcaaagttgttgtaattaaatgaattagtgcgtgttcaaaaccaaaccagaccaagtggttcaataaatatctgctgaataaataaatgaatgaacaaagtggcacatgggccatcttaggcttggtgtagttttgtagattgccgttctctgtcctaccacatgaaacttggattcggccttctgttctctgtcctactacatgaaacttggattcagccttcactaaagcttttagaaacatacatataaagtgagtatatctgcatgaaatggcccctataggaagttggaaggattcttttagagggcaggaatgggctacaagtaaaaaggatcccagggtgggtggaaacagataaagatttgttctaaccattaggacagaatgtcatatggcatagcaatcaaggccagattctccctctgtaagacccctaataagtacaaatttaactcagaattcatctctaataacacagccacagtcacagtgatgtaacagagggctttactgaaaaggttgacaaatgaaaagagatctaaaacccaacaaatcttttagttaaaaggttacttggaaacagaatatagtataaccaagttataaaaatgcaaaaaacagcttataagaactttctttcgacaatgtcattgtttaagaatgtaactaaattacttttgaggtatttcataatacatgttgggtattttaaatagtaaaaaaaaacatacatatgtgaattcagtaatggctcaaatattttctatttagtctgataaattaattggcacttaaaataactatactttattcataaaatatccaagataaagaatatgctatataaaataaccaaccatttaatagtaacatgcttacagtggctcaaagctgaatgtgacaaatgtactccaggaaaatgtatttaacattggacctagctatattctaatcctaaacttacttttttggggtgtggaggggtggagtcttgctatattgcccacgctggtcttgaactcctgtgctcaagttatcctcccacctcagcctcccaagtagctgggattaaaggtgaacaccaccacactcggattaaacttacttctatatgaaaaataaccagactaacttttaaggattagtggttccaccaattcaattttaagactactaacagaattttataatataaacgcctacgatacgacagcatacataagaaaaatattttttaaagttttagtaattcaaaccaaaacatgctgtaagtttaaaaaaaattcactaaaaaattagttgaaaaaaatacacttaacactagagtacctttctgaagaaaaaactttttatgacttcaatgacatgttatttttaagcagcagcggaagtcttaaacacctttacatgcttcgaaatactgttgatgatctgattttcaatactgtattgggtgccattaaagagaccattgttctttgaatcagtctctgtgttgctgtgggaaacacggtaaggcagaagcactagaatcatggaggcaaattactgaaacactgtgatactgaaatactgctggcttctggaataatcttctgacatgtggaattagacatctgaagtgtcgctccaatcagtcacagttactaagctgctttttaatgtgcttgattcattttcttgaagtcctgtaagtggtgggtagaggcagaagagaaggcctcaatggttaaacaagcacattgtcaagtctataaaaatccataatttcatattgtcattaatcactcagtgtctaaatctgttcatgaatcctcatctcccaaccctcatgagctatgtataggacgccactttaaaatccaactgtgaactggtcgcatctctaggatacactcaggacccttggatgcaagcttctgccctgcagcctacaaacagcagggaccacatcctgcttcccactccttccccagcattcagctcagggcctggatgttgaaggtgctcagtacatttgtgttgtagttactgactctgagtgaatagatggtaaagaaagaaggatgaaattagcaagccaagtaaagtgttaaaaacatattttctaggtagataggattaacaacgaagtcaattttaaaatgccatgattttgagccagtgaaatagagtgcagagaattccactcaagtttgactctagaaatgtgttcctccaggggcacaggtttatgatgttggaggaaagagacaggagatgtccttagggcatcctcttggccctgtaaagagtcactctaatgccaacaggtctcctggttttcaataattagagttgatgcttagcacagataactgatgccagttatgcaacagctatgttataactggacaatgtgagagaaaaggtagcgtgaaggagacaggcagcaacatcttatcttacaaaggggcgagaggctgctgaaaatggaaagagcaagggtggagacatgcaggtattaacttaaaattacagtctgggtgcagtggctgacacctgtaatcccaacagtttgggaggctggggtgggaggatcatttgagcccaggagtttgacaccagcctgggcaagctggtgagaccccatctcttaaaaaaaaaaaaaaagtaataaaattataagtaggagtacaaaaacagtgaagaaggcgtgagaggtgcggtgggtggtgaaaatgagccaagtccccatctgtctttgcaggacatcaacagttaatatctaaagtcaatgaatcaacaaagagtggtttaaggccattactgagaggcacagagctaccactaatgaaggtggtgcgatggcatagagaagccttctgaacaactcagctttcaacatgtgcaagaattactttgacaaaaaaattacaattttctaatttaaaaaaaaattactaagttattgggcttatctaggctctagattgggggatatgaaaatcatttcaagtaattatctcatagtatttcatcccactgactacaaggctacaagagaaacctcccttgggagaaaatgaagaaaaatatttaatagggaaacagactaatacagagagactgccagaagagtggtctcattcaggtatatgatcagaaattttaattcctaaaaggcatcttcatgaagagaatacgtgtatagacatttttaaaaataatataaaagctgggcatggtggtgcacatctgtagtcacagctactcaggagactgaggcagaaggattgcttgagcccaggagtttgaatccagcctaggcaacatagtgagaccccatatcctaaaaaaaataaaaaaataataataataaattttttttgagacagagtctcactcttttgccaggctggagtgcagtggcgtgatctcagctcactgcaacctccacttcccaggttcaagcaattctcctgccttagcctcccaagtagctaggactacaggcacgcaccaccatgcccaactaatttttgtatttttagcagagacagcgtttcaccatgttggccaggatggtctcaatctcttgacctcgtgatctgcccgccttggcctcccaaagtgctgggattacaggcgtgagccactgcgcctggccaaaaaaaaaaaaaaaattaaaagaatacaaacaatttgggggccacgagcggtggcccatgcctgtaatcccagcactctgggaggccgaagtgggaggactgcctcagttactggggaggctgaggtgggagggctgtttgagcctagaaggttaaggttgcagtgagccatgatggcctgggtgacaataacaccgtttcaaaaacaaaaaataaaaataaaaataaattaaaaatttaaagactaaagattagtcctata

SEQ ID NO: 10716 - DNA, 34502 bp, Homo sapiens
  misc_feature (1)...(34502): n = A,T,C or G, or insertion/deletion polymorphism (see Tables 1-2)
tctgtagtgacttttcccactgaagtcttcaatccctcaaagtaatccatgaaggctggaattaactccttccaaactcctactaatgtaaatattttacttcctcccatgaatcacaaatgttcttaatggcatctagaaatgctgaatcctctctagaagagtttcaattgatggctcagatccatcagaggaatcactgtctaaggcagctttagccttacaaaatgtacttcttaataagacttcaaagtcaaaataatttcttgatctgtgggctacagagtgaatgttgtattagcaggcatgaaaacaacattcatctccttgaacctctccatcagagctcttgggtgaccaggtgcattaccagtgagcagtaatattttgaaaggaatccttttttctgagcagcaggtctcaagagtgggcttgaaatattcagtaaactgcactgtaaagagatgtactgtcatccaggctttgttccatttgtagagcacagacagcgtagatttagcataattctcaaaaaccctaggattgggcagggtgcagtggctcatgcctgtaatctcagcactttgggaggccaaggcagatggatcacttgaggtcaggggttcgagaccatcctggcctggccaacatggtaaaaccccgtctctactaaaaatacaaaaattagccaggggtgatggcgtgcacctgtagtcccagctacttgggaggctgaggcacgagaatcacttgaacctggaaggcagagattgcagtgagccaagatcgcaccactgcgctccagcctgggtgacagagtgaaactctgtctcaaaaataataataaaataaaaaagaaccctaggattttcagaaaggtcagtgagcactggcttcaacttaaggtcaccagctccactcgcccctaacaagagagccagcctgtcctttgaagctttgaagccaggcattgacttctcctctctaactaaaaaagtcctagatgtcatcttcttctaatagaaagctgttttgtctacgctgaatatctgtcgtttgatgtagcagccacctttatcagttacctaccctagctagatcttctgcatatcttgctgcagcttctctatcagcatttgctacttcactttgcacttttatgttatggagatggtttctttcctgaaacctcatgaaccgaactctgctgattccaactttccttctgcagcttcctcacctccctcagcctttgcagaattgaagacagttggggaggatcttgctctggaataggctttggcttaaaggaatgttgtggctggtttgatcttccatccagaccattcaaactttctccacatcagcaataggctgttcttctttctcatcattcatgtgttcattggagtagcactttcaatttccttcaagaacttttcctttgcattcacaacttggctgtttggcccaagaggcctagattttggcctgtcttggctttctaaatgcctttcttactaagcttagtcatttctagcttttgatttaaactgagagatgtgcaactctttctttcactcaaacacttagaggccattgtagggttattaattggcctaatttcaatattgttatgtttcaaggaagaggaaggcctgaggagaggaagagagatgggggagtgactggttggtgatcacaacacacatttatctatttatatggcatggttccgcagtgcctcctaaatgactacaatagtaacaacaaagatcactaatcaccacagaagacataatgataatgaaaaagtttgaaatattgcaagaattaccaaaatatgacaaagggacgtgaagtaagcccatgctgttggaaaatgatgccagtagactagctcgatgcagggttgccacaaaccttctatttgtaaaaaatgcgatatttgcaaagtgcaacaaagcaaagcacaataaaataaggcatgcctgtatcgctacaattttaatccaacataagcaccctacacagtatgttccaaagggaaaatacccccaaatcaaatgcagaaaggagtgtcaaatagcaagctctcaataaatgttagctactgttattaagagctgttaaggccaggcacggtggcttatgcctgtaatcccagcactttgggaggccaagacagggggatcacctgaggtcaggaattcaaggccagtctgaccaacataacgaaaccctgtctctactaaaaatacaaaaattatctgggcgtgatggtgtgtgcctgtaattccagctactcaggaggctgagataggagaactgcttgaacctgggaggcggaggttgcagtcagctgagatcacaccactgcactccagcccgggcgacagagtgagactccatctcaaaaaaaaaaaaaaaaaagctgttaaattatgatcggcttcctgtgtctcagagtcaacctggccagcatggtgaaaccccatctcttctaaaaatacaaaaattagccagacatggtggcgtgcacctgtaatcccagctacttgggaggctgaggcaggagaatcgcttgaacccaggaggtggagattgcagtgagccgagatcacgtcactgcactccagcctgggcaacagagagagactccatcttataaaaaaattaatatgtaaatattgaaaagtagtgacaaaacaaatgtggcaaaacgtcccttggtaaatgtgggttgagggtatttaagagttctttgtgctatttctgcaacttttatgcacatttgaaattatttcaaaataaaaagtaaagtatatataaataagaggaagctaggaagtgacaaaaaccattaaaggaagaataagaaacggcagttcggccagcagccagctccctgctggttcccacgtcaggcgctgtgagaagccctttgcctctcggtcctgtgtcctcaccatgcacccttgtggtcagcctggaaaggccaacttgatagttacaggctgcttcagatctgccacccacgkggtgacaagtcctggcgcgttggcatgggtggtactgaaaaaggctatggatccagggcagtgcagcggccagtggcaagggatgaggcggggtctccaatggcatcgtttgaactgcctgcaacctttttacccacatgtctcatgaagggatcaaggagaaaagcactgtggtctgggaaaagacttctagcactgagatgctgccttcaggggcaaagattaacctggctccccagaagaggagcagtgctcattgccagacagaagagggcgatgttttcgcccatgtcatcctttgaataggcaccgacaggctttggccgccagctgtgcccactgggtgtggtttcacaaatctgcaaattccaagggcaagattagggtgaggttaatgagacagggtcaagtacaagttcaggggcagatcgtgtctttactttgttactttgttcatcatggatttttcttcattaatttttgatttttcaaaatattgcattgaatgttatttagcttgattactgagttatttggtaactccttaaattttgtgcctaaggctagtgtctcattcgccttgccctagtcctgtcttgacagatctaatccattagtcgtatcgccaccagctcagagtttgcaattaggcccttttgtacctataaagaaaggactgacaaaaggaattaatcctgaggacgtaaatacctgctttttttttttttttttttgaggcagagttttactctgtcacccagcctagaagactggaatgcagtggtgcaatcataactcactgcagcctctaaatcctgggcttaagtgatcctcccaacctcccacctcagcctccagggtagctggggccagaggtatacaccaccatgcctggctaacttttttatctttagtagagacaagttctcgctatgttgctcaggctggtctcgaactcgtgggctcctgcctcggcctcccagggtgctcgggttacagatgtgagccactgcacccagtcaaatgcctgcttttgatgtcacttcacagccagcaactggagaccaacttctttatctccgagtctcaatttcttcatctgtaaaatgaggatagcaattgctcctttgcagtttattctgaaaacagagtatcaccccaactgagtacccctgagggccaggcaccgtgctgagtctgccctttagttataacctctctaaattttcacagccctaccatgtaagagatactattaccccatgttaaaggtgaggaaaagggcacagagaagtttggttatttgtccagggctgaacagccagtaagtaaaagtgtatatgctttaacgtcatcagcattcccgacrtgagatgacccccaagcccccggagatatttggcaacatctgtcgaaatttttggttgtcacaactgggggatgtgattggcatctagtgggtagaggcaggggatgctgctaagtgtccaataatgcacaggatggtccccacaacaaagtactatctggccccaaatgtcaatcgtgccaaggctgagaagcctgctctatgctatgctcccgagtcagaaagttacatgagcacttagcacttagtgctccatgaaaggtagatactgttgtggtttttgttattattacattttgtctctatggctgggggttcccgtggcttccagggaagctgagttcccttggtaccacacccacactgtgatcaagaaccccgtctctaggtcaaacgtggtggctcacacctgtaatcccaacactttgggaggccaaggtaggaggatcgcctgggccctggaattcaagaccagccggagcaacatggtggaatcctgtctctacaaaaaaaacacaaaaattagccaggcatggtgacatgcacctgtggtcccacctacttgggaagctgaggtaggaagattagattacttgagcctgggggattgaggctgcagtgagctgaaattgtgccactgcactccagcctgggtgacagaacgagaccctgtctcaaaaaaaaaaaaaaaaaaaaaaaaagaacttggtctctggagtccattagagtatcatacgtcgcattcagcaatgatttatgagcatctgctgctacatgacaatcctgttccaggcagcacagacacacggaggtgccccctgcccctatgtggcagcctggtggagagacaactttagacaaggaaacacacaagctcagagataataagatgttacaatgcatgccatgatgtgaaaaacctgggcaccatgagagagaagacgagggaagaccctgatggggtcaggaggccaggagggcttctctgagggtgtgacatttaagctgagccctgaggctggaggaaggaagagccctgtaggcggagagaacagctgtgccaaggccctgaggggggaaccgaaagccaggcagtgcaagggcagaccagtaggggaggaagaggggagtagagtgttatgacctgggaaatgtgagcaggtagaggctacattaagaagtttgctctttgaccaataaaagccctggaaagattttaatcagagcaggcctgcccttcagaaagtgactcttgaggtccaggcacagccctgtgtggaagatagtgtgtgaggctgaaacccagagtgtgtcatcatctggaaacaaccctgcaaaggtgagaggtttgtcatagttacacaactttaactaatgcaccttcctccccgcaaactctaagctggttgtgaaacatgacgatggagcattttgcatatgttacaaaattattgttaatgctcattcatttttggacaaagaccagcatcagtcactggaaacacctgtttgggtcacgaggcttgtcttctgccaggagtggagactttcccacagacttcttgtttcttcttgctgcttttgggtgactcagcctatgacacttttgctcctcctgaaatctccatatcttgcntttctcaaattccaaggtagcctttgcgcaacatatcactctccactgactcttgtcccatcagggcccatagtggatggctgtatgggggccatgtgactgaactcctgatcctcgtttcagcccactcatgtgacatgcatggagctcttcagcagggacttactgaccaggacaagagcttgagactttgaggggatctgattgtcactgcacaatcaaggacagtattcccaagagtggatgttgctcaagatagtccaaggaattctatgaagaaaaggactccacagacaataaattttggacaccctgtttcaacacagttaagcggctttttataattacaggacttttcagaacatttaatatgctaatgtgcattctaaatctccaagaaagaatgatgcatatttatcttttcttccaggtgcatcttagagactggtgtttgcaagtatatggagcaggaaacttcatcccgaagatggagaccccggggctgtcagcaggcgttaggcaagtgcctcaaaattcccaattcccagcaagagaagccaactgaaggatgagacagggtttctgccttccctgggtcctccagtattacatggaggggttggagtgaaccttctggaggtggggtcaatgactcttggaggtaggggaaagcttcctttgaccmagttgcacacaaagacagaaaacgtgtttgcatgggcawtgtttaacctgcttaaaagaatgaaaagattttagcacttttttctttttctgtaattactaaagaagtacatgtttttgcaaaaaaaaaaaaaaaatmaaacaatmtacaagtatatagagtaaaaagtggaagtcctcctttcatctcctccctgcatccctccctgcaccctggagtgttccatattaaggttttggtatgcctggttcagtgggtgagaagattaatctggagtcagcactctgagattgaatctcagctttgccacatgctagctctstttccttgggcacaagcctcactttgctcatctctaaaataaagtagccgtaggaagggcttggcaggtatgggatgagatgaaacacagaaagccctaatgcagcacctgaacctagttggattcagttaaatttrgccgttagaattttccttccagaatccaggcattttttaaaaggtccaatttcattcaatggatgtgctaattcgagaatggggtccatctcttaatctgttcatgtgactcttttttaagtcctcaagggcagtttctatgcagaaaccactatttagaggtttactttattttttcaagttcatagtcaaattgtcaaagctggaaattaaaaaaaagcagattacttgactttctttattctacacattagctcgtttttaatgctaggaactaagaacttttctaggactttgatggaatgattactatcttagaaaatgccatgcctccataaatatatatgcctactatgtacctgcaaaaattaaaaataaaaactttgttaaaagaaaaaaaaaaagaaaatgccatgcttttaagttcagcttacaaaagttctcattctttttataaatccagctagaatttccagataaaataaaagttgcccarttgaatacgaactaccccaaattcaaatctacctactgttctatatttttatttgttaaatctgccaatcctaaacccaacaaacctaaataattacttataaggggtttgtggccaatttataaacattttatactttatttaatatgccctattttcttttaaaagttcttcaattgtctgaactaacaaaaaagctacttttaaaaaatactaaatcatttgaattctaataaagtaaacaaacaaaacattgatgataacctaaagtgtttataaatgttccagaactgtattcagacaaaggtttcaamgtaaagtcatgaacctgaatcaaaccctaccaagtgcacattttataagagagttacaagattttctatatagttggcccagcagctctyattaagtccatgaaataccgcatattccatcttaaaacacacaaaaagagtataccatggctctgagtctcttaaacatttctacactttaattctaaatcttttttctggttggaagatgcccattcaccaagaaagacaattaaccattccctagagctcctttttttttgtttttgtattttattgagatggaatctcactctgttgcccaggctggagtgcagtggtgcaatcttggctcactgcagcctctgcctcccaagttcaagccattctcctgcctcagcctcccaagtagctgggattataggcgcccaccaccacgcctggctaatttttgtatttttagtagagacagggtttcaccatgttggccaggctggccttgaactcctgacctcaagtgatccacccacctcagcctcccaaagtgctggggctacaggagtgagccactgcgcccggcccagagccacctttaccagagattcaaccaggcctgaggtcttaggttgcagacaacagggagattcattgcagcacgaactcaggaaaccatttccttccatgtactatttggggttatcttatagaattcctggcatgcttggccagtatgctgcctggatgtatgttggggatatatgtataattttccctgtggctgtggccacagacccatcaccataagaggggttggtccacagatcccgatgctggcttggagttattcttattccctacccttttcacagaattgtctttgccaaagtccattaatataccttgattggattttgcttttttttttaatttttttttgctttacagatcttcatagtttcctgcccatatctctaaaagtcattttgcttgagttgatatcctacagttcttacaagacctttctctcccagggtcacacaactctcgccaatattaaattaatatcagcttcaatcacgggtctctccatgggtttcacgggctatttgctcgcagagtccagggacattttcctcatccattccatcagatccccaattgctttctctggcaacacactcctagtatttgtacggtaaagctgcctaaaaaaattaagtaattcaaactactcttgaccttactttacaccaccagggcaattagagtcacagtctgggtgtgtctgaggacagcaggccgccaaatcccagtgatttagagaaaaccgagcagaatttcccatgcctcctgcctcattgtcccccagcagaaggttccgtcaccccaggtgccctctagggtggaccacttccgagttcatccactgtcaggaaaaggcacatggcatgcaaccgcangaccgatgactagatgtcagagctggctcccggttgggatatgagtgactttgtggaggatggcgcctaaatgaggcatgccaatttcngcaccagggtgacgaacataagggctcctwaaaggctagcccaatgtatctgtatttccttggggattaaaacccatgatcttcagttcctcagagaactgaaagttgcaaggagaaatccagtaattcctgttatctgcaggctttataagtcagtggagcctgcggaagtggccagaatccagcactccaagcactgctgtcttctcacagagtcttgaagccagagcagyrccaggatgtcacgggagctggccccactgctgcttctcctcctctccatccacagygccctggccatgaggatctgctccttcaacgtcaggtcctttggggaaagcaagcaggaagacaagaatgccatggatgtcattgtgaaggtgagcccctttcctgggaggaggatcccagacacccctcacaccctctctcctgtctgcagactttaagagactcaaggaacttaaagttggcccttagggggaatgtagaagctggcttggaacaataaccacttcaactctctgtacctcctgccgtcatcttaaaacaggrgtgataacaatggttccctccagggttgctggggggactacaggagttggcaaatggaaagctcttaatgtagtatctggctcattatacgttccagataagggttagccattatgatttttattgctatttattgaatgcctgtatcaggcactataagcacatggtttcacttcataatctttatgaagagggactattactccccatgtagaggtgatgaacaaagaaagatgaagtaaccttatacagctactccttttcaccagcaaagcccagctcctttctctctctttccttttcttctttctttcttttctttctttctctctttctttctttctttctttttctttcttcctttttctttcttctttctgtcttttctttcttcttcctttctctttttctttgtttctttcttcctttcccttccttacttttttccttccttccttctctctcccatcctcatcatccctccctctctttgtctttctttcttcttctcctccttccttcctctctccctctcctctacttccccactccttccactttcgcttacgctttccttgggtgatatacccaatgtctggggacactgcttgctttctctggagtcaattgactccctttatcctacaggttaattaatttttgatgctggcaacttaaccctttcccgggactctggaaaggtacttattaccttaggaaacctgagacaccatggtgtggtaggggggccaggagccctgggtccagattccacctaccagacttgtgagcttgggaggccctgcccctccctgaaccaccagctcccctagtaaaatggygaccacatccaaataccacctgtagcactggctggtgaagagaactcagggtgcctgaggcacccagcagagcctgcagcaaggtgggtatycatgagccagagccgctgctgttgctgtcactgggaaggaggattggagtgaggactggcaggctctgttcttccttggacgagcctctcagacccaggtggccctgccctttgggaggtaaccaaggccttctagatggtgktgtttagccaggatagcaatgccaagcctgtgggagccatgacaagattgttcaatgggaaaccctgacatgcaaggcaatgattttccccacttcacacatggcccgtggagcctgggtagccactgagttcccatctccttcctcactgatgaaacccggctgtctttttgttccttggtgagtccatcntgggggcttgaactctgcatctcccctgagcagctgtgtcctgcagagcatgtccgaagtccttgtcaaggctgcctcaccctccccatcctaccaagaggccatccccaaaacactgcaagagctaccctacagggcactcacagtcacccgagaatgccaggcattcagaataggattatccctagcgcccattgaccaagcacctcctataggtgctaatttttgtatttttagtagaggcgggtttcaccatgttggccaggctggtctcgaactcctgacctcaggtgatctgcccatcttggcctcccaaagtgctggtattanaggcgtaagccaccgtgccyggctgggactgtattttaacagttcaacatggtgggctttgtagtcacgcagacctaagttcaaatcctgactctaccacctatcctggctgtatgactttaagctagtcactcaaccactctgagcttggtttctgcctatgtttaatgggctaataagcatagttaccccacagggttgttgtaaggctcggagtaggtttgcagtaaatgtcagcttttataattattatcattataattatacctctttatttctaatccagtctgttatctttgcttactaagggcttaataaatatttattattattattgtaattattcaagcaaagccaagaggcaggatattgtggggaggtcatgagcaaggggctctgggcttgaattacataggttcaaattctgcctccgccattttctagtagggtgattgggagtgtaatttactcaactttctctgagtctcaygctcctctttaaaatgtacataacaaaagcacctacctacctcagggagtccttcatttagttcagagaagaaattattttaataagcactcagtgcaatacttaaaaacagtaagtgtccaataaaaggttttatttatctgtggtaaatgacctcaaacccctggnaattctctttcttgcaggtcatcaaacgctgtgacatcatactcgtgatggaaatcaaggacagcaacaacaggatctgccccatactgatggagaagctgaacaggtaacatggggaagggtgggccctctagggctcaaggtcaagtgcaagggcatctgaaaacccctgggaactgaaagtaatgtgagatcccgcacttgaccaccagttcacacagccagtgttgcccaggagtccagctcccttagccacggtcctgagaactttcaaccagttgattttactgtgataaaatagaataggggaaatagatgaggggtctggacacagaaagaaatgaaaaaagcagatgaggctgagctaaaaagtacagttatgaagaaaatgttggagaaaagagaaaagattagaaaccaatagtagaagaaagataataaaattacaacatgctcacacacaggaatattatgcagctgttaaaagtcatgctggtggccaggtgtggtggcacgtgcctatagtctcacctacctgggaggctgaggtgggaggatcgcttgagcccatgaggtttaggctatagtgagccatgatcacaccactgcactccagcctgggccacagagcaagaccctatctcttaaaaaaaaaatcatgcttgctacagaataagttagagctaaatattccagcacggaataatggccacaatatattgaaaaaaagcaagttgagaattgcaggtaaaatagcccatttgagtcatcatgttacatgaataagggtgtgtttgtgtttccatgtgcatagagatgaaagactggaaggatgctctccaaactattaatagtggttacttctggtggggggggggggggtgtgatcagagagctgtggtgaaaggggttagtgaaggagtgaggggcacttgcttcttattttagtactttttaaatctgagactctgttgcccaggctggtatgcagcagcaagatctcggctcactgcaacctttgcctcctgggttcaagtgattctcctgcctcagcctcccaagtagctgggattacagtcacacacccactatgcctagctaatttttgtatttttagtggagtcggggttttgctatgttgcccaggctggccttaaattcctgacctcaagtgatctgcccctctcagcctcccaaagtgctgggattacaggtgtgagccgctgcacctggccatctcagcaagaaacacttaatagggacttttgaacaaaagccatgtctgggtcttgggcaggagcaagatgagatggtagatcctggtgccatcatcccccaggctctgggcttatccatcatagggaaggcatgtgtaggacaattgtagggacaggcaagaatccatgtcagtctgcctaagggcttcccttatagtaagggaactgagtgggggacctgcctgagtyacccagccaggaagtggccaagcctacctttgaacttgcgtcacatctgatctcatagccagtgctctattctttgtcatctcagccttccttggagtgtccccagtcaggtttatgggagactgaggggacaggtttgtgggggactgaggggacaggtaggctccagtcatctcctccacagtcagtctggggcgagtcttttcaccaccagtggtcttggcacwccccaacctatctagactgtcgcggactccaagcagagccaagcctgtttgtctctttatcccccacaagccaggatgggccttagtcactttgcaactgagtcaccacaagcagtttgctaactcaggacttggcaggctatgttcaaaatagggccagtctccccaaagtggaagcccggcagaacctactgttcacactcctggggccccaggggctaagtctgccttagcatactgcatctgaagtcccaggaatttctgtaaggtctaagttggcccctaaataccccttctgctttttttccaactgaatctgagaatatgctgcagctttagacatgccctagatctttttgtgagcagatagagtgaaattatgttaggctctgcccagagtggagttatcagcaggtttggtaaacacacagaaagagtccgctttccctggtgcaggtgaggggcaaggtcaatgggacttcatggctgtatccccagcacccaggatataaacaacagtgaattgaaatcgtggtcccaaagcttgtaaaaaaatgcctgrwggctttcagaggagagaatattcctgcttatcataaatgctcaggagtggttcgtggacacggacaggtggcctgatgacatttattccaccagaaagcatgagctgcagctgcagccatgggcatgagcggggtcaggggctgattctggccaagattgtcttctagggtctcagtggcctcccacaggtacaggccaaagcatgcgggttttggggtgagttggatctaggttcaaatcccagctttgggcttgcaaaccatagaaagggggtaatgataacactctcctcataaggcaagaaataatggctgtaaagatcgtggcagatgccacattccagccaatcaatggtgrctcytctcattggactcaaaggttatgatgaacagtggcccttccacatgatgccattgggcrtatggaggcagattggaaagaaaggaacatgtacagtaggggaatgtttactcttcaagatgcagtgttaaatctttgttttctagaaattcaaggagaggcataacntacaactatgtgattagctctcgscttggaagaaacacatataaagaacaatatgcctttctctacaagtaagtatcacctatgctccctggaacatggccaccaataaatcgtgaattgaatcaaaatgcatgtcttttcttcaaaaccaaattttgatttctaaccaattctcagtgttcatcaaaataattgctgtcaaaactaggggcctatgcaaagtattgactcttcaagctgaaaacacaaggggtctccaaacacctaatttgttggttggctccatggttggcaggccaggtgttctttactcctcatagtcaagtcctggcccagggctggaaagctgaggttctcagcacagctgattcctgaacttcgtattcttttcctcttcctgctagtaatttcttaagtctgaacattaacttttgggtgccacagataactagtatggctcagatcttcagctcccagattcgcaacagctccctggctgttgagaagagttgacttagccttgttctcaggaaaacgatcctgtgcttgagcctkctctggcttctgagaaagccatgggaacctacatctctgcttcatgaaagtagtaagaaaagggctgactcagctgggaggacttccttttccttcttatagggaaaagctggtgtctgtgaagaggagttatcactaccatgactatcaggatggagacgcagatgtgttttccagggagccctttgtggtctggttccaatctccccacactggtaagacccacacaggcctttctgtctgggacctccccaacrgcccatgaatgygcagcagccttgagcatgagcccattaaggaggcattaggctggatgtgacagtgcattgcttctaatacttcaatgtagacgatgcagttcagtgtgatggcaccaggcttgcttctcagaatgccatgactcaagacttccccagcccagaacccactttctggaagcaatggtagtccactctctttggagagtttaggctcatggaaattgttttctgcaattccttggtacctgtcaagtacaactcttccttcctttttaaaaatcctggctgggtgcggtggcgcatggctgtaatcccagcactttgggaggctgaggcaggtggatcacctgaggtcaggaacttgagaccagactggccaacatggtgaaaccccgtctctactaaaaatacaaaaattagctgggcatggtggtgcgcacctgtaatcccagctactcgggaggctgaggtaggagaatcacttgaaccagggaggcagaggttgcagtgagccgagatcgtaccactgcactccagcttgggcgatagagtgagactcttgtctcaaaaaaaaaaaaaaaatcctaagcaatggcttaggtgaacccctagcctagaggctcactctccctccagtcactgcatygcagactcctccacaggccgcagcgggtgaggaaatccaaatggattgctccctgaactctaacaacagtacttgtactggcccctgattaagtgccagcctcctgtaatccttgcaatgactayaaggtagggagtaggattatctccactttacatttcaggaaactgaggtttaaaaaggcatggagtcacccagctactgaaatggacaggccagggttgtaacccaggccaccacctcaggagctcatgttcttttttttttcttctgtttttgagatagggccttgctctgtcatccagtctggaatgcagtggcatgatcttggctcactgcaacctccacctcctgggctcaagcaatcttcgcacctcagcctcgcaagtagctcagactataggcatgcaccaccacactcagctaattttaaaatttttaaatagcgagataggtctcgctatgttgcctaggctgttcttgaacccctgagctcaagccatctgcctgccttggcttcccaaagtgctgggattacaggtgtaagccactgtgcscagccagtggttaacatgcagtgttatgcaatgctcgatggagtcaagaatcaaatattttttcagtacctactatgtaccaggctctgttgagggcactggacaagacagaggaggtgacattgggctgtgacctgaagaagtcagccatacagagggctggagaaagggcattccacatggagggcacagtgagcacaaaagctcagaagtgggaaggaagctggaatatttagggggaccaaaaagaggatggaggagtgcagtggaggcctgaggaggagagctggcaatgaggacacgtggggccctggatgcagcctgctgggctgagttctggctcctctctgtgtgacttgagcagtgaccgccccacagcccgtgtctgttgaggtaagagtgggaatccaggctgagaatgaggggaagtcccaggaggagctgctcagaaggcgacagctgctgttagcaggtgggccaggaacggcttctgaggctcgcgcacattgccacactcaggctctcagtcctccaacggtgggggaaggttttcagacacttcacaaaagtctttcgtgaagaccatgctaatttttaaatagctttttggaacttttgttcttaattacaaaggagtataaactgacaagcctcatttttttttttttagacagagtttcactcttcttgcccaggctggagtgcagtggcgtgatctaggctcaccacaacctctgcctcccaagttcaaacgattctcctgcctcagtctcccaagtagctgggattacaggcatgcgccaccacccccagctaattttgtatttttagtagagacaggttttctccatgatggtcaggctgatctggaactcccgacctcaggtgatccatcagcctcagcctcccaaagtggtgggattacagaagtaagccaacacgcctggccaatttttttttaactagaaaatgtgcgactgggctcggtggctcatgcctgtaatcccagcactttgggaggctgagatgggtcagtttatactctttttgtaactcccagctgggtgtggtggctcacacctgtaatcccagcactttgggaggctgagatgggtggatcacctgaggttgggagtttgagagcagcctgaccaacatggagaaatcctgtctctaccaaaaaaaaaaaaaaaaaaaaaaaacaaagctagccaggcatgatggtgcatgcctgtaatcccagttacttgggaggctgaggcaggagaatcrcttgaacctgggaggcagaggttgcagtgagccgaaattgtgccattgcactccagcctgggcaacaagaacgaaactccgtctcaaaaaaaaaaaaaggaaacctttaaaaaaaagaagaaaatacaaccataaatatatgcaatttttcctgtcaattaaaaaaagaaagaagagggataaaatacatcagaaacaaaagaaaatacagatttgccacacacacaaaaaggggaaaataaaagcactcacaatgccagcatggaacacagttgttataagtaaaatgtttatttagaaacagaatgcttgttccctggtactgcaaggaaaaatcaacattcagataaaaagttttctcagcaagccaattttactttctgcagaaagggtgctccttgcagatggaacaatggcgagagcacacctgaataaaggagggaagcaatttttatcctttactcagcttgtccctgctactgtgtcctgtctctctattggctggagccagaccacacaatctaagctaacccgactggctaataatttaaacctttcttaaataggtaaaggcaagggagaacaaaggaaaagaggaagttgcttatgccaaatagggaaggggcaaaggctgtgagctggaatgtgcctgygagctggaatgtccagcacaaatatcttggttaaggtacaaggacatagaatgtactatgtgcctgtgagcatgtctaacagctacataggatagagcttaacaaagagttattagcacaaagcaaggagrcttgaaggaagttagtctttaaaggaaactattatttctaacacttatgatttattctttaataagaagggaaactttgaagaggaaacttttttactttctacaacagtctaccagctttctcttagccatgaagggcaactgggagaaatgagtctttcgtgtactaaaaataggcagcctaatgaccccaagatcattaaaatctcggccactggctggaccctctgggaactggggacccagataatgcagcctgtgccttctggaggggacagcnggtttccctccagcagtgtttatgagaccttgacaggggaagtgtgtgacccccgcctctttcctgtttctcagctgtcaaagacttcgtgattatccccctgcacaccaccccagagacatccgttaaggagatcgatgagttggttgaggtctacacggacgtgaaacaccrctggaaggcrgaggtgakgactgctgtgtcagacgaattcccatctagcaggggcaggctctggtccctgagtgggatgagtacctctccagggagggggaggaggaagggcatgtgcaggctaccaccacttacagcattctttaaggcctttcttcagccctaagtatcccttttgctaaatctgcctgggtaccctgcatgtgggccttgggaattgccacactttcccattaataacagatgccaacatttactgagtgaatagctagtgccaggcactgtgctgagacttgacatggacaagtttatttaatcctcccaataatcccttgaggtagctacagtacctttctcattcccactttgcaattgagaagtgtaaggcatagagcagtcaggattgtttcagttgcaagggacagaatcttaacatggctcatgaaaaaaaggagcaattgattggtttgtgtaactgaaatgtccaggagtacttcaggcatagctggatccagggctcagacaaggtaatcagagcttgatttgtctcttcctttctatctcctggttgccctttcctctgtgtggctccattctcaggttggntccatccctgggatggcaggacagccaccagcagcctccagaccaaaataaattttctttcccacaaggcaacaaatagtgtgggactgagtctcattggctctgactgggtcaggtgtccatccctgaaccaatcattgtgatcagggtgttgasmtactctgattgactaaatctgtgtccaccccagctccaccccaaactcagtttgaggtggaggagggatgggtggtctcccaaaggaacttggggtgctgttttcacagaagggggcacatatttgccatccctataggctcagttctttccacttttggaagagaccacttgtggctgtgaggggctgtgaaagctcttggtaaatatggaagtgcacccaagggttcttcttctgtatttctcttttctcgtttcggaatgtgactcctgtgatcccccttcctcctcttgagttctgctgctcaaatgcaaaatgaatcaaataaagtgtgaacatagtccatcagagctggggcatggaaaagaccaggggtgtrtttcattgcttattaataaataggtcaaaagaaagattcattctttccaaaaattatgaaatcattcacttattaaacaagaatgtattgagcatctattgagtgttgggctgtggggaggcatcagtggcctaaaagtgaacaagaggggaaactgcttcagtgaagcagactgggatgtgattctttttttttttttttcttgagatgaaatctcgctcttgtccccaggctggagtgcaatggtgcaatctcggctcactgcaacctccacctcccgggttcaagtgattctcctgcctcccragtagctgggattacaggcatgtgccaccacgcctggctaatttttatatttttaatagaaatggggtttcaccatgttggccaggctggtcttgaatgcctgacctcaggtgatccacccgcctcggcttcccaaagtgctgggattacaggcgtgagccacggcgcctggctgggatgtgattcttgacttcaccatttgaacctcccagtcctgtggcctagagcaggtcacttaatctctcaatcctgtttctatagaagttagtgggctcttgtacctcctattgtttattgctgccaggtgtaaatttaaaaacacctagtgctaggcctggcacatagtgaatgttcagcaaatcatgtctatattagcagaagctggtgatcactgaggttaaggatgacactctgtcctcaactgaacccatcaatcarggggaaaattgtgatcaccaaggtcaaaataaaatgttcttgaagaaaactctgaagtcagcaatgccccaccaaacaatagcacaaacaaggaaatctggcacttcctctggattgtggaatgttgaaaattctgttccaagagccttgcagggaaaaatatttccaagataggaagtttctcttggtggccttgggtgggggtggacagctcactcaatggtcccctcccctgaagatgcctcccacctcctcaagggactgaattttcacagaaataagtttccaacttcaaaacaataggagagaaagagtgatgccagggttgtcaatacaccacccaaattcacttttcctgcttgaaagcaaaaggcgttgattcattcgtatatttacaccctacagtagtttgagccagggacaaaagatgtgagggaatagattcactgaaattttttttatccacacctgactctgcatgctgaattatggaaatgtggcgactaagaacagcaaacattctccttcctgttaagaacatcctccctggtacgcactcgcctgtcatcgactcatcaaaactgtgactcaattttaaacaacaaaaagaaatttttaaagaccttatattcatttgctagagctgccataacaaagtaccatactgaagactgggaagtttaaacaatagaaagtgagttcgtcaccgttctggaggctggagtcccagaacaaggtgtgccagcagggctggtgtcttttgggggcctctctccttggtttgtagacggccatcttcttccagtgtctttacatggtctttgctccacttttctgtgtcctaatttcccctttttacaagaacgccagtcatattggattagagcccatccatatgacctcattttaccttaattccctcttgaaaggttctatctccaaatacagtcgcattctaaggtgctgggggttagaacttcaacataggaatttggccggggcgggagcagggggtagacaagattcagcccataacagaccctgttgtttactgggcctgggacgcagagtctttgctagagtccastgtgaaagcattctgcagcagcacccaccaggtgacagttccaaatcttgtcttttagaatttcattttcatgggtgacttcaatgccggctgcagctacgtccccaagaaggcctggaagaacatcygcttgaggactgaccccaggtttgtttggctgatcggggaccaagaggacaccacggtgaagaagagcaccaactgtgcatatgacaggtaggaggccctgcagggtgctgctggctcaccacagtgcttggtgtgcactaggaaagacgcaaggtggctgggcactgtggctcacgccagtagtcctagcactttgggaggcctcgatggatggatcgcttgagtacaggagtttgagaccagcctgggcaacatgatgaaaccccgtctctacaaaaaatacaaaaattagccaggcatggtggcacacacctatactcccagctactcaggaggctgaggtgggaggatcgcttgagcccagaagrtggaggctgcagtgagccaggatcgcaccactgcactccagcctgggtaacagagtgagactttgtctcaaaaataaaaaataaaaataaaaataagaaaagcacactgcttgcagagctgagtcaattaaatgtcaggcccctctactgggtaccacatgtagcgtatgaaccacaggaccctatgcggtggccctgggcactgtagcttagcagaggtaagcactggcttcgctatcagataggcctggatttaaatcctgacattatcacttcatatgtctgtgaccaagagacaagctctctgtgtctttcatttcctcccctgtaaaatggaagttatcctagtgcctcactcatgaagatccgatgtggagtaaatgaaataacatgtcaggctgctagcacaatgcctggcatacggcaagtgctcattacattcatgggctgatcattgttccatcacaaagacttaccgcaattgatgcgcccaatccccatcattaggcattgggttattaccaagggtttgctgttataaatactgctaaaatcaatatcctctgtgcattttgtgcaagtatttatgatttcctcaggaagcaaccctaaaaatgagaccaattagtgcaacggtatttatatttttaaagytttagctacatattcctaaatgcaatgcatacatttaagtcctagcattccctcgtgctttttaaagtcccttcagggattttcaaacagctttcatctttgctccttcaatggggacagaggggggagtgcctgaggcgtgtgaatgttagtgatcttccatcacagagaccacaggtggggaaacccctaggagcctggtcccaggtggtggccacagttcccagagctcagcctgccacgaggaagtgtgagatggccatctgcatgagagccaccaggccactcgttttcacttcctctcggagttttttttttttttttttttttttttagacagagtctcgctctgttgcccaggctggagtgcagtggtgcgatctcggctcactgcaagctccgcctcccgggttcacgccattctcctgcctcagcctcccgagtagctgggactacaggcgcccgccaccacgcctggctaatttttttttttttttgtatttttagtagagacagggtttcaccatgttacccaggatggtcttgatttcttgacctcgtgatccgcccgcctcggcctcccaaagtgctgggattacaggcgtgagccaccatgcccggcctgttcctcttggagcttttgaggctggtgtttcctttgcagaagttatcactctgcaaagtgggaacccaaggcggggagttacaggggtctaagtgcccagaccccctattttgaaggacttccagcaaagcctggacgatggccactcactcagttacacatggcagttgtgtgcccgtgggtaggtcaagtcccttctccagcgccattcttctcccctggcaaatgagtgggaagtgattgaaaatgatacagaagaatcagaaggcaacatggccacagtagatcaggtcwggggtagaacaggttagaaaaagatgtttactaaaaggatcctgattttatacacatgtatcccaaaggatggtgggattacatgtgacattttaaagattcatttcttattttgatgctctgaattttgtttctcataacaacatgtataactcttgtgcctcttttttttcttttttttgagacagagtcctgctctgtcgcccaggctggagtgcagtggcaggatcttggctcactgcaacctccgcctcccgggttcaagcgattttcctgcctcagcctcccaagtagctgggattacaggcatacacaaacatgccccgcttttttttttttttttttttttttttgtaattttagtagagatggggtttcgccatgttggccaggctggtcttgaactcgtgacctcaggtgatccgcctgctttggcctcccaaagtgcttggattacaggtgtgagccaccatgcccggcctcttgtggcttttaaaaagtcataggccagttgtggtggcatatgctgtaatcccagctacttgggaggctgaggcaggaggatcacttgagcccaggagttcaaggctttagagcaacatgatcacatgcctgtgaatagccacggcactccagcctggacaacatagtgagacctgtctcaatacaataaaataaaaagtaaaattaaataaaataaacggagaaaatgaaaagccataaaaatgatgttttaaaaatgtaattagacaagatggtctcagttccagtctttgttccatgttcacatatttatcaaacacctctcatgtgctgagtgctgggggaacatgcaaagatgcccaggatctggctggtgccctggactgaaaacgtcacatgaacactggcctggtcctgcacatccctagaagaagtcagaaatggaagagcctttaacatgtcattctttgctttctgagtcttaaagaaagctttcacaaatgtctaacttgatgcgaagaatttacatttgggttgaattaaaagccgtagcccgggccgggcgtggtggctcacacctgtaatcccagcactttgggaggctgcggccggtggatcacgaggtcaggagatcgagaccatcctggctaacacagtgaaaccccgtctctactaaaaaatacaaaaaaaattagccaggcgtggtgccgggcacctgtagtcccagctactcgggaggctgaggcaggagaatggcatgaacccaggaggcagagcttgcagtgagccgagattgcgccactgcactctagcctgggtgacacagagagactccgtctcaaaaaaaaaaaaaaaagccgtagccctggagcggtggcttacaccggtaatcccagcactttgggaggttgaggtgggcggatcacctaaggtcacgagttcaagaccagcctggccaacagggataaaccccgtctctactaaaaatacaaaaattagccaggcgtggtggcacacacctataattccagctacttgggaggctgaggcaggagaatcgcttcaacccggaaggtggaggttgcagtgagctgagatggcgcactgcactccaacctgggtgacagagcatgactgtgtctcaaaaaaaaaaaaaaaaaaaaaaaagttagttgtgctggtgatgttagcaaatgcagataccaaaactgttgattagaatggggaaggcccactggtcactcatgaaatggcagtttgactcaccttgccattcctcgggaagtcactcaggaccacgtagaccacaactgcatcacccaacttgggatatgttagtttgtttccaaaactcatttgactacctcattcttactttttgtcattattgcaaagcacatatgctgtgatttttctcgatattttccattaaatcgcttaatttcttgctgaaataaatttttaaaagaaatttcatgatactagcatgagtaagaaagcagcagcatttgccataaattgaaggtaacgtaaaaattaagtccagtgaaaatcacgccttgttaaattctgccttaattctcttgcctgcagaatgctcggagatggcagcctactctctgtcaacacgggactgagggaggtattaaagacaaaccagcacctccctgagaatttctccataatcaaatcagggaaagtgaaaaataattgaaaaaggaacagcgttctcagtacgcaagtcattgttgtgtgggatagtgtgcgtgtgtcatataaaatcttctcctactccaccagaacattgcccacactgggagacagtgtcctggtgtccacagaaccatggcagggactgatcctatttcacagttgtaggcactgtcctttagggtcacaggctaaaaccagctctggactttgagcgccacatgaaagggccagactgctcggttaattccagacagcaaacacagaccttggtttgatctcagcaatcacaggttggattaacacaactgttttccctccccttgttccaggattgtgcttagaggacaagaaatcgtcagttctgttgttcccaagtcaaacagtgtttttgacttccagaaagcttacaagctgactgaagaggaggtaaggttgccatcttgtctttctatgccattgtcctggaargatgagttagcttgggcaacatgatgagacyccatctctatgaaaaattcaaaaaaattagctgggcatggtgatgcatgcctatggtcccagctacttgggaggctgaggtgggagkatcacttgagtccaggaagcggaggttgcagtgagccaagatcrcaccactgcactccaggctgggcaacagagtgagatcctgtctcaaaaaaaaaaaaaaaaaaagatgggttgatgccaccctttgaggtcaccactgaagacacaacattgggcactagaccttgaccctcaatgcctatgattctgtgatttgaggcccctccaaaatttctgatcgagctggtcttggaatgacgcttaccagtaagtgttctgtggggtgacttcgggcatttcctctcccctccctggtcctaaatttgctcatcgctaaaatgaaagcatctcccaggcatctcctaatttccatgtctacctcccctttctccttataggccctggatgtcagcgaccactttccagttgaatttaaactacagtcttcaagggccttcaccaacagcaaaaaatctgtcactctaaggaagaaaacaaagagcaaacgctcctagacccaagggtctcatcttattaaccatttcttgcctctaaataaaatgtctctaacagatatgaactgctccctgtacttaggaaacaagagtgatccaactgctttcattttttgacctgaatttattctgacttgagccaaattggaaggagaatcttttgtatctctcttggtctcatacctcccctgaattgtctaaaagggaaccaggggcatttgtagaccaaaatgatgatcttcatgccctgagccagagccccatccactgtcactggccctgctcaaccctgtcatgcgagaggctgcagggggaggaagagcgtcagctttcagtcctcatgaggggtcctgttccacacgcaatgaccagaaacaccaaggccccagctgcccctgtgatttgggcaattaactgttttaagagtctgccccctcctctctgaggtcaggccaccatcacgtctcacagtgttgagggataaaggccactcccacctggtttctctgccttcgaattgtcctccaactcagccagcccaggaagcatcagtgtcatcctctgaaatactaatctgaccacagcccaccctcagtcccaccctcagtcccaccctctgcccataaatccttcagcggctcccatcaccatcggagagagctcagtcttggccaccatgaaggtctctgctatctggcttattgcgccagccccaccttctgccagggtcccaccctgaacccctgctccaggaggatgtcctccgccctgcataccccatgctctccctccctgggggccttggctctgccccccccatgccctgccctattccagagcccgggccaagtgcccccagccctcatgtgcgccctacctctattgcaacatccaccacattatatttgtcaccaaggtcagtgttggaggtctttggggccccagtgtgacaaacacctagtgggctggctgggactcgaggattttgttatctttctgcaatcaaggaggctcattggagtccaacaacacagcaccatttagcctgtatccaaggtgcccatttttgtttgttttgctttgttttccctgatgtttctttgttcaagtcatacacgaacatggctaaatgtgtgaacagtaccgaagaataagcagggaaaaggaatgccgtgccctgaccccatccccgagtttcctgtctcagaaacagcccctcttcccagctcatgtgtttttccagagagtctgcacagaaatgagcactatatgtaaccttaaaaatacaaaatatagcacaccatatgcatggttccactcttcgcttttttcctttaatatattggggatgatgtgacttttgatgtaggagaaaaagaccttaagtctgacacttgaaattatgtaacatctgactgggggaataaaatcaaaagggccctggttaagcacgggaagccatcttcctcaaatgtccaattaacctcattggacaaaggtctcactggaattggtgaggggtgagtgatggcaaggctgctaacacatctgtcacccttctcctaagccagagctcatagtcccaggaaacttaccagtttccaaggtccaaaatggtcaaacaaggtcaggcgaggtggctcatgcctgtaatcctagcactttgggaggccagcctgggcaacatggcgaaaccctgtctctactaaaaatacaaaacattagccaggcatgctggtacactcctgtagtcccagctactgggaggctgaggcacaacaattgcttgaacccgggaggtggaggttgcagtgagctgagatcgtgccactgtactccagcctgggcgacagagtgagactctgtcaaaaaaaaaaaaaaaagtcaagcaagtcataaatgggcttattccggagagagaggctcatccttctgtcccaaagtactgcaagctccgaaagcccacatggctgggataagaaccctggctgctggggcttgagactccatgctgggtgggggaggaatgggaaggaggaccagacactaaatgagtcagtccatggctctgacttggtcctgacaccctgcagcttcctcccaacaagacatctctccactcctgcccaggagcaggttactggagccacaggcatctgccagctcttattccggccaaattctgacaggcaagagggcacagcgcagggcatgtctcactgcgcataacctaatggagctgcaaacatcctcctgtccctttgggtcacctggcctggcctgggcaaggaactctggtggccttttggggaaaatgggtgtcccctggtcataggcacccttttagccttggctttgtccaaagagtctaaagcttggctgggtgcggtggctgacgcctgtaatcccagcattttgagaggctgagatgggaggatcacttgaacccaggagtttgagaccagcctgggtaacatagcaagaccccatctgaacaaaaaataaaaaaattagctgtgcatggtggtgcatgcctgtagtcccagctactcagaaggctgaggcaggagaatcacttgagcctggaaagtcaaggctgcagtgagctgtgatcgtaccatggcactccagcttgggaaacagagcaagaccttttctcaaaaacaaaacaaaaaaaacaaacgaacaaaaaagagtctaaaccttggtgtgcactggaatcccagggaaccagttaccatggtgattcccaggtcccagtctcccagagtctgggccagggcccaggaacctgcaatttcaacaagtcccccggttgattccaaggcacatgatctgaggcccagatttgaaatcactctcccagtcccccttggtgaggcgaggtgtagcatggtagcaaggaccaggctcactttggagccatagtctctaccacctaccagctgtgggacctcgagcaggctacttacctttagtttccttgtgtgtaaaacagagataataagagaatcaacctcataggtaaagtttaaataagatgatggatataaggcatggaggatgtgcctgatgcttagtaagccctcgataaattaaattcccttacttgtatatttgtattaacagggcttgctctgttaaagggtaggccgctttaagtctgggtgtgcaggttgctcgagcttagttattcagaatgaatttttgccacacaaggaatcatgccagggttccatttctttgtcattcaccacggcaaatattttggcaggtaaccctgaggatggagacgcccctgcttccagtccttgtgacatccttttccttgtcaacaccactttcctgccacaaatacagaaaccctcccccagtgaccttctccctgaccctgctgggggtggggtgggtgaagggagcttctgcaattcagcaaccctgctcctatctctcccttgggctggagagggcaagtataaagagtagttgccaaaccaggaaagggcgacaaactgggggccacatccctcgtccctcccggaaagaggaaaggcacccagcccaggcaggcgtgagggtggaaagcagggcagctgagagaggctcacatttgcatcagctgctgagtctcctgatcagggcgggcttccacctgaatgatcctgaaggagccagcatccccatgtcacttgcccatgggccatatttcaaaggaggagcgggtccccacggtccccaagaccctggcaacagtggcgtcaatctttgggattcagggaagctactaaaattaaatcaaaataagggaatttgaggaaacaagaatctatggatgcaggtttgtgtgtgtgtgtacgtgcacatacacacgcactcagctctttcccaggggtctccctgcctggcacatattcctcggcctgctcagcttctggctgggtcataccagcccatgtccctgcctcaaatgcgtcttccgatggcaggtgggaggaggttggtcatttacagaaactcctcctgctgcccctctatgctctgggaaactctaccaccaaataccctgggagttttatttttccgagttatcattactttgagattcccgctcctgagatcttttcacagtttcctagaggctagagctgaaaatatccttaaaggtaataataagtaatggctgccatttgctaagggctgctgtgtgccaggctgtgtgctaagaggcagtggcgtgggccatctcactgaattccaaccgcagcagcgaggtggagtctgatgtcatctccattttataggcgaggcgagtgaggcccagagaagttaaacaacttgcccgagggcacacagctggggagtattgaacccaggtgactcacccattaggcacagcactgtgcctagggcccatggaaatgtgttaatttctttcagaatcagaaagaaaaacatgaactttggggatgaagaaaaaattaacataataataataacatgtttgtctttataccaatatagttgtaaaatacaattttaatattttttatgggggaaaggatctataaaggcaaaggtgcctaatgcccgtgaaagccacaatggggccctgggggaggcagaattaaaatcccggtctgcctgccttcaaagttcgtgctctcttcagtctagtctaatcctgtttacaggtgaggaaactgaggtccaaggccacacagcgaatggcagagccaggtggagagctcaggtttccagtgagccaaccaccatggcttgtggtccgacatcaccacccggtggccttttggggaacttacctttagtccagaggtgaacctagaaagagaaagggctcagacagttccagatacccgcaggaaacctccacaagccagtctgcacttgggctccacactcagcagtggtgaagccaggccagggagccaactccacactcacttgaggctgtcgttggaattcacacatctcagcctacacacacacacacacacacacacacacacacacacacacacccctctgccagggtaaaagcatcatcccccagagttaatatttgtaaagttcttagaccagtctggtccaataggaatataatataagccaaaatgtaatttgaaattttctggtagccatattttaagaagtaaaagaaataagtgaaattaatatatttaatattttatttaacacagaaatcagcaaactatacagcctgtgggggaaatctggcccaccatctgttttttttaaataaagttttattggaacaagccatgcccatttgtttttatattgtctatggctgattttgcactgcaatggcagagttgagtagttgcatagttgagaccaggtgatccacaaagctgaaaattcttactatccagtcttttagagggaaagtttgtcaacctctgatttagcccaatctatccaagtatggtcatttcaacataaaattcaatataaaaattattaatgagaaattttacatttcattatactaaatctttgaaattcagtgtgtgttttatacttagagtacatcacaatttggataagactcattgcaaatgctcaatggacatgtggttggatcatgactaccgaactggacagtgtagggcttagaacaatgcccgcagatatcaaacaggtattcattaaatacctaaataaactccccaccagcctttcttaactgacttccagaaagaattaagccctaacattcggggacagcccctgtttgtaatgaatcaacttctttcccatgcctgtagaatggtgtcattcctgggaggactgagaaaagtcactggtgtcattttctgtagggtttcatttattcacagaatcccagttgagaaatgctgcagccattccttttctaaggagcttgaagacttgctgctgatagagataattattattaatataaatcacatgtatagagccaggcactgtgctaaggtctttctgagcattgtttcaatgacagaaatgacaatggcctccctcaggaaggctcctctgtgcaccaaaggtgtccactgtcccccatacagcccttttcactatgtcctgtgagctccaagatctgacccctcattccccgggagctcagcctaggcccggcccacaggagctgctggatcaatatttgttgcattcaatcaagtaactctagagaacccgggggtcatttggtgtttgattcaacctggcaggtgtttttccagcagctctgttgtgcaaggctgctgtgtgcatctcaagggaatccattcccacattgatgctcactcacattcccaagactgcccagggaaaaccagacaagatagttgcattcgcagttttaagtggtctagctcctctctgacagttcaggctaagagacagaccaccagagaccagggaatagtgattcgtttgcccagtgctttctctgtccagcatgaggaactgcccttttgtccaagtaaggagggaagtgta
